United States Patent 7,365,185 (GENOMIC PLANT SEQUENCES AND USES THEREOF) - sequence listing, part 22

SEQ ID NO: 54003 - DNA, 1501 bp, Oryza sativa
attatgcatgcatgtcttttttcccttcttataaaattttctctcaaattacttatccgatctacaataatccaattacaccattatgttcgttacaattaaatcattacaacaagatcttacattattatattatgatgaaaaaatatttatgtttgtaaatgacatttattatatacgtaagttacttttatcatatataacaattacttttcgatttgattaaattacttcttatacattcataatgctctaagttgattatttttattattgtttttagtcaattctataatttgtggactttaatttaatttttagatagaccatatttttctctctacgacgaatttgcttttaatattgtaacaatttacttccattttatgctaaattactttatgatttatttaaattacttttagattttattgaatttactttcataaatgcatttacttaaaaatcttttctacactttacttgtgaatttactctacatagtttcttatttcaactcagtcataatgtaattatttctaatgctatagagagttacttctagttcattgctaagttacttctgcaattaaataaattacttttaaattaataaaatgtttgaatatattcaacatagatcttgtttagtcacatattttatgtagagtacaatgatgcaaatagattttgaaaataatactccctccgtttcataatataagtgatttttgagcgatgtgacacatcatagtacaatgtatctggacagactctccgtccagatgcattgtactagattgtgtcacatctctctaaaatcccttatattatgggatggagggaatatgtgatttaaaagatataagtcattaaatagattaaaaaaagacatgcaccataagctaaaggagaattatatatggaatagagtggtcttcggttagaactaaagcactacaatgcactacctagtgacgtccattttctatagaatctctcaagaagtcttaaaagaatcacacaagtaggtaatatataaataaacaactctacaaagttgcatgaacaaactcgactttattaatggaatataaaattaacaaatcattaaaaatacactattcctctttttttttctcatatgtttctcaattttatatctcaaccaattttaaaaataatctcacgaaatgctaaggtagtattagacaagcatacaaagttcttaaaaataaactcaactttattttgtgaaatataagaatatagaaacatatgagaagcgtgatgaatattatatcatcgtcagctagcggtactagtacagcagtgtccggatccaatcttgcacaatccaaggaaggtcaactacaagtaaatgaaattgagtttgtggcggccaaggcggtaagagaagcattgattcacccatggagagtcaggtgctccgggacccggcgccgccgtgctcaccggagccaccgcgctcgccgtgctt

SEQ ID NO: 54004 - DNA, 1501 bp, Oryza sativa
tagaaagtcttataacctgaggaggtagtatgatggaatttcgattctttttcaattgcacagttaacggtagcaatgatgttttatctttcttttttctctctttcatgtcagcaaatattctttattggttaattaatttactggatgatgtgtagcactgaaagaacacaacataacggtaattctaatgatcggtagtacagttttgttggtaactttttgtgacaagtcgacaagcacgatcacaacacctaaacgccttgcggtgatatggagtcgccaaccacctcgatctagccaaacggccaaatcaagatgggtttcgtagaaaaacagttaaaccggctagcggagccgatttagagatcaaaatcagcttctaggccgatttagatcgatatgaggataactacccgtctcgtgggcaaaacggaaggttttcaggacaaacctacagagaggcgtcgcactctcgcagcggcggcggacaatttacagcgcaaatcgacgaagatggactaaaactagggtaaaatagaaaacatggtaaaagaacgatttaagtagattgtattcggggttttacaatgaaccggccttatcccttaaataggggttggtcttgccttctccacatccaactcgggatagaaactaaagaaaacatgaaacatgccttcctgagtaaggaaactcgagacctgacgaaatcggactcggaccttgacggtctaaccgcccacatacctgcggtcagaccggccctactagccggtcagaccgcccacatacctgcggtctgaccggccctttgaaggaaacccgacactttctaaattttgataattttcccctattttgtccataggtgctaaatttgggtgtaaacactgttgatttgtttccgttgttatctcctgaacatcctcgaacaaacggggttaaacaacacttgtctctttccatttaatcatatatagttgcctaataatctgaggctttctaatttctgtttagatctcaagcggttttatctgcatgggtgtctcaccaaagaccaaacaatttcagatctgcatgtttatatgagatctctgtttatattggtgtgcaccagcttaatttggcccagataagaaagctgaaaccgaatccaacagggtctcttttaagttgtaaaaaaaatgaagaaaaacagggactcttttttgagttggactctacttggcccaacttactttgcatagataatttcctttctttcctaggggcctatagtttttgcctgaattggactctacttgggcccaatctatattctcttgtggcatagatcttgtttggcctataaatattccaagacctattgcttatccttccagattctctgccatagaaattagaggtgttaagctagggttttgggattgtcatcaagggaagttgccaccagcacaacatctgaaattattgaaggaactcccaacagaaattattg

SEQ ID NO: 54005 - DNA, 1501 bp, Oryza sativa
atattattacatatataaaccgcactaaggttcacagtatatagttctttgaaaagttatatttgttactattaaatttaaaattttggattcatgttaactaggtatattcttttgaaaaagatagtttagatcacacaaatcagaaggaagcgaggtatatgacatgtctttattaatttatatgtaagtatgtaacaacttacatcaacttaaacctactagaaggagaactacttgatggtacaaataaaacatatttattaacaatatagttctttagaatttgtaaaaaaaagcatgtaaacattctattaaaaaaatggccaaacaccttagttctaatttacacttgatttgttagacatgttttccaaacaaactgaatcgaacttccttctatataatcaagagatcatagataattattaatacagatgtattaaatatgatatatttttaaacctaacaaatatcttagaaaaattatcaaagcaaaataccaaagaacagcggaggcttcacctgatgtgtcttattcaaataaaaaaagtacttttaaacataataggtgtcagccgattgatattatatttatatagatatttcaaatgcaatgtacaatcagggttggaaattttggccatttcagacccctccgatactatattatttcggccaaatttttgtattttttcatgaattttggtaatatttgttcaaattcaactaacttttgttcgaaatttcggaccgaaattttggtgatgccctatgaaatcggctaaaccgaaaagtttaatcatgtgtacaatacatgcccgcgcgaatgcgcgggctactttcctagttgatagagcaggagaataacaacgacaatttgaggatatctgaacatctactactctctttatttcaaaataagttaatttgtaatccgtgatgtttgttaaaaattagttgtgcagtttggcggtttgatgcccctctctgcattaaagaacttataattgctgattgtaatctccctggttgagaaataaattcaccctttccccgcaaaaaaaaataacttgtaatttataatacaaatgtagagagtagataaaaagaggagtagttatattgagatttaataaattaaaggtattagtcctttttatctttttacatgtacgtacacgcaaaatgggtaaaacaaaatttgttccgagacgtagggattatacctatctcagtcgcagtgcacggaaaagatgcggaagcacgtcacacacatcacttgtagctgcagtagtacatgtcatgcttttaatttgcatgtactggatcgatcaggattcagaagagagagagctagcgacaagttgtgcgtgtaaccaactcgatctgtcccaacccaaccaccagcgaggcagcgacggccgggacacgaccgattgaccaaatgttaattagtgcagattttaaagccggctggttaaccgtttatgtcatgtca

SEQ ID NO: 54006 - DNA, 1501 bp, Oryza sativa
gatcaagatttcaatctttgagggaagacgatgcttctttacatggtaatacctgtcttgaggtggtatggaatcatcaatcatgtgtgctttcacaatcctaaagatttgagctttctggacaaactagctgtctagccccatctccacactccataggtaaaattccgaatcatttcccctcctaacagtgtttttcccgtaatcaccgtattgttcttacttacctttaacattctgcacaagaaacaagaggttcgagctcttccaaaaatttagatcgggacagaaatggagccatgggccattagagtggcctacttcatagtgttctcctttcttgtcactgcaagatttgggtcctgtgctccccacagtgaagaaggtgagatgtttttttgattgctaaagattgaactgaaaggggctaatagaatggttgcttcaagtggatttggattgcaacaacctgaacatatgtaagtttgtgctttagggagagctcttccgggttatagagagagtgagcaagaccaatcaattggctctttgtcaaattggggagaagggaagctcattggcagagtgttcaacttgtaagttatgctttaatgcaatctttcctcttctaccaaactgaaacatggatccaaattatttattgctcttgaatatgtctttcatgttagatatttattgctggggatgcattacatattaacatagctctttttcaaggggaaattttcttgatgtcctactttcatcacatttagatttatctactctccaatttctgttcaaaataggtgaatgactttggttattgtaattcggtcgaaaatgcttccaaagtgatgcaagtacagatcattgtacttcatgttaatagttatataagatacattagaagttatataggtcatcacatgttggctgctgcactgtaaatataggatgctttacaatgaataacaacattttaatggagctttagtctttctgatgtactatgtaatcttaagcactatgatgatctctgcagattactcaaagagaacatgtttgccagtgaaacaccatctgaatcgaaagagcatagctcaatttcagagtctgtacctcatgacagtgcaggatttgaaccatgcagaaaatgtttagcaaagtgaggcttctttgtggctataaatgtttattttcttgatagattatccgttatcaaatttaatttgcaaatatactagtcatttggtgaatcaattttccgagaacatttttttctaacacattatgttctctctctctctctctctttttttggtagaactgttcacaatgccacaccaaggcgacttctgcaagccagggagctggcttctaatcaaacacaaacacaccccaaaagccaatcatctccagttcaatcatcagcatcacacctggtacctcgttgggctatttacgcattgcctgttgctggagtccttttcattgcagc

SEQ ID NO: 54007 - DNA, 1501 bp, Oryza sativa
tttcggcccaaagccaaaagggagattttaaaaaccttttctatttaaatttattcatggaatgcaattccatttattaaaaatacttccttggctcaaataaatcccaaaaaatccagaaactaaagaaacaagagaaatatttaccaaagttttatctagaccatttttacattgagatttattaaactaaacttagagcttttcttttaggattttaagatcatttataataactcaatttataatttaaggatttttaaacaaccaaaacatttaacaaaattacatatagatcatttaatgattagtttattgattaactaattactgaaaaaatctttgtattattaaaattagtaattgagctctgaaaaaatccgagaaaattccagatagtataattaattatggagaatttaataaaaattaaatccagtcatgctttatatttagggaattttatttcccacatttaacttcacttgtaaattaatgaacatttaatataaattctaatgataatttattaaataatttataaatcctaaaacgaaaatcagatgcgacagacccccaacatataaataaagtatttcgatttgtgatgtaaaggtgaatctatcaccgaatcaatcaatgtctaaaatgtagtaaagaccaaagggactgatcatggcaatgatagctaaaaatcagagtacatcagtgtgtgtgtatatatatatatgagtaaattccctgtgtacccctgaaaactcactcagtccctttcgtacccctgaaatttacccgatctcttctatacccctgaaattttaacttgatcccttccatgcccctaccgttacattttccattatttcactattacatttggttgcaaatgtctttttttgcccttgatgctataggtttgaatataagcttaaaagcgattgaaaattttgtttgagtgcacagtacgtgcattttatgaaactaatgagactaaataattagtgcagaaaattttgacataaattttggaaataaaaaaggtaataaattaaaatttttatttgaaattttaataggacaatgattttttttgatcgggagcattcataaaaaaattattatgaaaattggttgtcctatctttgtatgaatgatccttttttttattactttttttaaaaataaatacacaattttttatttcattatctaaaaatattttttgggataaataatgcatcgcacaacaaactcatagctataatagtctcgtgtgagaagcttttacatttttaataatgtaattcataaatttctatgttcatccaaagggtaaaatggtcatttttatagaaattagacggtcaactaacaatcaactgacgggaggggtatggaagggatcaaaatcaaattttaggggtatataagaaagtaagcaaaattcagaggcatagaagggattagttaaaatttcaagggtatacaagggattttctct

SEQ ID NO: 54008 - DNA, 1501 bp, Oryza sativa
acatcgtgcacccggatccggacctcctccgcggtgaggcggcgcaggacggactcgaggcgagcctcgtcggacggggacggggagggttcttggtcatcgtcctcctcgtcttcgtcatcgaggtcgtcgtcgtcgtccgtcttggaagtcgtcgtcatcatcctcttgcaggtcggggtaatcttggacggaaacgggagaggatgcggtggccattggaatgttggacgatcggaaggggatctcaactgaattgggagacgaagacgacgactctactcactcaaactcaaggatgccttttcacaagcaacgaataacactatcaacttcctcttttggggtaaaatttatgtagagattgatgtttgcaattcatgaatttcacaagtttttctttttaaagaaacaaatgcatgctagaatatgtgaaaaattgctatgatccatatggtatagaggtaatgcctttgatactttttttttcaatatacaaaagatttgagtatcactgtattaaactgaagggaaatgtttacaacgaacgtgagaaaaaaaaaagaaacacaattcagaaatcatctcgccccatgagttagtgagcacaataaaagaacaacaacttttttttaaaggaaacacaataggagagacccccgctgttagataaactttgttaaagaaataaacaaaaagattacaacatcctaatccagttaagaattactcatctttatcactttcattaagcctaaacaataacgggagcatatcactctaaaagagatcctccaggaaactagggaatgagacttattctaaaaaatatagtcattcctttgcttccaaatattccaagctcccaacagaaagatttccatgaagcaacgattctgaaaagtgcacttagtctgcaatagcatatgatcaaaggacagagaagtgtcccaaattatgcccaaagagttctagtagctcgccgaaaaggagcaaagaaagaacatatgcaagagatcctccactgattgagaagaacaaagaacacacggtaggtcacagtttggagtagtataatgcttatgatccagcatatacttcgtattcaatctattcatcagaagcagccatccaaagacaacaacttgctaagctcgtatttcggttgatcttcgtagcgttgccttaaacgctgggatacgtcgcctaccactgaaagaataattagttgtaaatgcgaatactcacgtcaaatctagaatttaaatccaggtggttggttccaacataaccagttgagctacgttcactttctcgttgccttgatatttgagagaacacaagcaataggtgtcttattataaaaaccatgccttacattgtcgcatgcatgctctaaatcataatctgaaattacgtttacattgtgtcattatctacttaaataacttcactaacatgcttattggtactaataagttactccctccagtttctttta

SEQ ID NO: 54009 - DNA, 1501 bp, Oryza sativa
gccttgtcatcggagaatcgttctcggataatgaggctcttggacctttgacctgcctcggttgaacaagcactgatcctagcccccagccatgaagttggaaaatctatttccgattacacggcttggttaatacgcacggcgagaactcttacacgactagatcttacatggtctttcgtctctgaagaatccgacaaggccttatccgctctgggcgtccccaaccaaagttcccttaggttcctcggaggccttgtcaggacgacgtaaagggacattaggataggtttcaacgctaggtgtctttgtggtaagggatctctgggtaaaacacttggcgatactgtgcacctgatatcaactttgttgaagtagaggtaatgggagaatcgctacacctctggtcaagaaccaggtagtagtcgtaactcaaccactagaagtaaatgtacgagagatcgctacgattgactagttgagaaccagtgagtaggtatctctcgatcatttgaagtcgtagtacgaggaccgctgcgttattgctgtagtcatacctcgaccatctgaggttgcaccaatggaagcgttagagttggtttattacatgtgcatctcatgtggccagcatgactcacacacccaactagtagcatatccggatgtccgttcgcaatcatgtcgggtgatcaaaccgacaacgttcacaaggaattatccgttaacaactttttctcaaatagtccagccatggccggtgctatgagataggtcatcggtcttcgttggtaggttgggcacgacgactctgcatttgtcgagatcgtcctcgataatgcggtgtacttgaccacaacctactcgagtgctcaattgttcctgcaaaatattttctagaagacaagatatatagcagataatatcgagtatgtactcaaaaaactgcatggatcttctagcattatcaggatataacgagcagattaaatatcagggcattatgtaaaccgtaaataagcatgatatatacataggaaaatagagcgagcccccagcattaaaccgttgtcgatttaacatcggggacacttgcacaatatatattgtataaaaaacatgctttaggtaattaaacataataaattatagatctgacaatgctgtatgatctgaataggtatgataaattgcagataaaatattgtgtacctttgtagatacatgccggatgtatctatgaaattagtagatcaatttaaaaaaccaatctatcaattaccttgtcacgtactcgttcgatatcatgcgatctgacatcttttggtacgtcgcgtatcttgaggcttggtcgatctcgagagatcgaattgttgatgacgatggttccgatctcgtcgggagatgtacttagacaggttggatctccccacagctaaagtcgtcgagtagcttgttgtcggagagtccatctcttaaacccatctcgtcgaaatcctgaagc

SEQ ID NO: 54010 - DNA, 1501 bp, Oryza sativa
tgtccaatgcacgtcttgcggaacttgctcctatcttgagacctattcagcacatggatggtttcaaccgatgacctgaaaatacaataatataaccaaagcaacaaagaattagatccaatatatattaggtaaagatgattagcaaagaaacccagatgaatttattaacctgctagtaaatttaggcagcttcgatagttggcaacggaaaggtcatgaggcaaaggcgagcgatgatgcccatcaagctgtgcgagatggcggatcgatgatgtcagcagcctcatttgcagaactggccggattcggaatggcggagccgtggaggcgatctaatcttctctgcctgaggtggagcggcacggtgccagcatcgaccgtcggggaaagagcaagtgcgcggaggcggcgatgtgatcgagcaccatgggaagaccttcctgctaagtagccgtgacgaaggcgggaggtgaaagcatagtcgctgtcaacgtaatgtagcagctccaagtcctctgtgttcagatgggagtcaggaatcaacaaggaagtactgctcaccattcaatggtaaaaaatggaccaaaaaatgaatcccatcttacccacatccaatgggaatatagtatctacaaatgggaatataatcatgagcataaagtttgattgttttattctgactttgtgtgttccaattcatactgcaagctgccgttatgtcatgcaataactcgcagcaaaactcttgctagaaggctggcaaataagcaatgacagaacctttctccagatgttcaatttcagacacatggtcccctttaaaaaaatttagaaacattgctgtccaaggatataaaattcatatagaagacgatgccaaattcagaaaaacaaatacagtggagaataaacccgcacccaacaattatccatctacctatccactaaaacaagtatatgatatttgctaccggctttcagtcaattacctcatctctcaaatgacatgctttgaactatccctcaactccagtgtattttgttaaaatcatgtgattcttcaattatatatcgagtgcaaaatttcagtatgcagcattctatttactaattggcattttttttatcgatctgtatattttattggcattaaaatttcatccattgagatatgaggtacataactgttcgtgaccatactgttcatcatcgtgagatgaacaaaagttcatcgtttgagagatgagatacataacggtatgaaattgatacaagagaagatttccatgactcaccttggagagagcggagagcacaaacgattctgatggaccatgttggggatcgtgagtagaggaggaacgatggatgacgacctggcagtgagtggcgaaggggtggcgtgatgggacgatcggcgggggctcggtcaccgtgaccccgaattggcggtcaggaatcgatggtggtcgcgatggcaacggccgtgaggagatcg

SEQ ID NO: 54011 - DNA, 1501 bp, Oryza sativa
tcagtggtgttgggcttttacgacacctgttgctaatctgcattttgcacgagttgtgccgcttccaaggctccaattacaaaatcatgtcaattttattaggaactataatgttatccatttgattgattgagtccacatatcaatcataaaaagagggcaaagttacagttttatattaaaatcattaaatatatgatccgtattttagaatgtaatagttctttacctactagcattactattttttcctctttatatatcttttgcaagagccggcgccgcatgggaggttacaatggtccattgtatcccatgcattgtaattatcttctctatattaatcattgccggttgatatgcccttgtttttttaaggttgacatgcccttgttttttgtaaggatttttcacataaaaaatgtgtctccattgtgcatctgctttcataacaaaaattgtttgttattgttgtagttttgtggatattaagttagaattacacttaagtattatttttgataaaatgtttgtagttttgtgaattttgcacacttgacaactccctgtcacacgtgcgcatgaataaaccctcgttggggcgcctacatgccctaattgtagtctcgtagataatctacaccgagcttatataagtaacacaaggcacgtataaataagatggagatgatgttgagatgttaagtgcagagaaagttagaatgatttttccgtgtggtcttaagttggaggattggtggaaccctatttgtgttctctctttcacaatggttcgccatggtattagtgcaatttaatgcctctataaaatctatcctctctcttctttgacattaaaaatgctgtcaatttgtattttatacgtagtgatatcttgcggcctcatcttttcgcttatgcttatatttatcagtcaaaatttgaattttcaaccataatttttcaacctttattgtattgcactggtaactagaatatggcatacaataagttctgaaaaatgcaaagctgtttgttggatctattaaggacaccctatatatattgtagaaccagtaccctataaaggtggctggccttaggatggtcgtagtatttttgcataaataggatgagtaaaagagattattgctggaattattggtgtaccttgcggtacatgattattgtaggctatatctactgtcgacgtaaggtcagaccaatcatgcatgttgttgttcacatagaagcagcttgctgaatgcaaacttggcctgtgcatgcgtgtcctagcttgcataggaacagcaggtctacacacatgtacagtcagggaaaagtgcatggatgctcaaaagttgatatctgtctgtccgtcatcgtgtaattttgacagagttgactttttttaaaactttgaccattggtaactttgaccctcgtataatgccgtgtttagtttgtgtgccaatttttttaaatatacggacacacattt

SEQ ID NO: 54012 - DNA, 1501 bp, Oryza sativa
ggcgaggcggtggtaatggcgatggcgatgccaccaaagccttgggtcggtcgcacgtggggggcaaagcgagtcaacaggtaggggaggaggccgaccaggcagagccgtgccgacacattgatgcttttcgacgccagcaaggccaggcggtgatggtggaggaataggaaatcgaagctaatttgtgtttggataacacgagagaaggagcagagggagttcgtcagagatatcttcgccattcccattgtccctgtcaccacagaaaacagtgtgtaaagaagataaggcagagagaggagtaggggctaatggattgggctatcgcaacgtgttcgcggtctacgaacacccgccattagacttacctttattgaaaccatgggatactagcaaacactaaataccattaattactataagtacgtaaaacatcttgctttagagcgttttgacgaactgtcagaaacattttggcggcttatcagttgggcccatttgtctgtctcagttggtaaaagtactcccgtaatagtgtctgtactttgtactggtccacagtaatagcattcattgtagttgtagttcacacatggagcttcagaccaaaaaaaaaatagtttacaagaattaaataagtctcgtcttatgaagtgctgtaattcgggcgccaatgcagaagttataaagcagacatagaaaaaaattgcaattatttcattgaaaataaagatttgcaatcttttggaactcgaaacggaaaggaccatttaaaatttggacttcaaatgggtggtaggagtagaacgttttgacctttgaacgacgaagtcttgtcgtgaagggattgcgtacaagagcttcgtggcctttgagctacgcaattcctactgctgaatgaaggcaaacctcgaagtcctgaacaagagcaaaggaaaaccaaaatcagttactctgatgtctaaaatagtaatccctccggccatgaaaataagacgtatttaatttattttatttcgtttggacgagacgtggaccaattataaaaaacataatcttaaataattctaaataatgacattatttttatgcaacaaaaattatgtccatttaaagtaattattaatcaaagcctaatcgtaacaatgttttaaatagcggaataagacatttagcggttagttttctcaaacagatatagcagcttaattgtacatgagagcaaatagctagaaccatttacaaatggctatagccggagagattgtaacaacacaaaatacacctctataattttcaacggagtgagtatccgacatcgtgcaaattcttgaaatttacaacttcctgttaaattcgaacaatgtggagattttcggctacagtggaatttcttacatgtactcggggtaaccttaaatccgaaaatcccaaaagattcaaaccatggtggagccaaccatttgtaatccttattattactagtagtattatattt

SEQ ID NO: 54013 - DNA, 1501 bp, Oryza sativa
taaaacgaatttccttaatagggggtttccaaaatatgtgggttttttgttgcaatggaatatttcatttcactgtaacattagatctatatacagtgaaacactgtaagtacactaggtgaaatatttttggtggaacaaaaaataaaccaaattcccttaatagggggtttccaaaatatgtgggtgattttttgcaacggcgcgttccatagtatcaaaattcattgcaacatttgatccgtacatagtgaaacatcgcaaatacacttgctgaaacatcgtaaaactactggttgaaacatcgaaagagatcatatgcaacattaaaaaaaatatcaatagaaaagctaaaatattttttttgtcgaaatataatcatgtgtggtcttgttgtaaagatttaattacaacgaatataacggtgtgatcggatcgtagattggataattagtttaagagaaaatcattttaaagtaagagtggcagtaggcgcgggcgtccgaggcgtccgatttttccactgccatcgaacgcccggcgcgcagcatttccctagttctgtttttggaattaattaataagtaaattacactagcaatacttaaacttgtaacgaggtttcacttaggtccacgaacttgcaaaacgtgcgtcgagatccttaaacttggtttaacgtatcatctcggtccaaagcctgaccatggtcttgccaacatggcatgccacatggacgatgatataaacttcaaaaaactattggtagtataaattaaatatcatcttcttaaacaaacctggttctatctattctatttatctattaagtatgtaatattatataaaaacgtgtgactactaacgcgttgctagcttgatcattctgatatactctggcattaagtcataatgtcatactagtatcttgcaaatgactgtctaatacctggccgtctggtcagatgatttatttgacttctgatgattagatttatcatgcttccgtgcttcaaaagggaattaattaagtgcaagataacacaccacatgttataacagtataaatatatgattgattaatttgtaactatatactgctacgcgtccgtcagacggtgctaattaaataattaaggactgaccaggttactgttaaatggagtacgaaaaactgaataattaataataacatatatagatcgagaagaaaatttaaacacacgagcaacacaatgcatgcatgttctagaaaaactaaattgttgaatgacgcggaaacgtttctttgcatcatatggatcggtcggtccactgctataggcgtgaactccatgcatcgaaatatatgggaattaactaacgctgaaccttctgtcctcttaccttagtaagtattgcctgctggatcatctctatcatcttatatataggagtatatagctatcatcagatcgaccgatgatttcgatagtaagttgcagcagagacaagtcgcaaa

SEQ ID NO: 54014 - DNA, 1501 bp, Oryza sativa
tgaaataataacaatattatacacttcataataattaaatgatatctacaatcataaacgtaaaataaaaataactatgagtaatgttcccaaaatatttagttagaaagcaagagttatgctaaaaaataagcagctataccataaatcatgggatcccctaaatcatacaagtaatatttttcttatgtcttttgattattttacatttaaagacccatatttggggttatattttctgacttttgcatgtcattcaaacaattataaaattatgaaaaataatgatatatgttttatcattgtatataagttcacaataaagtaatgacaaaagtaaagtaaacctaataacactgactattgttccaaaaaaattacttctcccattcggatagtataataaatcaataataaaattagtagatttgtagtgttcatattttgtcccatttgactttctcttcatctcctctctcactcaactcatctgtcttataatttttaactaattaacaacataatataaaaatgatcaataattggaaagctaaataattatgattcttatgttatatttgatttttagtttatttgaattgttattttatttataattaaataaataattcaagatccatatcactcatatttcactttacaaaaataaagaaatacacaatttgagcatacacacctatcctttgcatgctaaccaaatataaaaaaacagagctttgtaaaaaatgacaataagtattgttgactaaatctcgacaggacccaccacataccatgtcctatacggaaataacctgcgaatataggaggagttccggataaggaaagacaaccagagttctacatggaaacgacaagaactactcggattgtatccatattggtttccctagttatacttggacaagaggacacctatgggtataaatataaggccccctctaggaggaggggagacaatcaacagagacaatcaacaccctccacaatctacggaacaacagaagccaacatacgccaagacaagacgccggatatcgacttcagggataggcacggctagtcccctacggtgtctctggatattgataggaaagacattgcgctgtctctgatctcgccgggcacgaactcgaggaggaaggctaccctgttgttgactacgagtcagaccttcagaccgtcatgtcgacaacagttagataggctaccccaaatattgtactggtgtgattatggtgaataagagcaatatcggcttcggccaacaggatgtagggttattatctgacaattcaggggcccgaacctgtataaaaatcatcgtctccgtctcttttacctcagtctcgcgtataccctagcaccaacgatccccatactatgcaaatactggaatcgcgacatcaaacgtcgacagtggcgcaccaggtagggggattttggtgcttcaggatttcgacgagatgggtttaagaga

SEQ ID NO: 54015 - DNA, 888 bp, Oryza sativa
cggcggccagagcagcacggtagaggagaagggagctgcggcggcgacggaggaggtggggcgtctttgcgccggatccgccagcgagcagaccggggtcaccggattcagcggccccggcctcctcactgggagatccggcggctcattaggagggagcggtggcgcagcacggtagaggagagggagctgcgggctgcggcagcgatggcgcacgcgagcggaggcggcgacggcgcatgcgagcggaggcggcgagcgaaccgacgggtgtggggagaggagaggacaggcggctagggtttttaccggttcgcgaaatccaagccgtccgtccacaatccgacgatcacacgggcgtggaagggccagcacactgggacacgtggacggctagatcgaccctacggcgagatcagatggtggacgagtagttgggtttgaagtggagttagagcagtctaaaatcagatccgtttctctaatttattttgtgatagcgcttcaaccaactctactttcattttagatggtgttaaaactatttgtctgggctctagctccaagagacatgaagctggagttgaagcagtgcaaaacatacatttacatttccttcataaaaaattgaagaaggctgaaatttgaaggatttaagttggaatattcgacccatatataaaatgagaaaaatgttcaagcccatatattgaggagcccatgaaggaggccagcccaatggtcccttctttccttcctttgtgtccaaatccaaacagacgacgtcttgttaaaccctagagccaccaccccacagagcaacatcgccgccgccaccgccagccgcaacagcaccgacgacgaggacgagctgagaatacgaggcga

SEQ ID NO: 54016 - DNA, 1501 bp, Oryza sativa
tcaaacgatgaacttttgttcatctcacgatgatgaacagtatggtcacgaacagttatgtacctcatatctcaatggatgaaattttaatgccaataaaatatacagatcgataaaaaaaatgccaattagtaaatagaatgctgcatactgaaattttgcactcgatatataattgaagaatcacatgattttaacaaaatacactggagttgagggatagttcaaagcatgtcatttgagagatgaggtaattgactgaaagccggtagcaaatatcatatacttgttttagtggataggtagatggataattgttgggtgcgggtttattctccactgtatttgtttttctgaatttggcatcgtcttctatatgaattttatatccttggacagcaatgtttctaaatttttttaaaggggaccatgtgtctgaaattgaacatctggagaaaggttctgtcattgcttatttgccagccttctagcaagagttttgctgcgagttattgcatgacataacggcagcttgcagtatgaattggaacacacaaagtcagaataaaacaatcaaactttatgctcatgattatattcccatttgtagatactatattcccattggatgtgggtaagatgggattcattttttggtccattttttaccattgaatggtgagcagtacttccttgttgattcctgactcccatctgaacacagaggacttggagctgctacattacgttgacagcgactatgctttcacctcccgccttcgtcacggctacttagcaggaaggtcttcccatggtgctcgatcacatcgccgcctccgcgcacttgctctttccccgacggtcgatgctggcaccgtgccgctccacctcaggcagagaagattagatcgcctccacggctccgccattccgaatccggccagttctgcaaatgaggctgctgacatcatcgatccgccatctcgcacagcttgatgggcatcatcgctcgcctttgcctcatgacctttccgttgccaactatcgaagctgcctaaatttactagcaggttaataaattcatctgggtttctttgctaatcatctttacctaatatatattggatctaattctttgttgctttggttatattattgtattttcaggtcatcggttgaaaccatccatgtgctgaataggtctcaagataggagcaagttccgcaagacgtgcattggacacagccgtcgcatcgctcctctgcagcagatccacgcaccggccaccgccttcacaacatgatttggaggtggagaagcttggtgtgccctcgacgagttcttccacaaatttactaccctcgatgatggcccaggccgcggcggctttgtcggcttcttcgacaacactaatgtctaccttgccaacaatatgtgagttaatttcttcctctctgctttctgaaatacttttcaatgtgaacactagcaatgtgaatca

SEQ ID NO: 54017 - DNA, 1501 bp, Oryza sativa
aaaaaaagatacttaccagctaccaccacactatatatttgcatccaaactttatagctaaattttattaatgaggttacgaatattttaaatataattgttgaagtctgttgcacgatatagcggtatagctatatacacaaaccttacttaggccccgttcggtagtgctccaaactccaactccagtgggagctggtgttgacggtccttaaatcataatatatgaccgtcagtacttgcatataatgaaataaaacatggtatccaacttagtggtaggtattattactaatcatttccactagtgttggtgaaatatgtgtatgcaggtaatttgaggtgaaaacacatccgtgatatgacaaaatgcacctctgcatatccaggacacgtttacacggattagaggctccataagccaataaaaaccatttagaattgggccaaaacatagtgcaggttattgggggcccattaagcaacctaccggccaaaggagaggccgggaggacactttttgggttcggccaaacccgttatgcggccgttcaccgtctgcttccacgtggatggcttggattcctcctctatggcggttgcagggtgttttggtcatttcccatacccctaaccatcatttggagcttatataaggaggtcttcactcttattccaagacacacaactttgagttgaattacaagaggctctattgtatcttttgtacattagaataaggtagagagtggggagaagcaccggaggagtgcccggaagtttggcgctcatccgacttctacctcaacgagtgtagcttcctaggaggaattctggaggagtaccggagctgtcggtacactctgctccgggttcggagaacttcttctataaagtaagcattcgtgttcctttcttatgttatttaattatttagtctgagtaagatatatttccatctttgcgggttcattgtttagtattcatactaagtgctctagtactaggactctggatagagaaggaagttcttgtgcaagtattagagtagtaattaataacttagacgtgttgtctaggttagagattacctttgtttgttgtgtatcccatggatttgtcagatgtaggcggcaggtggtgacagccttgaatcccgtccaagtaattctccacgttcggatacatcatagagctatagccgaaacaatgctagcagactagcaggggtcggcgcccgaagcaacagataggaaattacctttgcttagcttagataattaggtagattacacacgttccctgagttcgatatccttttggggtcacccgaaggtgaagtgctacagcggtattccgtgcgcttgcggatttatctatgatcgtaagaaataccaacaagcatttctggcgccgttgccggggaacggttgctaatttatccgagtctaggtcatactcgtatctttatttttatttcttcttctcttattcctttcct

SEQ ID NO: 54018 - DNA, 1501 bp, Oryza sativa
gttggcgttggcagccataaacaggaacaccattgtctgtatgttacttgtttacggtctcatgtccagctgtttgaattttgtacctgaaatatttttttctttggacaaaaagatggagtatttgaatatttcgctcttgccagtgacttgtgtattctataatattatatgggtttttctttgagtaaataaatgcatttgccaaccctggttgctgtggtgtacaacaaaacaatgcaagtgttcctcgatcggttgccttgttgcagccttcacccctgcgctgcatgctgtgtgatttgctaattgggtttgttatgaagctggttatccgaacaaaatcgacgcgtttgcatgtgatttgctagttggatttgttatgaagctggttatccgaacaaaatctacgcgtttgcatgtcgcttggtcaggaatcgatatgtagagagggttacgacggcagaagatggtgtttttcgtcgaagttgctcgattctgcaacattgactagactcttctatattgttaatctagaaagacccagtgcaatgcaaacaatgggctctgcccgtctgccgtcgtctaaaacgttgaaatggggaagctgcagggcagggcttactcttccatctcctcttgtgtctatccatcaacattgaacaaagttgtcctagacctagctattcttcctcgtgcgtgctatggcatgcaaattgcaaagtaaaaaaacaataaaattgaatgaatctatcatcatatggacacatgaggaattaccaagctatcaatctgtcatctgcactaattaaataattgacaacaaaagaatgaatgaatgagaaatagtgcaacaaaataaaacgtaggtcaagccatgagcatcatgaccctgaactcgtcaaaggagagcacgccgtcgccgttgaggtcgaacctgcaaatcatggccctgcactcctccatctccagccgctgatgctctgaccccagccgcctcagcatccgccgcaggctcgccggcgtgatcaccgccgtttcttcttcttccgggtacatgtcaaacgcctccctcaggcaccttaggctctcctccgttggctcctgcaactgatgagcagcaaagagcctcatgacctcgtgggggtccagcaagccgtccctgtcggtgtcggccgttgcaaggatcgccgccgcctcctcctcggacacctcctccccgagcgccgccgccatgcagccccgcagcggcggacgcggacaccttgccgtcgccgtccttgtcgaaggccgcgaacaccgacgaagctgacgatgccatggcactgtcagtgattatatggtatctaatctaaggagaggattaatctcggttgctcctggatcgacaatataatcagagttcgcaagaaatacgtatatatgtagtgagtctaatttgcgacttgtctctgctgcaacttactatcgaaatcatcggtcgatctgatgatagctatat

SEQ ID NO: 54019 - DNA, 1501 bp, Oryza sativa
cttagacatggtgtctaggttagagatacctttgtttgttgtgtatcccacagatttgtcagaggtaggcggcaggtggtgacagccctgaatcccgtccaagtaatcctaatcctccacgttcggatacatcatagagctatagccgaaacaatgctagcagactagcaggggtcggcacccgaagcaacaaataggaaattacctttgcttagcttagataattaaaactcatagaaaatcctctctaacctagcctacctaccatcagttgaaaaattacctttgcttagtttagataattaaaactcatagaaagtcatctctagcctagcctacctaccatcagttgttgtccttggatagtcttagccttaggtagattacacacgttccctgagttcgatatcttttttgggtcacccgaaggtgaagtgctacagcggtattctgtgcgcttgcggatttatctgtgatcgtaagaaataccaacagctggatccaatagaagctgaggttggtgtcaaagtgtttggctagatttgtcagctccacgccacgacctcccttatcgacattttatcgaacaccttgtggcgcccctgccgcacgcacgccgccaccggtccttccacacgccgccgacgtcgctccgcactcgcgccgcagccggtcagccggcacacctccgacgtcgtgccgcctgtgacctcgcgcgccgccgcccgggccgccgccgcctgggccgccgccgcctgcgacctcgcgcgccgccgccacctgtgaccctgtgcgtccccgtcaccgcgacctgctggctgctgccgccgtgtgccgcttcaccactctgacgcgcgcccgcggacgccgccaccatagccctccgccggtcgccgcgtcgggaggaagacggaggaagagagagtggtcgggaggaagatgtggaagagagagaacgagggagaggtgtgtagaggggtagttcagtggtatttttgtgtaaatacattgaaaaattaaagtgttgtgggtcttttggggtgtagtcgagttgtggagcagcacaaacctagctccacccccgtagtacaaatttatggagcaactctgctagctccactctgaaaaataaagaatatgtaccatttggcacagctccaattctaggtaagttggagttgggagctggagctgtgccaaacggggccttagacagtgttcagtttccttcaaacttctaaaaattccgacacatcaaaagtttggacatatacatggagcattaaatgtggacgaaaaaaattaattgcacagtttacatgtaaattgcgagacgaatcttttgagcctaattataccatgatttgacaatgtgatgctactgtaaacatttgctaataacggattaattaggcttaataaaatcgtctcgcagtttacaggcggaatctgtaatttgtttttgttattagtctatgtttaatacttcaaatgtgtgtcc

SEQ ID NO: 54020 - DNA, 1501 bp, Oryza sativa
ctgatctttaacttattcagaaccgagaggcccaaaatacgtgctttgaggtttgagtatagctgccgctcatcattggttaaaactcttgactcctgtgccacgtcaagttgaaagacaacttccatcgccactgcaagctgtagcgtaatatcccccacctgactgcgattccatctcttaagatcacgggcaagacgacgaagttttaggctgaaagtagcgagacagttcgtggctagtatcggcttgttccaagattcttgcacaacatctaggaaacctggaattcttaaccaatatgcctcaaatctaaaactgggtggtctacctcttttgtcattaccgattaggaaaagaggagcatgatctgagcatgctgaagagagagggtaaaggattgaaccgctgaatattatccattggactagacttgcacacactagcattggtttaactgaaaaatcccttgcctattcaataatgcatagctatattaagagctaaacttatatttcaaaaccacatcataatttcacactgcttctctcagaaaaggaagaatgaactagcaatagatatttttattatgttcattttcagcatatacagatatattaataacagagcttatcattgtgcagagtgatgtagtttcccatgcaagagaggagatcaacaagctgaggcatgcaaatgaagaccttaccaagcaagtagaaggcctacaaatgaacagattcagtgaagtagaagagttggtttacctgcgttgggttaatgcttgtctgagatatgagctccgcaactaccaggcaccgtctgagaaaatttctgctcgtgaccttaacaagaccctgagcccaaaatcgcgtgagagggccaaacttctaatgctggaatatgcaggatcagaacgaggacagggcgacactgaccttgaaactgcttcttctgcaccttcttcacccagaagcgaagacttcgacaacgtttcagttgacagttcttctagcagatacagcttctttggcaaaaggcccaatctgatgcaaaagctcaagaagtggggaaggggcaaggatgacggaagcagcttagcttcaccgacacagtccttcactagtgactccccaaagagcgccagccagaaaccaaaggggcccctagaggctctcatgctcagaaacgcaggagatggtatgggcattacaacctttggaaagagggaacaagatcccagtgatatcatggatgaggcaaatgttgcatcttcatttcatttgatgtcaaagactgtacaaggttttgctgatgacaagtatcccgcttacaaagataggcataaactcgccacagaacgggagaaggcaataaaagagaaggccgagaaagctagggtacaaagatatggcggtgtcaacagttcaggtattgtgccatctccaagatctgcactccctccaaaacttgctcaaataaaggaaaaggctcctacagc

SEQ ID NO: 54021 - DNA, 1501 bp, Oryza sativa
aaggttactacaaaataaatctcatttgttgtgaaggttaccacataatgaatctttcatttgttgtgaaggttacaacaaataaatctctcatttgttgtggatgttacaacacaatgaatctctcatttgttgtggaggttacaacacaatgaatctctcatttgttgcggaggttacaacacaatgaatttcatttgttaatggtgactttattctcgtctgttacaaaacggaagagcagcaggcaggctcgactcggtctgccgcctcgcctcgctacgcccacggccgaggccgactcggcatgcgcgcatgcgtgtggcagtccaaccatcacctcaaccggtcaacagggaatatctaatatcaccctatttaagttgaggttcttccacctaaatttttaaggcagtattattctctctaacattacttgtgggctcttgagattttaattgaattaaattgggcctagcccatttattccaacacttccattccatggagattacaggcctgaaaacaatgccaataaaattaagatgtgaacctccagattcctaaaaatatgccaaaaagaaaatcaatacttttggtgagtgcactggtgtgttattagcttattagtattttagtttttgggcttgtttgagggagattaagattctgagaagcagctgggtttcccagcttctggcttctacttcattttatggattctacaactacaacttcttagaatctagaccagaagctagactgtttaggggagcttctgattctgggagaagctgcagcagttagaagctcccccaaacggatctaggttctctacagtgcagcagagaataactgtagctacagtattctgagactgctacggtgaatcaatgcaccgaacagcgcttcagtactgtagcaaagtgctctgtaagcagtaatctttttacagcttgcctgattactgttcccatttactgtttagatctactgtagtaaatctccaacaggccctttgcaggtgtgtccagaagagggtaatgataagcaatgctccatcctgtgagcctcgtaagcctcaactatcgtctggtctttgctatccaattatcactatcaaacgccagctaccacccatttttgtgcacaggaaacagcctgcgtattaagctagctttcaagccacaagccgtacttgtatcatgacaggcaaatcagaagccacaaattaagatgcatgctttcttcctgccactgtcagcatatgtaaattttgtcagctattagtaagtgccacactgctagcacacagaaaagagctcgtctgctatacaagtcctgtctgtttttgcaaacaagggaagagataaacatatagagacagacaaattggaaggaaccgtttgcaagccacatgttctagtggctttcacagtttcactcattccaaggcaacgagctggagctctcctcctccaatgtatctatctatctctag

SEQ ID NO: 54022 - DNA, 492 bp, Oryza sativa
cagccatttcgtttttcatcgtcagattggcagcttggtctggtttttgcttagatatgttcttttctttgttggattcttaatgctcaagaacctgcagcttgatcagatcgctgttttctgaagaagcccatgatagtagttgcaattacttgatttgataacagttatgatgtaaaatgcttatgattaccattaggcaacttctttcaggccattcctcaaatgtgatccttgattatttgtgtgttgcatgtatatgttatacactcatcacaaaacagacatgcatttgtgattgttatttgtagttaaggtgttttgtctataattatatctgtcatattgagcttagtgatcatctatttttagaccattttctacctgtggaaaatacaatggaaaaacatttggtagttgcactgtctttaggtttgttgttaacaaaatatttaagtaatacaaatttcttctcatattttgcagacaaga

SEQ ID NO: 54023 - DNA, 174 bp, Oryza sativa
acccggccggaccgcccccgcgtcacgctggccgagctgggaggctcgctggtggtggccatcgacgaccaccgagctgccaccctggacctgtggttcctcctcgccgccggcgacggcgagcagcactggtcgaagcagtacacggtcaccatgccgtaccaccggcggcca

SEQ ID NO: 54024 - DNA, 385 bp, Oryza sativa
attgcatgataagtagaagaaataatagtaaataaaacttgttacatattgagcgcaaatcaaacatggtgcaaacaagagtctacacaagaagtatccttactctttgcacctggttagttaagaatggaagttaacacctccaaggctctccaacacttgtttatcctcaagataaaatatgttcacctatataattcacctaatagcacagaaaacaaacggcaaaactcacttctaagtaaatgtgtttgcagctagctcatttgacatacctttgagagtttgcatgtgtgcagctttttctttgcagaatttatcatgtgttgcttgaaacttggtgtactcgttcttcagtaaaccttcacactacatcaaatacaaa

SEQ ID NO: 54025 - DNA, 748 bp, Oryza sativa
ttaaaatacggagggagtattaattagtacaacttgattaacgcgcatattgatcagtgcttgttgcatgataccccaagaaaactttaatttttgccactcacacacatttcctccctccctgcatgcgatgcttactgtttaggaactgatcagaaaggaagcaactgcaagcagtcctgcatctcatcttctcaataaagctctcttcatcagatgatgccaatgttaaatacatcaccttgcatgctagctgctagtgaggggagagagccaaaaaagcaagttgtgttttctgtcttgattatggacaaggtgcattttggcaaatatataggagatatggaatgatcatttgaaaaatatgttgggaatggaactttgggggaaaccaatactatctttagatataaaaacattattatgtcgccacaagagtaggaaacaaccaaaactgaacatgaaaatataattgattatatgtatatatgagatctagagctaggttgtctaaaacagtgaactaattaaaataactatgcataaaggattgtgccacaacatcagtaacttatgtattagtttaatttggcaaacatttgaataagaaaatggctgatgaatggatgaatgccaaaattcaaaatattgtgaaatcaatgttttttatttatattttttgtgatgaacatttggcatgagaattatattggttttgatatttggtagatatttgtctgtggtgaga

SEQ ID NO: 54026 - DNA, 1501 bp, Oryza sativa
atcagtctcctgttccttgaggccatagtactctagcagctctccctcaagcttcacttccctctcctccagctcacgcacaagtccacgcagcctctccagctcggagttaacactgttgtaccgagagcgttctttgacgtcgaacctgtcacttggtagggggatgtcaatctcccctgataggaggctctcgatctcggagagcatgtcgtcatcatctgaaagagctgaattgattatgccgctgattgttttaacctcttccttctcttcttctttctccccctgaaccacagcaattgaaaagaacagttaaacgcatacgtgttcagaacagttacagttaaactcacaagttctaagctagtagagaatggcatgcacttacatgttcagagtagcgagttttatcctttcctttccttgcttggccatctgttgaagttcaacaagagcttcagtgagaaattcagaggaacaaattaaggaaggaagtgccactgcaagagagaagcaagtatagtacctctgttgccactgttggctctcttaagagttaaagctgcgacggaggctacaacaacgacgcctaacctgacaagcatggctccttgccctcatcactgtcccgggcaggagagctgacgacgcacagagctcccttggctcatcagaaactggcaagctatgagaatggcaagccagatatatcttgggctagagatagatagatacattggaggaggagagctccagctcgttgccttggaatgagtgaaactgtgaaagccactagaacatgtggcttgcaaacggttccttccaatttgtctgtctctatatgtttatctcttcccttgtttgcaaaaacagacaggacttgtatagcagacgagctcttttctgtgtgctagcagtgtggcacttactaatagctgacaaaatttacatatgctgacagtggcaggaagaaagcatgcatcttaatttgtggcttctgatttgcctgtcatgatacaagtacggcttgtggcttgaaagctagcttaatacgcaggctgtttcctgtgcacaaaaatgggtggtagctggcgtttgatagtgataattggatagcaaagaccagacgatagttgaggcttacgaggctcacaggatggagcattgcttatcattaccctcttctggacacacctgcaaagggcctgttggagatttactacagtagatctaaacagtaaatgggaacagtaatcaggcaagctgtaaaaagattactgcttacagagcactttgctacagtactgaagcgctgttcggtgcattgattcaccgtagcagtctcagaatactgtagctacagttattctctgctgcactgtagagaacctagatccgtttgggggagcttctaactgctgcagcttctcccagaatcagaagctcccctaaacagtctagcttctggtctagattctaagaagttgtagttgtagaa

SEQ ID NO: 54027 - DNA, 1501 bp, Oryza sativa
cagtccattagcaggcttaatgccgagtaggagataacgctttatgacatttgacacctcagggtaaaaaaacaatggcactgctcgatcatatgtagccgataaatgtggttaggttgaagtatagtttgcaagtttagattatcaaatttggagtggattatgctcaatatctgggcgttcttgtatctactggaaatggtttaccttctaatgctgccttctactctgtatgagttatgcatggctgtaaaacttgtcagtagtcttttttatatcaaaatcaactttctgtaaatttatggtgacaaactgttgaagtctggatcgaagtatcgaagaaaagaaaagtattattgtccttgacacacaacataacttgtcttgtgccatttgcattaactagcatattgcccatccgtttaatctacctaccttataattcaacaaatagttttatttgtttatcgtgtgacacatccaacgatccaaattcatttgtggatacagctgtgttcggcgttaccccatcgtcttccgcgcccacgcttttcaaactgctaaacggtatatttttttaaaaaagtttctatacgaaagtaacttaaaaaaatcatattgatccattttttaaaaaattagcaaataattaatcacacactagagaaccgttccgttttccgtgcgcatatcctgcccgtgtagggaagactgttcggaacgcaaccttagatcggatggctccgcacctccctttgatcgcgctctctcccgcatcggacggcatccgctcctctcccttccgcaactccctctctcccgcaccgcatccgcgcctctctctctctcccgtgcctccctccgagatccgctgcttcctctcccgcatcgcatcgccgctatcgactcccgtcgccgccccagtctgccctcccaccgccgcctctctcccgtcgatccaatccgccgcccagtcccggctccgatcccccctctctctctctctcgcaaaccctagctcctcgcgatccccgtcctccgcgcagccgccgatctccgtcgcgcctccaagagttgccgcccgtcttccgttgccgatccccgtcgaccacgaccacgaccacgaccacgaccacgccgcccgccgatcctccatcgccgccttcaccgagtcaccgcccgtcatccacgactacgtcgccgctgatcccccaaccgcacacggctctggaccaccatcgtcctgggaattcaccatctgaactcctagcctaagtgagtggctccttcagttcctcctcttctgccatgtcttcgttgatgcagcagggtagaaaaattgatggagtgtatttgattgaaactgttcatactataaacatgctgggctgtgaggaccttgcttttcttttttccagatcgagccattcgggcagatgagcaatttcagaaacatgttctcttcccaacttaaaaaaaaaacaaaacagaaacatgatgt

SEQ ID NO: 54028 - DNA, 1501 bp, Oryza sativa
caaaaacagacaggacttgtatagcagacgagctcttttctgtgtgctagcagtgtggcacttactaatagctgacaaaatttacatatgctgacagtggcaggaagaaagcatgcatcttaatttgtggcttctgatttgcctgtcatgatacaagtacggcttgtggcttgaaagctagcttaatacgcaggctgtttcctgtgcacaaaaatgggtggtagctggcgtttgatagtgataattggatagcaaagaccagacgatagttgaggcttacgaggctcacaggatggagcattgcttatcattaccctcttctggacacacctgcaaagggcctgttggagatttactacagtagatctaaacagtaaatgggaacagtaatcaggcaagctgtaaaaagattactgcttacagagcactttgctacagtactgaagcgctgttcggtgcattgattcaccgtagcagtctcagaatactgtagctacagttattctctgctgcactgtagagaacctagatccgtttgggggagcttctaactgctgcagcttctcccagaatcagaagctcccctaaacagtctagcttctggtctagattctaagaagttgtagttgtagaatccataaaatgaagtagaagccagaagctgggaaacccagctgcttctcagaatcttaatctccctcaaacaagcccaaaaactaaaatactaataagctaataacacaccagtgcactcaccaaaagtattgattttctttttggcatatttttaggaatctggaggttcacatcttaattttattggcattgttttcaggcctgtaatctccatggaatggaagtgttggaataaatgggctaggcccaatttaattcaattaaaatctcaagagcccacaagtaatgttagagagaataatactgccttaaaaatttaggtggaagaacctcaacttaaatagggtgatattagatattccctgttgaccggttgaggtgatggttggactgccacacgcatgcgcgcatgccgagtcggcctcggccgtgggcgtagcgaggcgaggcggcagaccgagtcgagcctgcctgctgctcttccgttttgtaacagacgagaataaagtcaccattaacaaatgaaattcattgtgttgtaacctccgcaacaaatgagagattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtagtaaccttcacaacaaatgagatttatttgtgtggtaatggagatctttctctctctacatataacgcaaggcagaggctctcaaagtgtgtgtcttcctcctactattgttccttggcgatactctccttctgttcctgcgctgtctctctgtt

SEQ ID NO: 54029 - DNA, 1501 bp, Oryza sativa
cgcttcgacctcatcgctgacgtcgtccgttgctcctccgccgttgctttggtcaccggtgagttcgccgcgtcgccctctacccgttggtgtcctccgtttgcatcgtcgcgccgtcgttcgccggcgagcatgcgttgccgagccgccgccggtggtgacgtcatcgctgacgtcatcattgccgcccgttgtggtccggccgtggaccggttgatctcggccgtccgttttggataggatcgatctcagccgtccgttcccgtgaaccgttgccgtgcgcccggtccaccgcaaaccctagccgctgacgcaataatccccttttccttttcaaaaataattcattattgcgtcataattcaattaaaatccatataagtgttttaatccgatttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatctagtaaaattcataataaattcatttgaagtcagaatgaggccgttcaagtctcataattcatctaaaattatgatctacatgtttgtttactttttatgtattgtttatttggtttttattagtctttttcttcattttgcgtgttagcttgtcgtttccgtcgttgcgaaggttcgtgagtgcgccggaagtattcaagaagattatttgaagaccgattgttgcgaggcaagtcacacagatcctaaacacaatcctttgagcatgttgatcctatatttaaattctctatttatttcaactttgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacattattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcactggggagtccatgccttgttttataaagggggtgattatgatccaggaatggtgcgctgcggtggattgtgttatgcaaggggtattgttacagctcctttccgagataccgtggtggtattgaggcacatggtgacatgttgtggggctgtgtcttgtg

SEQ ID NO: 54030 - DNA, 1501 bp, Oryza sativa
ccttattcaaaaaataacatctttgttcaaacaagaagtcaaacagatataaatgttttccttcttccgctgtaataacgcataaatcataccataactcctgagaacattttttggaaatcagttattcagaagggagagattgagcggccattacggagtcatggaatttgtaatctcaaacaccctctcagccaccccttaccttgccgtcatcgctgtgatccccggagcaatgatgtattacctcacagggctgacccgaggtgcggaacacttcgcatacttcgtcgccacactctgcatgtgcacgctgctggtagagagcatgatgatgatcatcgcagtcatcgtcccagacttcctcatgggaatcatcatcggtgccgggatacagggcatgatgatgctcaatggtggcttcttccgcctcccgaacgagctcccgaagccggtgtggaagtacccttgctactacatctccttccacaagtatgcggtgcaggggttttacaagaatgagttcatagggctgtcttttccaagtgatcagctcatcgaggccaatgccactatcagtggtcttcaggttctcaaggaaaggctgcaagtggagatgggctattcaaagtgggtaaaccttgctatcctgtttgggatgatggtgacatacaggatgatattcttcgttattgtcaagattgcagaggagctcaggctaaaactgagagggattagatttagacggcttaaatagtcgtcttctctcttggaaaacccggccaggaggaagggatcattaaacacaaataaaatttgaagtacagaatgtactacagtagtgtggacttatgtcatttgagcttgataattcctaacgggtattttctggcattttagtcctttgccaatggaacaaaattgtaaaggattttttaaggtaaaccaagttatcgtgaacggttcgttgcacagtgttaaagggctaacattgctcctatcgcatcggtggtaagatgtcatttcttcatatttcaattttcttaatgccaagtattgcattccaaaaatgaatatatggagcaataatgcctaatgtaagcaccgacatattttaatgttcttcctgaaaagtgacagcaagagtgaaatgtgaagaaataatgaatatttatacagtgatgtatttacaaacggcctggtttgaaacttttcttctgggagagaaaaagtttgggacaaatccatatgaaaggattctatagataaaacaaaataaatggtagtagaacgcattgctgtttgagatgtgtacacctttaagaaataagatatatacaaaatacaattctccacctcagatcctgttatctcctccattctgtggatatatagaattgtcagaattcttctcttaatctgcatctatggctgctgtcactaacatcactatatgcaagatatataagctatgtttctgcaatattagctcctattataa

SEQ ID NO: 54031 - DNA, 1501 bp, Oryza sativa
ttgaatcccagtttacaaaattatttttaatttaaattaatgcattatcgctttatttaaattcccgcgttatcactgttttatttagccatgcctatttacctttgttatgaccatattattcttgttattgttgttatttattaccttgttcaccctagaataaacaaaaccccaactagtggacactctatttatggttccactagtatgaatttaggtagatgcttcgctgattaataggacaacattaggtggttttataactttagactttgggaattctcatatcttttggacaatatggaattgttggtttatggtaaaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtaggaggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggatatgggcaagccgagcaatgtacccaagtcagtgttttaattcttaaaatttgctcaacaactaaaatttggaatggttggcctgggttggcttgggacgagctggaacccaggtcgggttgccagttcggtccgaatcatcgtaggccttgggttaaggcaggttcgtgagggttcacggccttgtttaataatattgtatagctctaggatcgtctttacaaaatagctttgggcaactaagtgacttttaaatgccgtttactgcaaaacttaacccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggccttatgtgcctttgtaataatgtaaatattatcgatgtaataaagatgtgtcttttatatcatgtttgtatggtgtaccccggcttttcctgggacggggattaatacactagcgttcgg

SEQ ID NO: 54032 - DNA, 1501 bp, Oryza sativa
ggccccttggaacagtttacacatgaaatggaaccctttctacgcaagcaaggactgccagttcgtctgaacaaaggttagcagtttctgtacattttttgtgcatgtgctggaaattaccatgtgaaatggctgttaagtttggtctggttgatgcaggggcggtggaattagttgcagatcacatagtatgtgaagaagggaagcccatttcaccagaagcagcacaaactctggtacatactgcatatcgtgcatgattaaaaaaaaaagcaaaatcagattggcatttttgattatgttaatattgtgaccaagccaatggtaacatctttgtggtgtcgtaattattatgtgctttaagaaatacacaagttaaaacacattggccaatcctatgtctttctattccattgcagtaaggtcctcttgaatttctgtattgcagcggttgcttgggatgcagatggcaacattccgactgtaccttgtctgccggtggtcctctgatgactttgaagtttacaaggaaggcttggcgcaactgcgagctgaagctgatgattcttcttaagcttgtttggcttgcacacccagtttgcagtgacgcacttgctgtcttgttgtgctgaggcagtttttggtattgtgcgtgcgcatggcgtttgtgctcttggtacgttggaaatctgaaaaatgtaatatgttaacagggtgttcgttgtcctagtattttctataaagctattcgtgtcttattaacagggtggcacatctacgcagctaacatgcttcatttgttggtatttaaactcttctgaacaattgttactccctgaatgaattcgttggtagctataatttgatttctcgccaaaaaagaagaaagaaaacgtactctttggttgtttttggtgcctagcctggggcctcggagtcggtgagtgttgtgtgcaggtttgtttgttttatttatgtttcattcttcctgtttcttttatttaattctttcgtatagaaaatttccgaaatgttatttccagttcatatctcaacggtgatgataaataaatagaccaaaccttttttatgtcatgaatgaatattgaaaatttgtaagactcgggctgccaggcttcatcaaggaaactcattgggggttacaaactgagattccttcaactactatgttgctaagccctagaacttgacattttctcttgtctcctgtccaccagtcaagcatatatcgttggtctcttccttggttaatgagctatacataggtttgttactactaataagatactattccatatgtcctgttagttaggactgtactactatacatggcttattaatcaatatactacattgttattactatcatcatcaccatcatctttgtaagtagacgaagctgcactacaaacctaacagtttgtgtatctctctaaactcggctgtgcactctagctgcagctgtaagctcaaactagga

SEQ ID NO: 54033 - DNA, 1501 bp, Oryza sativa
attcatcttagctcggatttagttggttcaagtctctaaatttttctaaaattgagatctacatgttaaaaatatccacatgtactgttcattcttgtttatgtgttgttttggtgtttttgctcttttctgcttagattccgacgtttccggagagtccgttttcgcaggagaagaatttgaagagttccaaggccagcaaggcaagtcacacagatcccaaacaaccctttgagcatgttgatcccgtttaaagctattgtttttattcaacaattgcatttattttcgaatgtcattgggtggaattaacctattgtttgttatagcccttttgttcttgattactttattccttgataccttgggttattataacttgactagttgggctttatatattggttcagctagatattagatataattgcttagtcatgcctagaaacattagcacactattgggataacttatgattcactattatttaatgatggcttaatgatagttcacgatggtcaatcgtgattggttaattaattacttgccaactaaaacttgataatggtgggttgtgggcacatggttttgagagttgtgctcatgacaattaagtaccggttcacgagtttcggttgtgaaacattaatcgtgccaaccacaagccagcgtgggcaacggctttaccttttgtatagcatggtttattgcgggacaccagactgagaagtgacggagataagcccacgggggtcgctggggagtccatgccttgtttataagggggtgattatgatccaggaatggtgcgctgtggtggattgtgttatgcaaggggtattgtcatagctcctttccgaggtaccgtggtggtattgaggcacatggtgacatgatgtggggctgtgtcttgtgggtacagtggtacacctctaatcagagtaaaactattcgaatagccgtgcccgcggttatgggcgggtcgaacaatgtctttcgtgattagtttcacacctctcatcataataacagatgctataattggtaataatttgattagctcctggtttggaatggtatattcctggtttggagatagaactgtgcagccgggatggttgttcagaatggttgggcctatgcaacagggtatgttgtatagcgttggattaatactgtttaattaatacttaactgttttattaaatgctgaaatgtttattaaatgttgtttatgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttccgctgcttagatctttattgattgagaggaactatctacctctgtaatgacattttat

SEQ ID NO: 54034 - DNA, 1501 bp, Oryza sativa
ttccctctatctacgatgccatggcattatgatggcattatgagttacttcatgtattattatatatgtaattcacactaaaatagcaatatctaattggttaaaagtaatatttgttagtattagatttaaaatttaagactcatattgactaggtatatttaaaaagctctataggtcacacgtatcatagggaagcaagttctagattatgtatatctccttcgcatttattgatcatataaagtatgtgtaacaaattacgtcaatatgaacaaattagagaaagggctagcttgatagtacaaataaacatatttattagcaataattgttttttaagatttgtaaaacaaggctctaaacattcaattaaaaaagaaaaacaccttactttttatccaaacttaatttattagaaatgtatggtaaacaaacaaactaattaagtctaccttatttttaaataactaggaaggctgtaaatatttagttgtatagatgaattaagtactattatatatagtataaagctaacaaatagcttagaaaatttatttgagcaataccaaaacgataaagaaatttgtgaggaaaacgaacttatgaagcatggtatatgccatccgtttgatattccacccatataaattcatcaaaacataatcatgatacatgcccgcgcatacgcgcgggctatcttcctgtttataaaaaaattgtgtaattactactcccttcgtttcatattacaattcctttgacttttttcttattcaaactttgttatgtttgaccaaatttgttaaaaaaataaagcaacattttcaatacaaaacaaacatattatcataatatattaaatattagtttaatggaactaatttggtattatattttttttaaattttttttatgaacttaatcaaacttagatatgtttgactagcaaaatatcataacaacttattatataaaatggatgcatagtatttttttcactttcacctgagtgcacaccatgtacgttagtactccctccttcaaatagtctaggtcctttttttttgcaccaagaccaaggtatagttaactcattcatcttatgacaaaactaataaacatgcaaccaataagtattaaaatgatttcttcggttccgatcaaaagtttaatatagcatataataactacaaataggacttagacttttagaaaaaattaaagaataaaataggacttagacttttggaaggagtgagtactagagggaagtgggcagctacaaattttagggtaaaacctattttttgccctcaactttgctcaaagtccattcgtcatcctgaattacagaaacggttatttctcactttcaactttttaaaaccatatacttgggtctaaaacatatggatttctgatcgatgtactagagctagtggtttttttttctcacataaacttaatttagggaagtttcgtaattgtgggcctactt

SEQ ID NO: 54035 - DNA, 1501 bp, Oryza sativa
tggcatagtagggtttcatttgcataaacaacatttaataaacatttcagcatttaataaaacagttaagtattaattaaacagtattaatccaacgctatacaacataccctgttgcataggcccaaccattctgaacaaccatcccggctgcacagttctatctccaaaccaggaatataccattccaaaccaggagctaatcaaattattaccaattatagcatctgttattatgatgagaggtgtgaaactaatcacgaaagacattgttcgacccgcccataaccgcgggcacggctattcgaatagttttactctgattagaggtgtaccactgtacccacaagacacagccccacatcatgtcaccatgtgcctcaataccaccacggtacctcggaaaggagctatgacaataccccttgcataacacaatccaccacagcgcaccattcctggatcataatcacccccttataaacaaggcatggactccccagcgacccccgtgggcttatctccgtcacttctcagtctggtgtcccgcaataaaccatgctatacaaaaggtaaagccgttgcccacgctggcttgtggttggcacgattaatgtttcacaaccgaaactcgtgaaccggtacttaattgtcatgagcacaactctcaaaaccatgtgcccacaacccaccattatcaagttttagttggcaagtaattaattaaccaatcacgattgaccatcgtgaactatcattaagccatcattaaataatagtgaatcataagttatcccaatagtgtgctaatgtttctaggcatgactaagcaattatatctaatatctagctgaaccaatatataaagcccaactagtcaagttataataacccaaggtatcaaggaataaagtaatcaagaacaaaagggctataacaaacaataggttaattccacccaatgacattcgaaaataaatgcaattgttgaataaaaacaatagctttaaacgggatcaacatgctcaaagggttgtttgggatctgtgtgacttgccttgctggccttggaactcttcaaattcttctcctgcgaaaacggactctccggaaacgtcggaatctaagcagaaaagagcaaaaacaccaaaacaacacataaacaagaatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaggggtttattgcgtcagcggctagggtttgcggtagaccgggcgcacgcagcggtccacgggaacggacggccaagatcgatcttatccaaaacggacggccgagatcgaccggtccacggccggaccacgagggacgacgacga

SEQ ID NO: 54036 - DNA, 207 bp, Oryza sativa
ccggggctcacctaaccacatttattgcgggttggacgagcgcgccacgccgcatttaatgcagcgcagcgcacgcttatccggtccgtgaccggtcgcagtgtgtgaccggtcacagacctgtcagatcgcgggttaggtggcaacaggaggcctgtcacacgcctcgccccggcctgtcacacgcctcgccccgtcccgtcggaa

SEQ ID NO: 54037 - DNA, 1501 bp, Oryza sativa
ggacgtcgcgagcacgaatccgacggcgagagcaagcggcgaacggcggaaacggaggaggaaggcacggggagcaaatatatagcgccgggagggggagagcgcggccggagagggaggaatcggccgcggagatctcggctccattgaagacgccggcgacgattgcgggattcaaatcggacgaatccgagggagagagagagggaaaagagggggaaacgggagagggaatcacggggagtgatttccccctctttaatgcgcgcggggacggcgggatgcggcggaatccgcggcggcggcggcgctagggcacgggcggcggcgggcgcggcgcgaggacagggatgacaggtgggacccacccgtcagcgagggcggcgggcgggcccgcctgtcagcggcgcgcgcgcgcgggggaggccaatgggccgcgggggaagagagagagagagggagggactgggccgagccggcccaagaagggaaaaggggagggggaaaagacttttagggatttttctttttataaaacccttttaactttgtttatttcttttcaattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacagtatagccctggtcaagctgcctgtggagtggagccgtctgcgccgtttatcttattttccactgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctctccttctcttttaattaaaccaaactaatggcacatgcacgtcataatctcttttaatggttctcattcaaaatttattctagcgttattagtactgtacatttattactgtactaatggctcatttaccagcaaaagttttacaatattgttttatttaatcttgctacaataaaataaatttagcatgttaattttataactttcttttattttcttttgaaacctgttattcaaaagtacaaaatttgtgaccttgtttccaactgtttcaacttatcctgcaagtttggcttacccttttactttgattttctaaactttatgcaaattaatccaaaaagttgtgctattaattggataaatgtcttaactccctcctttcacttgtctttaga

SEQ ID NO: 54038 - DNA, 1501 bp, Oryza sativa
aagttccggacttctccaaattttcgggacaagatggtgtgtcgacttatgagcacattagccgattcttggctcagtgtggtgaagcatcgactgtagacgttctgaaggttaggttattcaggttgtctttatctggatcggcttttacttggttttcctctttgccgtattggtcaatcaatagttgggccgatttggagaagcaattccacagctatttctacggtggggttcatgagatgaaattatctgacttgacagcgattaagcagcggcatgatgaacctgtgcacgagtatattcagagattcagggagatgaggaacaaatgcttcagcttgagtttaactgatgccgagttagccgatctggcctttcagggtatgattactccgatcagggagaaattctcgtctgaagactttgatagcttgtcacatctgatacagaaggtaaccttgcatgaacataggtctgcggaagttaggaaaagctctaagaaggttaatcatgtttgtccatacatgtatgggtcggatgatgacgaggacgattctgaaatagctgcagccgaatgggtgaggagtaaaaaggtcataccatgccaatgtgtaaaaagttctggaaaagtggagaagtatgactttgatattagtaaagctgataagatctttgatctgcaattccgagagaagcaaattcaacttcctgctggtcatacaatcgcatcggctgaggaattaggaaaaaagaggtattgcgaatggcataattctgggtctcattctactaacgattgcaaggtttttagacagcagattcaggtggccattgaggggggcaagattaggtttgatgattccaaaaagccgatgaaggttgatggtaatccttttcctgttaatatggtgcatacagctggccaaacagccgatagggtccgtgcaaagggttctcaggtgaattcagctaagattatcaacaaatatcagaggaagtatgacaaggagcaggagaagcattatgaagaatacgatgatggttttgaccctcattggggttgtgagttctttaggttctgctggaatgatggtatgaggttgccatctattgaaaactgccctgggtgcagtgatatcgtcgggagctcaagccggtcatataataggggtaatcggctaaggcagacaagagtttctgttcatcaaagattgggtccagtgaaccaaggtcatggccaggaggacaatgtaatcaggaagaatcaatggtgtccttctggtattttcatgaagaatcaaaagagaagggttcaaagattgaggaatagggagcgccttcaggaggttgaacaagaaattaatcatcggctgaagaaagcaaagccaagacaggagtggcgtgttaagagtcaggttcctgtagccgatgatgttgcagccgatgaggcaaagaggttgacaaaagggaagagtgttgtgacggcaccgattaacat

SEQ ID NO: 54039 - DNA, 397 bp, Oryza sativa
cgccgtccccgtcgtcgaggtcgaagtccccgaagtcgttcgtccatgtcgtcgtcgccgtacgccgcggagacatcgcgccgcagaaggggcagtggggtggccccgcgggaaagggagccggcgaggaaaagggacgtggaggaggaggggttagctagggttttggagagcggcgaggggaatggataggggaagccggaggcggagacgacgagagagagcgacacggtggccgccatgtctgagtttttttttttttggcgcgcggtcgagagcgagtatatccatccacgtaggtgtgtcgagatgtattagcacgaatcttaaagcacccaactttgttctcgattgttctgacggcgagagaaccaaccaaccctaccttggctttgcc

SEQ ID NO: 54040 - DNA, 1501 bp, Oryza sativa
gaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgattagaggtgtacatctttacccacaagacacatcttcctcacgtgtaaccacgtgccacataccaccacggtatacggacggaagacgtgacatagtttccaacccatcctagccatagacaagagtaccgacccaatcccgcctacggccggaacccccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcacctcgagcccagcctaaaaccattttggggacttttgaatagagggagcggtgtgaagccaattccacaacaaaccaacaattccagagtgtccaggtgatatgagagtttcccaagtctaaagttataaaaccacctaatgttgcctaattaaattgcgaagcatctacctacaattatacaagtggtactatgagtagagtgtccactagttgaggttttgtttgtctagggtgaacaaggtaataataatagcaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgctttcccaacagacggcttcaacttccacgaagagcggatcttccgaagctgcagcgtctacacgaccaacggaaaagaaaaggcttaaacactaaataactccatataacagcagaaataaagcacaaaaatgggttcttgacttcataaggaaaaattagagacttgaacggtccaattccgagttcaaatggccaagatatggccatttgaagtttatatgctctttaaatgcatatttgcgaatttcttcatttaaattttaattaaaaatctcatttattgcgtcagccgagagagagggcgcgcggaccgggtccacgggagcggggcccacgcgtcagcctctcggtccacggtggaccgggagcacgcggctggcggcggtcggcgccgtgggtcccacgcgtcagccgcacccgcgggcgcgggcggctgacggccgggccccacctggcagccgcggggcgcgcccgaaggcggcct

SEQ ID NO: 54041 - DNA, 1501 bp, Oryza sativa
gacggattttggaggtggtggaggaaagcagtcatcatgttggcttgctgggcgaggatctgggtgagaatggcgttggtgtctggtggtggtggtggaggcggaggaggaggtggaggtggattgccttggtggttgtggttgctgccttcgggttggttgccatcaccggtgttaacatttcttctggtcgtcaccatctgaaaaccccacacagaaccagcaaacagagagagctaacaattaaaactaaccacccacgactactataattcttgaatttattactgctattgaattggttcattaaggttcaagttgcttaggcaaataaaataagacaggctccgacacagttatgccacacaccggcataaccatgccccacacaactcaagaagacaaacgaggaaaaacacacacgcaagcctactaactactcgtctactgctgcgacgggccagggcggaaggtgagcaacggcgcatcctccgtgctaccaacgccggaggcttccccctcctggggaaccacgggcacaggctcgacacgaggggtctcgacgaagcaagtccacgccagggactgacgaacaagctcaggcctggaggtgctcttgcgggcggtgatcttctggctgcggcagacgcggcgacgcttggggcggcagtcctctccctgggcgatcttgagctggtgcagctgcgcctccactgcgtcgaggtccttcttgagctgcaggttctcctgccgcagctccaggatcttcatgttattctcgaccatcccacggcgcaccatctgatggaagtcgatacgagctgcgtcgtatgcctccaccatgcgtgccaggtgcacgatggtagcgtcatcctccgagctagcatctcggaaggtggcgaagtcgcgggctcctccgcgacgagggtggtagcggtagggcgagtgctgcaactcgtccgggtagcgctggtgaagggtgccgatggcgaggagagcggcgttctggcaagcggcggggaaggaatctccacccgcggtgactgccagcgaagtccgcccgggagagccagagaggatcactgcagtgacctcccaaccagcgtggggctctgcatcctcaccctcctgctccgggagcggcctggcctggtaatccactccatgtggataccccaagaccacgcacatgccccgcagctccaaaacgaagccagtcatgtccaaaccacgacgggtgacgctgccggccatctacaaacaaaaacaaaaaggaaatcaacattttttttatggtcagattttgatggtaaatgaagcagcaagacagagagagactagactgttttcacaaatagcaaaggatttttatttttgaaaatattactaaggcttgggatctacggctcgtcctagggtcaagggtggctctgataccaacttgtcacgaccggaaataacccaacgggcgttcctgacgtgcgtgcattaatccttgtcc

SEQ ID NO: 54042 - DNA, 1501 bp, Oryza sativa
tgatcactatgcacccactagttcacagtacacctctagtttatgtcttttttttagcatttacttcatttgtatattactgatgatatgattacgttattgacaaatactcttttcatctcatagaaaacaaatttaatacatgatgtaatatatcttagtaataatttaatacatgatgtaacatatcttagtaatataaatctgaatgcaactctgctgcctagattctattaaaatgcgtcatatcttttatttattttttaatagaacggagacaatatattgtagcaacaagccactgtaacacaatacatactttctctgtacgtcttaatgataggcagccagaagaatcttcgattgattgcttttaattaattagttaactaataatcaatgacttaattaattttctagttagcgtcagaagggcaaagcagcagtaggcgtatgcatgtgtccagctccagcgccttggattgcgaccattattattcattatttttccgcgagtccaaggttatagagagttagtattagtttaagtttttgatttaccttgcggtcaaaccagcaggctgtggttataaaacaattacgcaatgatttttttgttacccgattaggcgcgctgcttatcctgttgatgttaccatcaactcaaacttgatatgggttaattagatcaacaaattatgagatcgattagttaagaatgaactgtatgtattactcaataccaatagcattagtttgcatgaataatcttaccccaacttggccaattaatgtttgttagacggcatgtacggatcaaaaatattagtactagatctctttgaaaggggagatttgcaataatgacgctgcaaacattaacctttactataataatactggacccacatttcatagatagcgtgcactagtatgtagtaataattattgtacaaaactatgtgatatcgggcactttacatgaatattatatattatagaaatgctagatatggatatatgttgcaatattaagaaagtgatgtttggggtgatgtttcgacatactcgctactatcgaaaggcacataaatagattgacactatagatagtggaatagctaaaactggcacttatagtatttttcccacctccatgggctaataaaaaattggtacctttaaacggttatatgtgtcagttctataaaaaaccaacatgatctctttttttttaaaaaaaaactgacatctttattttattataggtgctagtgaattaaaaagccgacatcaataatatattatagataccagtttttttagaaaccagcgtacgaaaaatcgagccgagccgaccactcgtccttattcgctcgagctgataagaagagcaggacatggtccctctccccggtgtccctttcttacacgcctttctctctcaatcttcctcttgcatacttctctctcttctcacgtgcgactccgcccatccagc

SEQ ID NO: 54043 - DNA, 244 bp, Oryza sativa
caccagcgaattgctccatcttctccaatggccaccaccagcgacgtcccagaggtaactccatgacactctaccttttcttttcttatttctcatattagatcaacaaaaccctcagtttacttcatttgcacctcgtattattcatgttcaccccttttactgttcatcttactgtagcaaatgagatatcaaatagcgattccactagccgatcatgcattatattattttcttggatcga

SEQ ID NO: 54044 - DNA, 1250 bp, Oryza sativa
acccccccgagggggtcaggcctcgtgggtgattgctcctgcccaagcctctagtcatgatactcccggtcccatgtcaccgacaacaaccttttctcgagtagtccagccatggccggtgctatgagataggtcgtcggtcttcgttggtaggttgggtgcgataactccgcatttgtcgagaatgttctcgataatggagtgtactcgaccataacctactcgagtgctcaattgttcctgaaaaatattttctagaaggcaagatatatagcagagaatatcgagtatatattcgaaaaactgcctggattttctagtattatcaggatgtaacgagcagatggaattatcaggcattatgtaaaccgtaaataggcatgatttatacagaagaaaacagagcgagcccccagcgttagaccgtggttggcctaacatcggaagcactcgtgcaacggagattgtataagaaacatgctctaggtaaacataataaattatagacctgacaatacggtatgatctcataccgaataggtacgataaattatatataaaatattgcgtacctgtgtatatatatgccggatatatctacggaattagtagattaattttaaaaaattaatctactaaataccttactgtgcatgcttggtgaggaacagtaactccttaattgatccgtttgtgtgtatggtactgttccccgtgtaggcctgcaccttgtattttggtcctttaattgatctgtttgccacgtcgtcggaacggccaaccaggatgctgcctagagattggattctagtgcaagcataagaactcctccaatccgacttagaatttgcaccaatgaacagatcaatctggctcttgatttaagctccacggcactcgttttgttggtggagataagccgatctctcacaccagtcaatgccgcatacgtggaggaattagtgtcggattgctcttggatgccgccgacatagtagctctccttggcgacgatggttccgatctcgtcggacgatatactccggtcgggttagatctccccataaccgaagttgtcgagtagattgttgttggagaatccatctttgaacccatctcgtcgaaatcctgaagcaccaaaatccccctacctggcgcgccactgtcgacgtttgatgccgtcattctggtatttgcttagtatggggaccgttgatgctaggatatatgcgagactgaggtaaaagaga

SEQ ID NO: 54045 - DNA, 1501 bp, Oryza sativa
cagactagataactacggtgctatttacagatgaactcattaatctacaatgagatatcagaataactgttgcccaagttcgattatactcaggcctaagaccttatgtgacggttcgactcttaatcggacgagcatacatacatggtatttggacctcggcaagccgaacacatcctatccttccaagccgggagggcccacgcacatttggctgtactcctagatcatatgtctactacaccctacagtgccgtgtacaggagagtactacgtgcatcaatccttaatgtcatgcacaaatcaacaaaggtaattagtagattgtgctttaaattactctactaattttgttgatatatccagcatatatctacacagttatgcaacattttatatacaatttaccgtaccaactttcagatccacacaatattgttagatcaacaatttattatgtttacttagagcgtgttttttatacaatatctattgtgccagcgttcctatattacgtcgacaacggtttaatattgggggcttgctatgtttcttctgtataaatcatgcttgtttacgttaaatatagtacccgatattcaatttaaatctgctttttatatccctataatactagaagatttataaaatatttcaagtacatacttggtattgtctgttatatatcttgccttctagaaaaaaaattcaggaataatcgagcactatagtgggcagcagacgagcacacccattgtcgagaatgttctcgaatgaatgcagagttgtccaaccaaacctacaattaagaccggcaacctgtctcacatctagtatcggtcacgaataggtctatttgtgaaaaagttaccacatacattcccctcactaatgttgtcggcttgatcactcgacatgattgtgaacggacatctgatatacttataagtagggtatgtgagtcatgttggccacataggatgcacatgtaataaccaactctaagcgcccttgcaagtggtcgaggtatggctacccctagcccttggctagctgttgtatcgatcctcccgccatctctatgagtggtcaaggtgcgactacacacctggtatgagtacaggcatggtagctatcccaccacctctacaagttctctacgaatggtcgaggtacgactacacacctagtctgagtacaggcatggtagcgatctcaccacctatacgagttctttacaaatggttaagataggactacaaactagtagcaatcccaccacctcttcaagtggtcgaggtatggctacacccggtccttgaacagcggttgtagcgatcctcccaccatctctacgagtggtcgaggtatgactacacacctggtccgagtacaggcatggtagagatccttccacctctctgaatcctctacaagtggtcgaggtatggctacacctgatccttgaccagcggtcgtggcgatcctcccaccacatcta

SEQ ID NO: 54046 - DNA, 1501 bp, Oryza sativa
cctcggattcgtccgatttgaatcccgcaatcgtcgccggcgtcttcaatggagccgagatctccgcggccgattcctccctctccggccgcgctctccccctcccggcgctatatatttgctccccgtgccttcctcctccgtttccgccgttcgccgcttgctctcgccgtcggattcgtgctcgcgacgtccacctctctctccgccgtcgccgccgacctccggtacgccgccgacgtcgctccgggctccctcccgactcggcgtcacctccatccgcttcgccgcgtcgtcgtccaccccgtccgccccttcgcttcgcccgccgaccgccggagctccgtcgccctcgtcatcccgaaccgcgccgccgtcttcctccgcttcggtcgccgttgccgtcgccgccgtcgacccggggtgagccgaaggccgtcgcttcgcttccctcttctctcctctctctcgggcgccgctccgccgcgccggtggtcgccggcggtgaccatcggggcgcgggtgcgccgcctcccgtcggccgtgccggcgaggccgccttcgggcgcgccccgcggctgccaggtggggcccggccgtcagccgcccgcgcccgcgggtgcggctgacgcgtgggacccacggcgccgaccgccgccagccgcgtgctcccggtccaccgtggaccgagaggctgacgcgtgggccccgctcccgtggacccggtccgcgcgccctctctctcggctgacgcaataaatgagatttttaattaaaatttaaatgaagaaattcgcaaatatgcatttaaagagcatataaacttcaaatggccatatcttggccatttgaactcggaattggaccgttcaagtctctaatttttccttatgaagtcaagaacccatttttgtgctttatttctgctgttatatggagttatttagtgtttaagccttttcttttccgttggtcgtgtagacgctgcagcttcggaagatccgctcttcgtggaagttgaagccgtctgttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgctattattattaccttgttcaccctagacaaacaaaacctcaactagtggacactctactcatagtaccacttgtataattgtaggtagatgcttcgcaatttaattaggcaacattaggtggttttataactttagacttgggaaactctcatatcacctggacactctggaattgttggtttgttgtggaattggcttcacaccgctccctctattcaaaagtccccaaaatggttttaggctgggctcgaggtgcatggttttgatagtagcacctcggccgtttaaggaccggt

SEQ ID NO: 54047 - DNA, 1501 bp, Oryza sativa
tatatagtatttctatacgcctaaagtttatagacccaaagtttataagtcaaaagtttacatacccgtttcaaagttgaatttgaattatatctgattcaaatttgaatttgaattcaaatattttctatatatagtatttttatgcatctaaagtatatacacctaaagtttatagacctaaagtttataagtcaaaagtttacatacccgattcaaatttgaagttgaaatcaaatattttctatatatagtatttctatacatctaaagtttatacacctaaagtttatagacccaaaatttaaaagtcaaaagtttaaatacccgattcaaatttgaatttaaattcaaatattttctatatatagtatttctatacatctaaagtttatacacctaaagtttatagacccaaagtttataagccaaaagtttacatacccgattcaaatttgaatttaaattcaaatattttctatatatagtatttctatacatctaaagtttatacacctaacgtttatagacccaaaatttataagtcaaaagtttaaatacccgattcaaatttgaatagaattcaaatattttctatatatagtatttctatacatctaaagtttatacacctaaagtttatagacccaaagtttataagccaaagtttacatagccgattcaaatttgaatttgaattcaaatttttatatattgtatttctatacataaatttttctaactttttgttttttttacaaaatttttgtggtgtactgtagtaggaagagaagaaggggtggagaaaggggggagaggagggaggagtgtatcgagtataggggatgggcggacgggtgatcgctgggcggacgggggagcgatcacccgcccattagcatttccgtgttcaaagggtctttggtcaaggacgcaacggggtcatttgcattgtagtcgggggctactgtcagtgtcatagataaggcatactcgatagtcttggttaggctcagcggggcctaccatataaaaattcttatacagaattatgcctcatgtacggagggtgttccggatgaggaaggaaaaacataattctactcgggcactacaaggactactcggatcgtatccacacttgtctccctagttctgcttggacaaggggacatgcaagggtataaatgcaagacaccctaggacgagaggggacacgccaacaagaccaacataagggacaagcatagacaaaacccaatgttggcgatacagaggccaacaaaagggatctagcactacccccaatctggccgagtttgtatttgaggaagaagactgcactagctgtcgactacgtgttggaaatccatgtcgtcaagccgacagagactagattgggtcatcccaaatattgtactcatttgatattgatatataaatgcaacaccggcttcggccagcaggagtagggctattacctatcagttaaggggctcga

SEQ ID NO: 54048 - DNA, 1501 bp, Oryza sativa
ttagacttgggaaactctcatatcacctggacactctggaattgttggtttgttgtggaattggcttcacaccgctccctctattcaaaagtccccaaaatggttttaggctgggctcgaggtgcatggttttgatagtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccgggggttccggccgtaggcgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctaatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataacattgtatagttctaggatcgcgtttacaaaagagctttgagcaactaaatgtctttaaatgctgattactgcaaccctaaccctttatattataactcccttgtactcccttgcatttattctgcatttgtgggtgtgtcttgttgagtacggtggttgtactcagtcttgctcaatttttttccaagtccagaagaggagttccttgaagatgaaggcttcggtgtctagctcgtgcctgccgtcaagcgcctgtggtcgtcgccctagtcttccgctgtttctcgtttgtctttgtgtgtgctgggccttcgtcgcccatgtaataattttatttacgcttccgctcgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagtaatattttcaaaaataaaaatcctttgctatttgtgaaaacagtctagtctctctctgtcttgctgcttcatttaccatcaaaatctgaccataaaaaaaatgttgatttcctttttgtttttgtttgtagatggccggcagcgtcacccgtcgtggtttggacatgactggcttcgttttggagctgcggggca

SEQ ID NO: 54049 - DNA, 1501 bp, Oryza sativa
tgcgaagaaacacagttccgccgaatcatgtctgagcacgagattgatgggcccacaagtcagtgcaaaccgacttaaagaggggccaaaccaccaggaaccatcatatgggcccaggtgccatcctctcatcaaaggcggtggtgaaagacggtggccatggtttggctgaactaggcttggcgcctccaacaccgagcttccacatggcgattccttcttcactcctaatggcagttatgtccgtttcccggcctacaactagggatgaaaacggatcgaatacgatcggaaactagctctatcatatttgctttcatattttttttcggaatcgaaatcggaaacccagatatgaaagcggaatcgaatcttatcggatataaatagggagtgaatacgaagcgaaacgaatacggtgacgaatattaatcagaatataaaaacccctcaatactcacaaacgatttttgatattgtgtttctaaaatcatgctatatcatgttattgtgtttttactatattattttggctattttttgtgactttgttttatcaattaaaaatttgaatttcaaaacttcaaatgatatttgaaacagtaaataaattcagctgaaaaagtcatgaacataaaagttgtagaactcatcaagacatacaacttttattttagtcatttcttcatccgacaaagtgataataacattgttcataaaatttacatctctctcttctagtttataaaaacaaatgatagagatgtaaattttgtgaacaatgttactatcactttgtcggatgtagaaatgaccaaaataaaagttatagattttgatgagttatacaattttgttgtcgatgactttttcagttgaaatcatttagtatttgaaaacattgtttgaagttgtcatatttttaaattcaaattcaaactgttcaaacaaagtcatatagcaaaataacaaaaataaaagttatagatcttgatatgttatacaactttgtttttgacaatttttccatttgaaatcatttactacccgaaaaaattatttgaatttcttatattttaaaattcaaattttatatagttcaatcaaacttggatggagaaatgaccaaaataaaattggtagatctcaatgagttctacaactttgtttttaacaactttttcatatgagttcatttagtatcataaaatttaatttgaagttcatttttgggttgggctagcttatgggtctgatgtgtaagtcggatatccgatggaaaatactggataatatccgacggatatccgattccgacggatatcacctatatcatattcgctttcatatctgacaaaaaatccgaattcatttccgaattcaaaaatttccagatatatccgaccgaaactatctgaatccgaaaaaaggtccggtcggacggaaattatccgaatcactttcaaccctacctacaactgacttcactactgtcattagg

SEQ ID NO: 54050 - DNA, 1501 bp, Oryza sativa
acaagaaagaatgaaacagagtgaaaaatagtgaaaactaatcttgtagcagttaatctccaacaatcccaaaaatttagagcaaagcctcccctcctctagctggtcgaacaaaacctagaggtgccgctatgttctttactcgatcacctcgacgagtgaggatgatgggctatatactgcgagctcataggtgccagttcataaatagaattggcacatatatatgtctgacagcctcgaaggtgttgtttagtaaaatgagcactcatagtggctactcgcgcagggtaggccttaaaggtgacggcacctttccctgataaccttaagggcccctttgaatcataggattgaaaaaatgtagaaataggaaaaacgcttgattttgatatgaatgtaagtgtaaaacagaggattgcaaagcacatgaaaaacataggaatgatcatttgattggaccacaggaaaaacacaagaattagaggagagttaaagactcataggaaagttttcatgaagtagaacctcatgctagatttcctctaaaacttgcatggcattaggccggcaatgggaaggggggagggcaaagggcaccaccacggagcccctcgacagccttgcgcgcacccgcgggtgcacgcgcgtgccagcgagggggcccgcagcggcgctgtcatctcctacggccgccgctctctctctcacttggtggggtagactgtgggggagaagagaaaagaggacgccggccatggggcggtggcacgagggccgccggcggcggcgacgctgctccgcgtggctgcacgtggaagtaaatggctagggttttcaggcggctggggacgggctagggcttttgatcgcccgatctctccgctcgaccgtccgatcgaaaccttggcgatcggacggccggtgtcggccggccgaattgagcacaagagggaggcgcgtggcggcagctttcccggcctaggaataggttgcggcctagggggaagggggcgcgcgcgcgcgctcggccgtgggccgcctttttccaatgggccgaaagtgacgggcaatgaacaatagcgcttttccttttttatttgtctattttcatgcatatttcaatagaatttgaatagattttgcatgttttacctctgtttaaaatttgaaccaaaggggtaattttttacacagagtaaataacagaatttcttactgttcatatgtattttatatagatcttccgctacaaatagatgaaattgataaaaattcgtgtttctaaaattaaatttcgaaccaacgggagaatttaattttaagaacattaattttgtgctatgatgttgtaattttctgacaaacgttgttaatttcaatgttatagttatggctttatgtgttatgtctattttgcccaacggtgatttaggtttaatgcataatattttaatgttaattttgttctcacagtacatgattatttcaggtggctact

SEQ ID NO: 54051 - DNA, 1501 bp, Oryza sativa
ttcagaacgtctacagtcgatgcttcaccacactgagccaagaatcggctaatgtgctcataagtcgacacaccatcttgtcccgaaaatttggagaagtccggaactttgaaccgattgggaagaggaactctctcaacaaactcagggtaaggctgccgatacaagcttccagtctcttttggtttgagcccaaactattccctcattacatcagcaatcacatcggcccacggtcgttgttgagttgccccttgcgactgttgcttcatgggctcgaactgaccgtatgcaaactgaggttgagccaatccccctaactaatattgggcttgtggggaaggaggctgatattggtaactcaagttacccccttggtaattgtgaaggttcggctggatattgcgcatcaagtgctcaggaacaacttgaggcattactgtgccattcggctatacatggtgaaccaaatgttctgggacaacttgatttaaaaattgttgtacaggctgaccaccaggcgttgcaaacccggccgatgcacttattgacccctggtgctgaatcggctgaacgatttgctatcttaatggcgtctgttaattcggctgcaaaggctgctgccttggtggtgtttgctgaatcggctgcagaggctgctgccttggtggtgtttgctgaactggttgcacgacctgttgttggtttggttgtacaacctgttgaatttggggtgtctgctgaatcggctgttgctgaatcggctgctgctgtattggatcaacaataggttgaggtggcagaaacatggcagcaacctgatcttgggttggccaactcgaaacctgcccgctatgttgtggatgctctctcattaacacccgagggttcatcggctggcccggcgccatagatgatgtagcaggtagaggagttgatgccggcgccgtcggctgagttgtgggtgcaacggagggaaccgcctgaatagatggctgaacatcggtgatcaaagaccgataatttgggaagacacctccttgcaaataaaccgggcctgcagcctgatgttcagctattgaaccatcgctattgacttcatcatgtttgatagggtattgactaacaccccagactgattgatcaaagcatgatgcacagcgtaatcaacccgatcttggaagttattgaaaaagtcctgtgccacatcactattaagatttcctccctgcagcccctgagcaccgtcaacttgaactccattcaccccatcaccttgtactccatggacttcttgagaattttcgccttgatttcctagagagccgtcggtagcacccttgatactcggctgagccgagccgtctagagcttgtttcccatctccatccttagaagaactggtcccaggatcattagcaaccacttttattttgtacttctgaacaagtgtccccttgcgggtctgcatgaatgagttcaagaactgatcccgtgcttg

SEQ ID NO: 54052 - DNA, 1501 bp, Oryza sativa
cccctttgcagtatcatggtgatacttcggggcatggcgacatgtgcggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttaccgctttcaactactgcttttaaatgctagctttatgcaaaagaacctctagcctcctttggttatatcctgcatcatacctcctcttccggtatgacttgctgagtacagtgggtagtactcagtcttgctctcttctcccccacaccagagctgaagatcttcctagttggagctgttttgtcaaagttggtttcgtcgctgccgtcaaggattgcctgtggagtggagtcgctcgctgctgaagtcaagcttcctggtttagctcgcttttatcttttccgctgcatttgtaatcttttctatttttgtaagacgtggatctgtatgtcaacaattgtcgtttgtgtaccctggctggtcctggacaggggtttaatgcacattcagcttagaaattctggtccgagaatttctgggcgtgacaagttggtatcagagccgaccttgaccgtaggacaagccaactggaaaccctaagagccctctgaaccccttttcatatgcatatgcccttttgcacttggaatttgttttgggaaaatttggagttttgcctctttggtttgcgggaaaaatcttggtcgttcattcggatcggatttttttttaaaaaaaaaaattagctcagtctagggctttagaaaaattttagttggagtttattcgacagtcagtcgggaatttattgggggttatgcattaggtcgtgtctatgttcgatgggggcaatgttatgcgcatcattttccatgcaactagtctatgcattaatttattgcctagttgcattagtgtctttattttgagttcatgaaaaatgttctatgcataaaaatcatcatgctcggttatttatttgggtcttcttttgctttgtttaatttggatttgagcatgaattggttcctatcccttgtctactttagatgtcagtcctatccctcgtttgcaagcgccgcccgagcttcagagtcgccgcccttagctttatcgccttcttagtctgtttgcttgctagttttcgtgtttaggtttgttgcttgtgggttagtcagcggtcgatatcatgtgtcagtggtatgactgcctcaattaggagttgcgtgcctctttttcagtgttttaatcaagattaagataattgcacttaaattcataaacaagattagtttctgagccccctgtttttcttcattttctcatatttctacctatccccttcaga

SEQ ID NO: 54053 - DNA, 1501 bp, Oryza sativa
ggtctggttgccagttcggtctgaatcttcgtaggccttgggttaaggcaggttcgtgcgggtttacggccttgattaataatattgtgtagctctagcatcatgtttacaaaatggccctgagcaactaaaagtcttttaaatgctatttactgtgaaccctaacctctttattataactcccttgtactcgtttgcatttattctgcatccgtgggtgtgtcttgctgagtactgtggttgtactcaatcttgctcaatttttccccaacctagaagaggagttcctataagatgaaggctttggtgtctagcttgtgcctgccgcaaagtgcctgtggtcgtcgccctagtcttccgctgttttccgtttatcttcgtgtgtgctgggccttcgccgcccatgtaataaattatctatttacgcttccgcttgtaaaactctgaattgtatcaacttttggtgtaccttgcctcccgggacaaggaataatacacgcacgagtagaatgcccgttgggttaattccggtcgtgacatgtcataacaagttttacctgttgttgaagatcgaaaccgatgcagctcaacccgaaagcaagaactcgtcgaaacaaaactaaactaaaaagggtggcgatgcgccgaaattgtattgaacgtgtgtgttaaaagttacatagggcttgggtctatttatacccgagaattacaagataagtccataatgaacacgactattatctctaccaaactctaagataccataagtctttgcggcagacttttacccaaacatatctctaagaaaattacttaaaacatcctaattaatagatacaattgcctcctcaggactctgcccatgtgcggcaatcaccttgaagcacctcaatccaacccaacatcacacatcaagttgtactgccaggatcggctacatcagcttacctagtccgactcaaactcagccgatcttaccgtagccgatctagactctagccgattcctgctctgttttcgaactcgatctccgcctccgacatcgcttcgatctaatcttcttttccgatgccgatattaccaaatttggttgttaacacatggcaaagaaagttgagaacattattacatttgtaaatgaatctcattatgttggttattctagatccacatggtggattgattctggagcaactattcatgcgtgtaattgtttaaagggtttccgttcgacgaggactacgcaaagaagcgaaagctccattagagtcgccaatggagttgaaggcaaaagttgaagctgttggagatcttctcctagagctcgcgaatggcttcacacttttacttcgagttgttttttatgtcccttctttgcaaagaaatttaataagtgtatcgaaattggattttgatggatatgattaccattttggaaatgtcaaatgtgaactatggtataataatgcatgtaatggtcttgctgtgttgcaagacg

SEQ ID NO: 54054 - DNA, 1501 bp, Oryza sativa
tggtacagtcaggtaacttgtcgcttgttttggtgaatttccaattcggcaattactggctgtttgattgtttggaatatataccaactgaagaacatgagatgtttttattaactctctggcgaaactggtatgtgtgtaatgaaatcacacacataataagccgcctcctctgttggaagtctccaaaagattcctggaaagttatattgctactctattccaaatcacgctgatctggaaaaaggtaaaactgttgttagcagatctgttataagtgcaattagaagaagaggaccagatggtcctcctgctgcatcgacccgtttgcactaggagaagccgaggctgggctggatgaaacttaatgtagatggctcatttgatgctgatcgtgggaagggaggtatcagtatgattctacgggacaacagtggtagtacagtttttgcagcatgtaagtccctggatagctgcaagaatgccctggaggcagaaatccgagcttgcatggagggattgattttggccctgcagtggactatgcgccctatcttgattgaaacagattgtgtttcgctagtcaatcttctgaaggaagggaatagggatctgtctgaagttgtaatttcatttcatagctagtctgtgaggacgttttgaatgagtaatacacttttttccccgcaaaaaaaatagtcaatccaataccgaaccaataaactgtcagacagttaatttcagatgcactcctcgcaaaaaaaaaatcagatgcacgtactaagatcataataagatattcctatatcgtattcaaatatcaatatatagcatgttctctctctagaaaaaaataaacctcaatataatagaagggctgttcctggatccccgacgacatgatggagtcttgatcaacactgcgccgagaagggcatgaggactaagaccctgtttgattcagcttagagttattataattcagattattacaagcagctaacatcttattctatgttaatccagcttataataatctggctcaataatttagattacaataatcttatgctaaaataaacgggccctaatataattaggaagataacttgatctataactatcgggctgaggtcctcttatattgatggaggactctgtccaagtaagaaccgcgagtgacgttccccttaaggttcctgttcctcttagtcccatgacacataatcaaggtgacttataggtatggtgctgaatagaattaaaccaaaataaaatagcagatagttgggagagctatatgtagatctgtattactctttaaaatttgtactagatcaatcatacattaaaattgcatgccttagtaacaaacgacatcaactccttagggaaaggctgtatgcctacgggcagaggccggagatgtaacacatttccattatctaaaaaaactccttagggaaaacgtaacataaaccacaattactgaatcagtaga

SEQ ID NO: 54055 - DNA, 1501 bp, Oryza sativa
ctgtaggctggcaaatactgaaggatcctcaagttcctttgctttgcattcccgcaaatcctgggatttaatttggaagtgtaagctcccacagaagattaaaatctttgcctggaaagtggcctccaattgtttagctaccatggacaacaaaaggaaaaggaagttggtaaactctgatatctgtatcatctgcaatagagaggtggagaattctgtacacgctctcttcaaatgtccccgagccagtgccttgttgtcggatatggtacagtcaggtaacttgtcgcttgttttggtgaatttccaattcggcaattactggctgtttgattgtttggaatatataccaactgaagaacatgagatgtttttattaactctctggcgaaactggtatgtgtgtaatgaaatcacacacataataagccgcctcctctgttggaagtctccaaaagattcctggaaagttatattgctactctattccaaatcacgctgatctggaaaaaggtaaaactgttgttagcagatctgttataagtgcaattagaagaagaggaccagatggtcctcctgctgcatcgacccgtttgcactaggagaagccgaggctgggctggatgaaacttaatgtagatggctcatttgatgctgatcgtgggaagggaggtatcagtatgattctacgggacaacagtggtagtacagtttttgcagcatgtaagtccctggatagctgcaagaatgccctggaggcagaaatccgagcttgcatggagggattgattttggccctgcagtggactatgcgccctatcttgattgaaacagattgtgtttcgctagtcaatcttctgaaggaagggaatagggatctgtctgaagttgtaatttcatttcatagctagtctgtgaggacgttttgaatgagtaatacacttttttccccgcaaaaaaaatagtcaatccaataccgaaccaataaactgtcagacagttaatttcagatgcactcctcgcaaaaaaaaaatcagatgcacgtactaagatcataataagatattcctatatcgtattcaaatatcaatatatagcatgttctctctctagaaaaaaataaacctcaatataatagaagggctgttcctggatccccgacgacatgatggagtcttgatcaacactgcgccgagaagggcatgaggactaagaccctgtttgattcagcttagagttattataattcagattattacaagcagctaacatcttattctatgttaatccagcttataataatctggctcaataatttagattacaataatcttatgctaaaataaacgggccctaatataattaggaagataacttgatctataactatcgggctgaggtcctcttatattgatggaggactctgtccaagtaagaaccgcgagtgacgttccccttaaggttcctgttcctcttagtcccatgacacataatcaaggtg

SEQ ID NO: 54056 - DNA, 1501 bp, Oryza sativa
attaattggccaagttggggtaagattattcatgcaaactaatgctattggtattgagtaatacatacagttcattcttaactaatcgatctcataatttgttgatctaattaacccatatcaagtttgagttgatggtaacatcaacaggataagcagcgcgcctaatcgggtaacaaaaaaatcattgcgtaattgttttataaccacagcctgctggtttgaccgcaaggtaaatcaaaaacttaaactaatactaactctctataaccttggactcgcggaaaaataatgaataataatggtcgcaatccaaggcgctggagctggacacatgcatacgcctactgctgctttgcccttctgacgctaactagaaaattaattaagtcattgattattagttaactaattaattaaaagcaatcaatcgaagattcttctggctgcctatcattaagacgtacagagaaagtatgtattgtgttacagtggcttgttgctacaatatattgtctccgttctattaaaaaataaataaaagatatgacgcattttaatagaatctaggcagcagagttgcattcagatttatattactaagatatgttacatcatgtattaaattattactaagatatattacatcatgtattaaatttgttttctatgagatgaaaagagtatttgtcaataacgtaatcatatcatcagtaatatacaaatgaagtaaatgctaaaaaaaagacataaactagaggtgtactgtgaactagtgggtgcatagtgatcagtccaaatcaagattaaatcctgatggccacaattacaattttttttatctagagaagaatattttttacccggtttttacatccaataggatatatacatctatttttaaattagaaacttagcctatcaaatagagaatttagccctcaaataacccaatctaaaattcgcaattacatacgtgtggatatgttttcaaaacaattttactgaggtttgaggatttaattttagtgaggtttaaggttttgaagacttcttttagtattcaaggataattgggccatcattaatttatcgaagaaattaaatataacagtataaggccatttccaacccaaaacattagacatagtttctataaactccacatcaataagaaactagtttaatgctacttatctcacatgatattttggatgttgtgtataaaccatgtctcatgcaagacatggttttcttctttttcacatttatttacttgccacctcattttctattctagatgatagcttatttaatactatggtagatattattctagtcattgtgttgggaatggcctaatgttgacctaggtgggcagtcaaggaattagtttgtcgttacactcacgccgctaacgctgtgcctatgtaggccctgttcagggtgtctttagttcatgctaaaattagaagtttggttgaaattggaacgatgtgat

SEQ ID NO: 54057 - DNA, 200 bp, Oryza sativa
ccgtgggacacatggtctctactatagtaggatccagatagtttgtgcacgaattaagcatctcaaaccaccccaaactagtcgttcaaaaaaccaccccaaactcaattaagtgtgcaggagagctaatgatattggaagtctcagatctcacctattagattcctaagttctctacacaggacatgtgtcctttcaga

SEQ ID NO: 54058 - DNA, 1501 bp, Oryza sativa
gaattagctagtcgtccatcccatgatgaggataggcggccacatactcttgcagatgttcctatgcttcaggaatagactcgtccctcgtctgttggaaactagaaattcgtccacgatgggcattggttttgcctatcgggaagaacttcaagaggaatgtcgtagagcacttgtcccagatgttgacagcagcacgattggcgtaaaaccactgcttcgctctcccgaggagggagaatggaaacagcctcagcctgacggcttcttgactgacgcccttgatggtgtacgtgctacagatctccaggaactgctgcagatgagtgttggcatcctcgttaggcttgccatagaacgggctagcatgcgccatcgtgataaggctggacttcaggtcgaaatccacgtctccaatgttgatctgcggcccaatggccacattttcagcagagggagcaacgaactcgcggaaggtcttgtcagccatagtcttgaaggtcggtggcgctggtatggctggtttgtctgttggtagagttttctgcggaacaacgactcgcggcctgacactccggaagaaatcttctggattttctttgaagttttccggcaagttgaaaccggtcatgcactaccctgttttcaaaacagaagtgaaaacaaccaaggttagcctacaaaggaaaatgattatacataggtaaatataaagtattagttcaagtaatctttattatgaatcttccccggcaacggcgccagaaatgcttgttggtatttcttgacgacattactagaaatataattcccagcaatggcgcataaatacttctattatattacggttacagagttcatccacaagcgcacggatatatcattgtagcatttcacccgagagtattccaagggtatcgtatttattttatcccgtgggaagatcatgtagagagaacttggctaataatttatatgttaagataacccaagggtagagtgacacacaagcagtagctactcattctcatattaaattatctaaactaagtggaaaaaaaaagagaaagataatctattcctatacttctagtatacatagtatacatacattctagttatccaatatagtagctaataccctctatccgatgccctctccaatgccctcctggtacttcgagaagccaccccttactgccgagttccttatgacagtccgtcatgaccatacaacctgggctaaatacggaggagtaccctccccagggaattaacttaggattatatacatgcgcggaggaatacccgtactgagctgtcaccatcaacggcccacctctgatccgcagcatataaccccaaataatgatatcccgtaatctagacaccacgtctaaactaccagatactactctaatatcatcgtcatgatatagagtaattgaataagcaaacaatatacccgcaccaaagcatctcccagataagctagcagcat

SEQ ID NO: 54059 - DNA, 1501 bp, Oryza sativa
gaattgacacgatgaattgggccaaaattcacaagtctacgaagaggatcaacagaggaggccgccagccaaaacatgggttggttgggccggcccctggttctgccgaaccaggaggttcggccaaacccccgctagcgcctttggatgcagggttgcggctggacagtgtggaatagcccccaatgacggttggagggtatttccgaccattccaaccgtcacaacagtcattcggaggctatataaacccctcaccttctcacttcactcacacacctcaagcaagagctatctcatattctctcaagtttagtctagtagtatcaagctagtggaataggaatagagtagaaatcaggagttcgaaagtcttcggaagagttcggttatggctctagtagctttcctttccttttttgtaagctttgtactttatttagaatactcttctatataaatttatggtattgaaatactttccgagtatatgaatgcctactttacattatgttcttgttatactaaatatgctgctagcttatctgggagatgctttggtgcgggtatattgtttgcttattcaattactctatatcatgacgatgatattagagtagtatctggtagtttagacgtggtgtctagattacgggatatcattatttggggttatatgctgcggatcagaggtgggccgttgatggtgacagctcagtacgggtattcctccgcgcatgtatataatcctaagttaattccctggggagggtactcctccgtatttagcccaggttgtatggtcatgacggactgtcataaggaactcggcagtaaggggtggcttctcgaagtaccaggagggcattggagagggcatcggatagagggtattagctactatattggataactagaatgtatgtatactatgtatactagaagtataggaatagattatctttctctttttttttccacttagtttagataatttaatatgagaatgagtagctactgcttgtgtgtcactctacccttgggttatcttaacatataaattattagccaagttctctctacatgatcttcccacgggataaaataaatacgatacccttggaatactctcgggtgaaatgctacaatgatatatccgtgcgcttgtggatgaactctgtaaccgtaatataatagaagtatttatgcgccattgctgggaattatatttctagtaatgtcgtcaagaaataccaacaagcatttctggcgccgttgccggggaagattcataataaagattacttgaactaatactttatatttacctatgtataatcattttcctttgtaggctaaccttggttgttttcacttctgttttgaaaacagggtagtgcatgaccggtttcaacttgccggaaaacttcaaagaaaatccagaagatttcttccggagtgtcaggccgcgagtcgttgttccgcagaaaactctaccaac

SEQ ID NO: 54060 - DNA, 364 bp, Oryza sativa
ttatcaaatcaagtaattgcaactactatcatgggcttcttcagaaaacagcgatctgatcaagctgcaggttcttgagcattaagaatccaacaaagaaaagaacatatctaagcaaaaaccagaccaagctgccaatctgacgatgaaaaacgaaatggctgccttactggtttctaaacaatatgagtaacaaaaaaccttcactaaaactacaactactccatctaacatggtagtacctaccaaattttttgttaaaaaaagttctcttcgttctactgcacatcgacccaacaaaaaaaactcaggttctagctgcgagacatttcaaactgaaaggactcgacgttgtatacctaga

SEQ ID NO: 54061 - DNA, 1501 bp, Oryza sativa
agccgcctgacaccaagtggtgatggtacttcttcttagcggcattttctttgtttctttccatcatcgcctgcccttgttgacctgtcttgtaagcaacgaactcgtcccagtgatcccatagcttcaggaatacgtcgaagttcggtgtctgccccttcaggatgtatttctggtacagatctcccttgaaggtctggaactgttctgccattttcttaagagtccactatttcactatgttctctgtacctgcagggagcgtgaacgtctcgagcattgtggtccacagcatctctttctctgattccgggacaaagctgtcatcacccctgcgtgcccttgttctgcgccagtacaccttgctgacaggcacgttatccctcacaacccaaccgctgtggcgtacaaaattcttggctgcttgtgccggggcactacgtcggccatctgcgtccacctcagttatgatgtgccgaccctctatcttcttcgcggcacctcgttttccgcatgccctcttctgtccagcggagggatgacttccactagcctcctcctcgttcccctccgcatccctctccacgttcccctcctcgttcccctctgcatccctctccgtgttcccctcctcgttcaagtactggtttggatcctcgttcccctcttcttcgttccagtactagctgcttcccgatgcgattgtatcgtacagtatctgttcctcatcacgatcagccatctgttcatagaagaaatatttgctaagcgtaatattaacactctactaatcttgtattaaaactcaaataatcatatatgctaagtctatttaagtttcgaatattacatctctaataatcttatattaaatttctaacaatcaaatatgtttcgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacggtagataatcatatatgctaagtctaattaagtttcgaatattacatctctaataatcttatattaaatctctaacaatcaaatatgtttcgaatattacatctctaataatcttatattaaatctctaacactcacatatgctaagtctaattaagtttcgtatattaaacctctaataatcttatattaaatctctaactatctctaacactcaaatatgctaagtctaataatctaataatttctaacactcacatatggtaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaatgtatttcatgttt

SEQ ID NO: 54062 - DNA, 1332 bp, Oryza sativa
gcccccaccgccgcaagacgccgccgccgcgaacgaacgcttaacaaacgtgactgaacgcgaacgaacgcgaacgaacgtgaacgaacgcgaacgaacgcttaacgaatgcgaacgaacgtgaacgaacgcgaacgaaacgttaaagaaacgtgaacgaacgcgaacgaaacgtgaatgaacgtgaacgaacgcgaatgaacgtgactgaaatgtgaacgaacgtgagtgttagtgaacgaacacgaatgaacgtgaacgaacgcgaacgaacgcttaacgaacgcgaacgaacgtgaacgaacgcgaacgaaacgttaaagaaacgtgaacgaacgcgaacgaaacgtgaacgaacgtgaacaaacgtgactgaaacgtgaacgaacgtgagtgttagtgaacgaacgcgaacgaacgcgaatgaaacgcgaacgaacgtgattgaaacgttaacgaacattaatgcacttgaactaaaagtgtgagaacgaacgcgagcgaaacgtgtacgaacgagataattaaactattgttgaacttagcatatatatatgattatatatacttgaaaacatgaaatacatttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattattagagttaccatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagaaatttaatataagattattagagatgtaatattcgaaacttaaatagacttagcatatatgattatttgagttttaatacaagattagtagagtgttaatattacgcttagcaaatatttcttctatgaacaga

SEQ ID NO: 54063 - DNA, 1501 bp, Oryza sativa
taatagttgttgtatatctattcttgcacccacaagatatcatttcttcctatataattagtacccactaaaagtttttttttttctgtagagctcaaattctctgaggccacaccatcaagatcatcttgacctttggatcatcatgcatctatgcaaatcaaccattagatcaagttcttctcgttcatatatcaggcctaaaacaactgagcaagtcatggccggcccagcccaactcacatcgcgcacactcagctaggctcttccccatcatctcatcgtcacctcatcttcttcgcgtttcccaagcacaaatttttttgcctgtattcctttgtcctggcacaataaaaagaaacaaccgtaatctatactttctatgtagttagtaccgacttacaattattaagagctaaagcacaacatgcaagtataccgcctcatcacctactagtaattagcatcttaaatttcatacaagcatgacacatcatcttctcccacataacatttttgcattctcatttgtacaatattccatccatcaattccgcagcaaagcgcttgatatcacctagtttctactatcggtcagctcagcaactgctgatggcatccaccaatgccttttgtcttcctcttaattaccccatgcacatatagatatccctttatcactaacccctaagagcatctccaatagatgactaaaattaaactcccaaaaatcctgtattggggacagccaaaaacatatttagcctaaaatacaccctcttctccaatagatgactaaaatttggttcccaaaaatttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggttatatatcagacgcagcgatatacgaaattgatcgaaggacacagtgctatagacgcacatagagctcttcctctgtcagcgccggcggcgttagcacttcactcaatcagagctcttcctctgtcagggccggcgacgttagcacttcacttaatcaggcaactgcagcaagcagcaacgattggtgacaggcacaagctcttgtgcagtgcgtgagtagcaaaattttgctagcaaccatgttttttactttgttctatttcctttttttatgtttctgatctgacaatgtcttgatggaaaaaaaaacttaatttgatatgatgaataaatatttggaaaaacggaaggccaatcacattttttttaatttgatctgacaacgtcgcaaggggaaaaacttaatttattgtgatgaataatggtttggtagttgatttgatcca

SEQ ID NO: 54064 - DNA, 183 bp, Oryza sativa
gcttcaaacggcatgcttgactacaagtcatctccgtggtcctcgcacctggaatgataacgttctcgacacccgaagtcgcaaatggtcgcacgagttcattttgagtagaagtcaggggctactgtcagggttacgggtctggcataccctctacccttcgatatacgttatgtatcgaca

SEQ ID NO: 54065 - DNA, 1501 bp, Oryza sativa
gaaattttaaagaagaaatccaaattaatttaggacgtactttcctgatccgacggccctggagaaaagcacagcaaggagacaggtaatcagtgtgtattggccctgggctgtcacaagcttagaggtagacggtccatgtcaatgtgagggtgatgcctcaccttgtaaccatgcctgttccattccaactcatccacatgaaagggaccccggtgatctatcattttctccactaattaaaccagtgcaaataattaattggacatggctttttggtaattgtattatattagtattatatttctgggggttgcttttttgtctttgttgaggattgcaatcaacataatatgaacagtagatagtagagtatagctactagttgagaggttcatcatcatgggttaaatttctagccggttcattcgattattttaggatatcattgaattatatcatgaaaaacaataatgatatcactcaataagtacacattgcaattggcatgaatcatctctcatgtcctatgtttctagattttcattctctcgaattcaatatcttctagcaacttaaaaaaatcataatcctttgtcgtccgtctttgttgctgccctttagatttgtcgttacatctagcaagttacactctttcatctttatcttatgtttctccaattgttcatgtaaccaaattaattatgtcctcttgtcggtaggcatctgatgccatgatcgatcttcatctaaacccctacattggtgaactatttttcttttcccacctcacacaaccacacctttttacccaagtctttaggccagtcgcttggcatcatctggtaaagtcacttggcatattatcagagaagaggaccaatgagttcatctcatttctatctcttctctttgtaacacagacgttcctatggcactttccaaatactccctccgtttcgaaatatttgacaccgttgactgttagcaaatgtttgaccgttcgtcttattaaaaaatttaagtaattgttaattcttttggtatggtttgattcattggtaaatatatttttatgtaagcatataattttacatatttcacaaaagtttttgaataagacgaacggtcaaacatatgctaaaaagtcaacggtgtcaaacatttcgaaacggagggagtacatctttacaatcctgtggagacaagctagaatgtctctattgcatatataaagcgtctccatatgattgtcttgtgtcttgttacagtgagaatcgtctacatatatatggttgtcttgttacaggaaaagagcgaactagtttctaaaattatatccaacgattgatatcagtaaagtaattgcccgccacttaaaggatacaaatttagctcctcatcgattgcccatattttctaataagataaaatggcttattagggaataaaattaatttatagatataatttttatgtatgtgttcttagtgacttaaaa

SEQ ID NO: 54066 - DNA, 1501 bp, Oryza sativa
atagtccaattttcctcaaggccgtcaatactttcttaaatttcatagttcccttaacctcaagaaaggaaatggcatcggagagctcatgttgattccaatttgatttctatctgaaacttagccccgttccgaacgaaaattttcacatgatttttgtaggaattttatcagtagttcattagtaggggaacagagaaaattcttgtgttctcttgatctgaatttcctacctgaaagttgaattttcacatcagtcgccagttcatcataattattggttacttagctagagatggatcgagtgcatcgagtagaatatggcaactcttagttaggtaattaggtcattgcattactccatgtataaagctagtgaaagctcagttccagaccaaattgacatcaatcaattgtcccgatgagtacagtgggcataaccaacaacgttgtttcagaaaattttagaggtcaaaagcaaaaaatcttgcatggtctactaaaaatgttggagctgaaaggggacaatgatgctgatagaattagggactgatgagaaaatgaccgaaatgaagggacaaataaagataccagagaaggattaagccatacacttcaggccgggtggtgcatggtgatttaataagataaatttcgtctaattacagtcttcttttgacaatagaattcatctcaacaatttgatttagctgaaaacaccaataacaagttaaaagatggtagcataaagtataggaaaaataatttgatacaccaaagatcaagcaagttgcacacgagtatgccttcaccattcgactaccaactctttcacgtagttaatctcaatactctggtgctcctaatgaacccgatattatgcttgcattatttatatgtaggtaccgaaatttcaccctaaaaattttaatacctcgagaaaccttactatctggagatgcaaagttttacagtagaaaaaaatatggtacaaccatgtatatatcttcttaatgatgataagattacctctatctttatataaaaagttttcacacaaaacgcaccgtttagcagtttgaaaatcgtgccacgagtatccaaaacaaatgtgttttgtgtgaaaactttctatatgaaagttgttctaagatatcagattaatcgattttcaagtttgtaataattaaaactcaattaatcacatgttattaccaccttattttacgtgaaacacctaatttttatctcatctttcaaacaccaccgtaatgctactacttcctccgtttcacaatgtaagtcattctagcatttttcatattcatattaatattaatggatctagataaatatataagtctagattcattaatattactatgaatgtggggaatgatagaattactttacattgtgaaacggagggaggacctactaaaagctgtagtcccgtggtagtactaccagatgggctttaaggttacgtggggttgaaaga

SEQ ID NO: 54067 - DNA, 1501 bp, Oryza sativa
gcgagaactcttacacgaccagatcttacatggtctttcgtctctgaaggatccgacaaggccttatcggctctgggcgtccccagccgaagttccctcaggttcctcggaggccttgtcaagacggcgtaaagggacagtacgataggtttcaatgctaggtgtcttttgtggtaagggatctctgggtaaaacacttggcgatcttgtgcacctaatatcaactttgttgaagcagggtaatgggagaatcgctacacccctggtcgaggaccgggtagtagccgtaacccgaccacttgaagtggaaatagtgggagaaacgctacatcgctggtcgaggaccaggcagtagtcgtaactcgaccacttgaagtggaaatagtgggagaaacgctacatcgttggtcgaggaccaggcagtagtcgtagctcgaccacttaaagtggaagtagtgggagaaacactatatcgttggtcgaggaccaggcagtagtcgtagctcgaccacttaaagtggaagtagtgggagaaacgctacatcgctggtcgaggaccaggcagtaatcgtaactcgaccacttaaagtgaggcgagagagatcactacgttttactggttcgagaaccaggagtaggagtctcttaatcacctataggggcgctaaagttggtttattacatgtgcatatcatgtggccagcatgactcacacacccaacttatagcatatccggatgtccgttcgcaatcatgtcgggtgatcaagccgacgacgttcgcgaggaattatccgttaacatccttttctcgagtagtccagcgatggccggcgctatgagataggtcgtcggtcttctttgataggttgggcgcgacgactctgcatttgtcgagatcgttctcgataatgcggtgtactcgaccacgacctactcgagtgctcaattgttcctgaaaaatattttctagaaggcaagatatatagcagataatgtcgagtatgtactcaaaaaaaactgcatggatcttctagtattatcaggatataacgagcagatgtaaatatcaggcattatgtaaaccgtaaacaagcatgatttatacggaagaaaacagagcgagcccccagcgttagatcgtagtcgatttaacatcggggacactcgcgctacagatattattgtataaagaacatgctctgggtaaacataataaatcatggatctgataatgatgtatgatatgaataggtacgataaattgcatatgaaatattgcgtacctttgtagatacatgccggatgtatctacgaaattagtagatcaatttgaaaaaccaatctaccaattaccttattgcgtactcgttggacatcatatgatctgacatcttttggtacgccgcgtatcttgaggcttggatgatctcgatagaccaagttgtcgatgacgatgatggttctgatctggttaggttggatctccccacagccgaagt

SEQ ID NO: 54068 - DNA, 1501 bp, Oryza sativa
  unsure (1)..(1501): unsure at all n locations
taggatactgaactttagatatcttacatgatcaggtaggcaacaacatttcaatgatcatataagtatataactgctacgtagggacataatcttatagagggtcctcccttcatgtttgtttatctattaccggtggaggctatttttagttgttaatcatgcatggtgctcacttagatccctataccaacaatcccgagcttctacgacctcttgagcagcatgaatggggagaactacccttttatcttctccaaatgcatcccattccgagataatgagatattgtggtagaaagaggggaaaggaaactgattgggtaattgtggtttcagagatccatgtactcattataagcttgcattgccttccactttgttagtaattaaatgcggctatgccatttaatatgcactactgctagttgtacttgtggctctctagtgagagggtagaaaatggaggtgtggtgttcatgagagacttgttcactactgagtgtccataagttcatgctaatgtgaatggtactccctccgtcccataatataaggaataatgggtgaatgtgacncnnnntnnnncnnanncatngcnctatnatgtgtcacatctacccattatcccttacattatgggatggatggagtagtgatgattgtgtaagatcaaagtgtgttttgttccttattctgtgatgaacaattggcatctgtgattattggttttgatatttggagattatcgtcgaagtggttttggagataatcaattttcaggtgatgatcggattctgttattttatgtgtccggtccgaccgggcggaggttgccggtcagaccggcgctatgtgtgcggtcagaccggccaggcccgcggtctgaccggctaacgctgagtcggtttcggtttcggattggttctttggatatccatgattgtttcatggttatggcttctagatggatactatacgtatgtaatactgttgtttgctaacaatgagtcaagttgaggatagcttggtctcggaatatggtttctttgtttgtttcatgtgtaggtgactcgatgcctcggcagagtatttgcggtgatggaccgggagtcggcttggtggtaaaacgatgtccgtggtggtcagatatcatgcgggatactaaggctagagttgatgcacgtggttggtgaagattccatatggcatacggtggaagtattgtgtgtgtatgggatgcggagtcgaatttggaaggagtccaaatttggtacgattggttatgttaagtttgtgtcttgtactagagggtttcctaaggtgtttaggactcttagtatgagtttggttcgtggttttaggctgcctacctcatgtataaatagagggggagcgtgaggcttcccagtatcgctttttggtatcactttggagagcaattgagttgctagtttagttagggtttcgagtttagtcgaaatttttgtaaggagtgatgt

SEQ ID NO: 54069 - DNA, 1501 bp, Oryza sativa
ctaggatggttgcggtgcccccatgaggccctgacccaccgagtttcttcctctggtcatagactctccacggccgagttcatcatctacgttttcccttcctcttcctgttaaggtcactaggtcagtaaaattatcccaataccacagctgtagacaagactgaaccattgggtcgattctatatggggacatttcaaattgaatgtgtaataattcttgatagtaaatgttttatgtgttaaacgtatgtgcattatagttgcatgtcgcatactcacaaaacatgaagagatatatggattgtagttgtatttatcatatcacaagagtaaatggaaaatgtgggttagatataatcttgatatatcttcagttagaatttcatttgcatatcttcagttaggggactattataggacctgaaaacaggtaagcaatttggcactacacttaattagttaagatttttccagctgctaatatatatcctgtgtatagatatgaattacgaattgctagctattcatttgcatgtttgcagatgaactgcacactatttgtcaattcatgtgtgtgcatggaaattgtatcttagttgaatagaacttctcttgtttattttgcactcaaggcgttcgacggaatgcccatggtataattactgactgtcttataggtatataattaacggtctcatcgtttcttggcattgtcagaaacgacatgctggcctctcaaattctagattagtttctgttctctcaataaaaatgtttcagctatgtttaggcatgagaagttttatttctgacttgtgcagtttttttctctctctgttcagcagaaaaggaaaggcatgcagacaatccattgtggcacaggctcacagctgatcctagatgatcaaaattgaagaatatttgcatgtggccagtaactctcttttgtatgcttatctgaggcttaggcctgtcagtatgtaacattatgtaatttgaaactatgtaatctcagtacataattgatctgtacttgtcgtgttgtttagtcttggagttggttgtgttattttgtgtctggatgtgattatgactttatgactgattgcttataaactacctgtcgtgaatgttcacaagtactggcgaggttctgccaaattttttaattaaaatttgacagcttttaaccgatcatattaggaccaacgttaactaacataagcgttgatcgatgatctttcttacctaagaaacaccgatatgaactgattatctccttctattcagtattaaattcctatgcagcatgggctgcttgcatgcatttattttatggtctgtttaaaacggtattgttccatacatctgattttatgggcaaactggcaaagttaaagcaccttcgatacatcaaactaggagagatgttagaagactatcaggtccgacaagcaaaaggttacacagtaagtgcctctgtaaactagttatcaagg

SEQ ID NO: 54070 - DNA, 1501 bp, Oryza sativa; identical to SEQ ID NO: 49828

SEQ ID NO: 54071 - DNA, 1501 bp, Oryza sativa
ggctcgtgattcttgtcggaaggacaagatttggccgcactaagatcttcctcaggcttggatgtcgtcgacattccttctccgcttcggcgggaggatcgttcgacagggggtcgtccggggttacggccacggcattctcacttctggtcattgatggaccagtcgagaccggcaccatggtgtaaatcgggaagacgatttcaccgacttgagtacacaccagcattgttgaagtcggaactccttggttgacgatggggtcgacgctattgttgacgagatttgacgacatagtagtagaatcttgagcaccaagtccccctacttggcgcgccattgtcgacgggggatacccgtagactggatatagagggtattggggtacgctagtatgaggatctacgtaatatgacattaagcaaatagaaaacaggaattatactggttctgaccccttggtaggtaatagccctaatccagttgatatgggattatatgatggaaatcacatattacaaagggaacagtggaactcgatgataccgacgagaccgtagtcgagtcgactagatcacccggcgacttggctcctgtaggctccggcttcgtaggctatggtggttgtctcggatgtgagattcgatgccttaggtcctcccggggggtcccttttatatcgcaggtcaggtagtttccaagtaggactcggagacatcggattctacatgatacagtgacgacccagtcctatccggttaggaatcttttcatctgtggactccgtgatgaatttccttagcgcatacaaaaaacatccgtatacgcacacatataccacaccgatgtatagcgtatatctaagggtagagggtataccttatccgtaaccctgacaatatataattttaagacttacatatgtaattttagaacttacattgtaaatatactaaaattacatatgtaatttagagacttacaatgtaaatacataccaactattttttgatgaaaaatatggcgctataaatatagctacacccataatatttaaaaaacacctttatagtggtaatggattaccagattatagtaatatagcttatagattgtaataatccatcataataaactatctatttgtttcaacttagttctaataattcagattataatatgactatgttgaattaaacagtggcttaaacgcgggacccacgtgcgacggcgagaagtcagaactcagaagtcgccggaagttctcctccccttctttcttagcgccgaagaagaagaagcagcagcagcgaatcgaacaaacaatacaaaacccacgcgacgcgactcaagacttgcacccaaatccattcccacccaccggattcgcatccgccgctgctggccccgtcgcctcgccctccgccaccgccgccgtgcttgctctcctctccctcctcctccagatcggcccgatcccctgcccaccccccctccccga

SEQ ID NO: 54072 - DNA, 1501 bp, Oryza sativa
acaattgttcgctactttcacaaactccgatgcaatggttactctaaaattaaatttattttaaaacaaataaaatgagctaaaaataaacttattatgagatagaggaagtatttcgtagttgaagaagaatgatgatgcacaaatttgcatgcttggacttattttctcaaaaactttatttattaccatctcctctacgataaaagcacgcttttaaaagttttcagtgatgttagagcattttattagcctttgtcttttttaacatgtgttaaaagacatatttgaagtaggatgtgccatatatctttcatataatagaagaaaataaaattagaaaccataaattagggccctcttcgacataggcacgtagctctagatccaaaattttttgaaactgatattcgtaacttcataaatcgttagatctggattcacgattatattaataacatttaaataaatcattattttcctattatttagatgaaatccaaaattttagaacaaatataatttaacacacaaacttcatactcctatcaatacgtgaaaccgggcttaagtagccactccataataattcgttcaaatccaggtattttagcgtgcaagtctagttagtttagatactgaaagttttatcattatcttaaaaaacttaactagggattatcccatccagtatcaggttcttttatttatttatatatatatatatatatatataaaataatactccatctgtcccccatatatatatatatatatatatatatatatatatatatatatatgggggacagatggagtattattttatataataaaaatagaaaaaaataatcaatattgagccgagatgcaaccccacgataaaacccacgcgagggagagaagccaccccatcctccccacctccctcctcgccggccggagttctcgtctccggcgaccgccgccgccgccgccctcaccgtccggtaagcacctcccctcctcgtcctcctcctcccgcgtccgctcgccggcgcacatgcattgctcctatcgcacgcatcgtctcggctcggctctgtcgcgatctcgagttccagacccatccccgggagagagaggagggggggggggggagcgccctaccgtcacgggatcgtggccctgctcgccgtgcggcctcctccatccatggcctgatcggcggctgattggtacaccgcatttgcggcctgggtgattggctagtatttttgttctttgtttgggggtgaaaagatgaggaggagaggttggggggaaagggacgggcaaaaaagggtgaagaaaataaatcatatccatccctttcgcactaccgtttgaattttttttggaatatatatgtgtgtggtttgttcggatttgggaggaaagtgaggaggtggatgctcctgatttccgtgaggaactttgctgctgttggttgcaggtggagctccggtgatcgacgccgcga

SEQ ID NO: 54073 - DNA, 1501 bp, Oryza sativa
ctgcaaaaattatgtttagattatcgaaaacaaaacaagatatgagaccttcaagcatgcctattccacgatttacatcctcctggttcttggaatgcacgagggcccaagacagcctcataatgctatcactcttctgctcttcatttgcagcctcagctacctccctttcacagccctaataaagcatacaaccatagaaactctgagcgcgaacgtgtaagcctaaacattatttggaatgtatctagtaacaaacagggtaatgatttttttgtaaagtgagactgatatgtgcattttcttagccaatagttgcagtgatgattgaatcagagatagttccagtgttactcttcagattgtgaaccgctaaaaaggaatcaaaatcacacagctcaataaagagaagccgccttgactcatccgcgttgcaacaaacaatcacgcgagctaatcacgggcagccgacggcagcaccaccatgatggaacaaacaagccactgtaaatgggggcaggctgccatgccgcctaaactaagcatgaaaaccactccacactcgaccattcgctccccagtacaaccctccaatcctcggagttgctaatcctcaagcaccgcgcgggatctcccgctagaactaaaacctccccccattgaataaattaaattagaaattagagtactagaaaaaagctccccacagcaggggattcgaataggagcggagagaatggattctcacggcgatgatgtcgcgggtgcaccaggggatggtgtcgccgccggagaagaagctccccaccgactcgacgagcttcccgatcttggcctccatcggggagggggggtgggcaggggatcgggccgatctggaggaggagggagaggagagcaagcacggcggcggtggcggagggcgaggcgacggggccagcagcggcggatgcgaatccggtgggtgggaatggatttgggtgcaagtcttgagtcgcgtcgcgtgggttttgtattgtttgttcgattcgctgctgctgcttcttcttcttcggcgctaagaaagaaggggaggagaacttccggcgacttctgagttctgacttctcgccgtcgcacgtgggtcccgcgtttaagccactgtttaattcaacatagtcatattataatctgaattattagaactaagttgaaacaaatagatagtttattatgatggattattacaatctataagctatattactataatctggtaatccattaccactataaaggtgttttttaaatattatgggtgtagctatatttatagcgccatatttttcatcaaaaaatagttggtatgtatttacattgtaagtctctaaattacatatgtaattttagtatatttacaatgtaagttctaaaattacatatgtaagtcttaaaattatatattgtcagggttacggataaggtataccctctacccttagatatacgctatacatcggtg

SEQ ID NO: 54074 - DNA, 1501 bp, Oryza sativa
catagactgaactcgaccaaagggccaagaacttgtcagaatgttagcactgaaacaaaagtaacttaagttttaaaaatgtgcttcataaaagaatgctttcactatactttatttatcttgttttctgattgatctacttaaatattttgttaaacaatgtgagaattacccacttgtacacattttcaattcctaaaatagatttttgggccaagttttattgttgtcacataggtactatcgatacctccatcttccaagaaaccatactattaatacctccattttccaagaaaccaatcaatttagttctttcttattgtaagtgtaattttcaatgcatagtcaagtcttgataagtttagggaatctaattttgcatgaacaaatatgtatcccttcatgttcaacatcacatgaagtggttaatctgctaacttaaaagtattgttgaagcagctatactcaaaattaggattagatgttgatctcaaaacaagaataaagaatacactagtttgttaattaaggtaaacttaagaactttgtctaatgtagatgaacagcttttcctattttttctgaaattgttaactaaggcagtgccacacagtgagagtgagtgctgtggcaggctgatgctagcctaccatgccaacatgcactagatgaggtgggcaaacatgaatcatatgggatggatggctctaggatgccaaagggccaaggagcgaccggatcctctggctgatgccgtgtgccatctaatttgtgcttgttaggtttggtgaacagtattgtgttcgacacgaagggagatggagctgtgatctgtcagttggatatacaattagtgcatcataccccttcacaatttgttccttcgtgtatcagttgatgatagatcatacagtactagtaggtgctgagatgtcttcgcttttgaatcttcatggttggatgggtcgggattttgtttttgttttgcaagagtgtagatataacaagtcaaataatgggcaataacctcttagcattgcccatatttcaattctcaattggttagataagtcagaataccaacctaaatgctgaatcctctacactctacagcactacagcaggactgagctagctcttttcttaatggaaaaatatgtcatcccatcattttctcaaagagtgttttaccatgaacttcttagtagtggtggtgtacaactgtagcattatacatttgcatatattttgtgttaaaccgctaacatttttactaatccaggggctcataacatgctcagtgaatgtcagcccagatactcagaaaatcataagtcaggattgctattgaggtaatgccttgatcttctctcttatagtttgtactgcattagtttttaatgcaggttatgagtaacatatcaggattgtcttatactgttgtatcttttgtccagtgacaatgcatttgggcctctgatgtaagatgggcgtgcaa

SEQ ID NO: 54075 - DNA, 1357 bp, Oryza sativa
atcagtctttagaattgatcaagattggcacccggccaacaactttcaaacggccacccgggccaacaactttcaaatggccacccgggcctagctgatcccatcagctgcagattttttaaacatcgaacccctttccacaacagcaatttcacaagtagtagtcaaacaaaactacactaggaatcacctcacatccgcccatgaccgtgggcacggctgttcgaacagtttgttaacctctgcagagggggtacactttacccacacgacattactaacccggatcacccagcccgtgtggatcagccacgtcgggagacctccaagctttcatgacaaggcattttcaaagccgacacaggtttaccatatgccgacgagaggggtcccagaccaacaacagattaggtcccagaccatactgtgccaggaaacccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaaattcatttagttcgcaagcaccgacccaggtgtcgggttttccaagtcttttgtaaaacccaagttttacccaagaagtttttcagattttaagtttgaaggcgatcgtcgatactcgtgcagagtgcacgattttcgaggcgcaactgggtggttacaagggaacatggtataacaattaacaaaggaaggatcaaatgcaacaaactaggtaggtccgacaatctgccttgcagacgggacaaacagattaagtgcgatcctatcaatgcataatatttttcaagcaacatgattaaattcaaatataggctcgaaatgttcaaaggtggcttgccttgctcgagatcttgagcttgatcctcgaaatcctcgcactgcgggtcttcgggctccgaaactacgcgcagaacgggacaactcaacaaacggcgaaaataaagccctattaatgacctctaagcatgccattagatagatcttaagatttgagggattttggaagttgaacggagtcaaacggatttacggttgggaagatattgaatttctaatattattggatttttggtctacaggaaaaggatttaattaaatcctttttgaaaaagaaaagaaaagaaaagaaaagagggagggaaattacacttccctcggacggctagggcgcggcccgagagaaaaggggcggctcggccgagctaaa

SEQ ID NO: 54076 - DNA, 1501 bp, Oryza sativa
gagaagtacaatggcaaaaccgctgacggtttggcgggacttctaaaaagtaaaaatgaatccaaacgataattatgttcgatttttaaaatctcaatgacaataaagagaagagacagtggacgggccatagaggagtataatggcaacgtttgacgggacgcctagaaattataaaaacgaaacccaacgtgacaataaactctaaaaactataaggtccaatttttaaaggttacaaggagaataaatagaaatagtggtagatcgagcaagcaaataatgaaagagatgacacaaggggtagcaactggtgcgacttttaaaaaattatataattagaaacacggggatgataagttttgttctttcaaagttttaagacattgagatagctatttaataaattttaagtaaaaccatacttaaaaaaatatatgattttgtttaggtgctagccgtgcaattgcgcgggccacccaactagttagctcgacaaaaataaagaatactgaaaaaagaagtctagagtacatataagaatacaatttagaaataacgaaatttaaaaatttaaaaattattaaataactatcacatatatatacactacaatatgaatattgatcagtttggtcaagttagtacaaaatttattgtcacttttaatatattttaataataaaatgtgaaaatatatattttagtatgtgaggaaaaaaagataatgatgtagacacgcaatctgcgcgggcccaccatgctagtttctataaaaaaaacatttcatcctgattgttacctaaagtgcccgtagcaacacatggccacgtgggagtttcacctagctagtcgtgtatatatgagtgtatacatctactgtgtgcttgctcgtacgaatcagcatcaaaatgattggagcagtactgcagtgctacgtttatcgtggtaaatcttgctgccagtcgaatggcttgagtttgagacctctaaagctcgtagactctaatttagtgattgcttcatgccacgaattatattggtgttgtgatttatatattgagaattcgatgttccatcactcttaagtttaggtttttctctttaaaaaaatgtaatttggttctcatggtgtgatctcagtagtttcttggtcttatttgtggtaaaaaaaatatttatgctaaaatatctaccatgtaacctacataacatttaagtcctgataatgatgatgagttcagcatcgagttagctctcaatgccaaatggtttttctgttttgaaaaatgaagaaaattgtggccaaactatactggctttccatggcatccatgtcaacgtcatatcatttgattgtatggaccatttagccaagtttgcacataataaacaagttggttcgaaatgagtaatttacagggcacatcattttgattggactatttagcctagtttgcacataataaacaagttgttttcgaaataagtaatttacaggg

SEQ ID NO: 54077 - DNA, 1501 bp, Oryza sativa
gagcacccgcaatggtaaagtaaggtgctatctataaaacatgtacacctcaacaatagactagattaatagtaaaccacttcaatggtatgtctacatgggtatctatagctctctaatccattgtctcgtttttctctatagactatctccatgttagtagatagctttgctctctctcttcatttaatctctttcaagtaggaaaatatgctgacatggatctcttgtagagagcttatagataaccattgtgggtgcccttataccatacttacttatagatatatactataccattaatgcatatcctatctcacataggttattggagcttgtgttgtagttgactacaaatctttaaccaacttttctctttccttcaagtaaacacaaatatagtgtggtaatatgtagaacatacttgcatcgtcatattgagttgatttggtttgtggcctaaataggccttaccaaattttgtctaattttggtaaggtaaagttgtatttggattgaagtcaaaatagcctaagtttactattgaaatggtctattttcttagacatgctaaaatttggcttcaaaccaaatagacagtaaatactattgaaattgtcaaatattggtaagtctaatttaggcctcaaaccaaaccagtccattatactcgctcgggtcaaaagaggctataggcagggtagagtgtcatttggaccttgaacattttaaagaacaaaacattcaagttaatattttactcctgatgagagagttgctgttacagagtgtgaaaaaccttaggattcctgaacatattttactccctgatgggtaaaaagaacagagtgattaattaatgtctgatgctgggcccatccaagaccaatcatggtggagctgcagtaactgttactccaatattgaccaaatgtttgtgtgtacgtactgtagtagtagaatgtatgaccagctagctagtcagattccaaagaaagatagtactagtagtaaaaataactgaaaacaggcgtactatagtagtaatacctagtactactgagtgaaagcagggggtgtactcttgtacgtgtttcacgtgctatatgtaagagcaggtacaataacaaattataaataaaaaagaaaataaagaagagagatgagcaattggctatagatttatagccagctacaatatggactcgaagacacaatttatatataacatgtaggatcagatattaatagtatattatatatttgtaggtaactattatataaattggctataaatgatttggagctattagttggctatactactattaaacttgcttggctatactattaaacttgctctaagcagaagtggtgaacaaaagccgggagtacaccctcagttcctaagtagagcaatttttggttgaaagagatacagagtactttcctaaggatgaatttggacatactccctatctaaattcataatattaggata

SEQ ID NO: 54078 - DNA, 1501 bp, Oryza sativa
tttgacatcacgcaactctgttaaattcagtgcaaaatatcaaggtcaaaggtagagtaaattgcatatatgttatatatgataggtgcaaatagttgtaacaacttacaaaaaatgttcatatatactattaatacaaactagggtttcatttacgtctaatccatatcgagtgacttagcaccagcatatatatcttataggcttccacgctacattaatatgaccatggtttgatatccccctcccccccccccccctccaagataaacccatgtgtatagagatgttattttgcatatcctatcaccgtcaacctcccaaggtcatccaacaccagatattttgtcaaagataaaaaataatgattactaaaaaaaagaccatctgaaacacatgacgagattaattaagtaacatgcctataaaggagtatattggtggtggttgatgggacatctaaaaactattaataaagacatctaaaaactattaataaaacacaaaatagaatcctaatgacgactaaaaagaattacaaacgggcaagtcgtgaagcaatcggttaggcggttagcaggacttctagaaagtaaaaaaaaataaacccaatgataatcatatttgatttttaaaatcttaataataataaaaatgagaggcagcaggtgggtcgtataggggtacaatggcaaagtcgccgatggttggtgggtcttctagaaagtaaaaaaaaaaatgaattccaatgatagttatgtttgactttacaaatcctaatgacaacaaaaagtatgcggcggacgggtcatagaggagtatagtggcagcgtttgacgggatttctaaaaattataaaagaaaataaaacccaacaagacaataaactccaatttttaaaggtttgggcttctaaaaagtaaaaaaaataaaccgcaatgataatcctgtttgattttaaaatctcaatgacaataaagaagggcgacagcaggtgagccgtagaggagtacagtgacaaagtcgctgacgttttggcggaacttctagaaagtaaaaaaaaataaacctaaatgacaattatgttcgatttttaaaatagcaatgacaaaaaagagaagatgcagtggacggtcatggatgagtataatgacagtgtttgacgggacttctagaaattataaaaaagatgtccaacaggataataaactctaaaacttatagtttttagatccaatttttaaagattccaaggagaatgaatagaaaacagtggtagatcgagcaagcaaataaataataatatgacagaagtaaggggtagcaactgttgtaactttagaaactaaagaaattagaaacatgaggataataaggtttagtatttaaaaatcttaagacaacgagataactatttaataaatttgaagtaaaatcatattaaaaatatataattttatatgggtgctagccgcgcaattgcgtgggccacccagctagt

SEQ ID NO: 54079 - DNA, 1501 bp, Oryza sativa
tatcttggttactatttactccctccgtcaaaaaaagacaaacccggatttccgtgtccaacgtttaaccgtccgtcttatttaaaaaaattatgaaaaaaattaaaaagacaagtcacgcataaaatattaatcatgttttattatctaacaacaatgaaaatacggattataaaaaaatttatataagacggacagttaaagttggacacgaaaacccagggtttgccctgatgccctggcacaacgagctgaacttggttttttttttgacggagagatagttaaaaagacggccaatttatttcactgggcctggtgaaccgaattggcgtgctcacactagcatgttggttagaaaaataattctgaaaattacatgcttggatttgaaattacgtggttgcatgtgtgtttagattaaaaaaaagtcatgacctggtttcaataactgattataataagtactccctccgttttttaatatatgacgccattgactttttcttacatgtttgaccattcgtcttattcaaaaaatttacgtaattataatttattttgttatggattgttttatcgttcatagtactttaagtgtaatttatatcttatacatttgcataaaatttttgaataacacaaatggtcaaacatgtgagaaaaagtcaacggcgtcatctattaaaaaacggaggtagtaatgtttattagaaataaaaagataatttactagatgtttcacgagtaaaatttttattcatgatgacgtggataaacctcatagatctaattttccacatctaactacacatttctatttaatatgtgtgatttgcaccgcatactttccccgacaatagatcatcctgtgcgcgcttagagcaggtacaataatagactatatatcaactataaacacatatcgaggagatggaagaagggagagatgagcagcgggctatagatttgtagttagctacaacacagacttcaagacgtaatgtgtgtataacagataagacccgatattaatagtgtagtatattgtatatatttgtagataactatggtatgaattagctattaaatcaactataattagttggctatattattaaacttgatcttaaataattaacgaaaatcatcgaggtaggcgagggcagtttggtcagaacacacacaaaaaaaaaagttaaagctcggaaacggcaaaagctatggcgaccgaccggtcacttcccactccccagttcccagtgaacagagcaggagcagcctccactcctcctctgccactccactccccaccaccactcgcatcaccatccatccatccatctccaacccaagccgaatcacaccaatcgccatcgccatcgccatcgccgtgcgtggtcgccggtgccggcggcggagggggagggggaccaagggaaaagagagaaggtgagctgagctgagctgaggtgaagtggtgctgaggcgagtgactggg

SEQ ID NO: 54080 - DNA, 1501 bp, Oryza sativa
tagctgaaagggcttgcagggctgcagcgcgtagggcaatggtctgctcatcctctcctacttcttgagatagctcacatagtcttgggactagcccttccaaattgaactgatatgtaccatccacctaaaatagacggaaataaaagcatgaaccagatacatcatgtctttcaaaagaattctgctggtgaggaatggtatcactgatcaccaggcaacggaaatacctgattaactgcaaagtcaaacaaggtttcacatcctatgatgcgcatatcatcctgcctcttttgatctaaaagagtgtgtacaatacttaataagctacttgcaaatagtggcctgcattgagcaaaccaaatgatagtattaacatctgatgaatagaaccagcatgttacaactcgttaaaggaaaagggcaaaacaaggggaaaaagaagactctcacatctgctctttacaagaaaccaacaatctacggtatattagcatcaccacttttgcaaagccatactgttcacttctcaattccttgtagatcctttgctccaaggaaaccgtgatctgctcatacatcaatttggaaaaaaaaatggagtcaactgagcttgaaattttcttgagaaaagattgaggtgaatttgtgtcaatcaatacatgactaacaacaacaagagcatgacaggaacaatctgactattgacagaaacatttttagctccacaagaaggtagagggcgtgaaccttgggcactcggagagggttcctcgagcaatactcgcacaacttcccgatccttctctcattcggttcttcatcctacatcatgataacatacgagcagcaacaacaagtaaattagctaagctgcggagcatcgattagtccgataatgcggcttccacacatgaacagaacaaacaaacaagacagagatgggggatgcagcaaggggcccaacctacctgcgttttggggaagatctcagcaaggatcgacttgtacctcttaacaggctgccttgatcttgccctcaacccggggcagaaatagcagaggctcccgcacgccggcaggaccttccgagatatcacgcccatcccctactactgtaagcagaattgatttagcagagcaaaaaacaaaaaaaaaagctaattagaataattgcaaacacaacaatggcgatcaaatcaagggattccacctccaatatgcactatctagctacgaattttctccaaagcaagatacattaataattgttgttggcaagttaaaaccgagcaggcgaaattcataaattttggggggaatgccatttctaacggaaatcaaatcaaaacgaaaacaaaaaaaattctagcggcgttcgatctcgcttagcggcggctggcttggtgctagaccttctcctaggttgcgtgtttgtttgtttttctttcatggttacagccttccatggctgcaatcttgtaaaaattatttttcatat

SEQ ID NO: 54081 - DNA, 1405 bp, Oryza sativa
aggcctcgatgtgatcgcacaacctatgagattggcccaatccgaaatacacaccgtaatgcaaatgaataagtcgacttatactccctcaaatatagttttaatctgattcgtatggatccctcaaccataatattaaatatcttgaccatctaactattaaaaataatgcaatttgactcccttaacagtttcaagagcgttttttactgacttagcttgttgactagtctaagtggttgagtcaattttatgcgggacccacatgttagtctccgttcctcttcctcctctctttttctatctgcggtggcaacatggagaggccgatgggaggaaggatgaatagggaattggtaccatatcttcggaaacgatgctcgatcgatcggtaattgatcatatttatcatttaaattaatcagtgtcgacattactactatgtagaaagaaattaaaaaataaaatttatgtataacaaaaaacggctttgctaaaattatgtcgacatatttctgggctaaatacagtcagtttgtcgatctgccatctaatcttctcactattcgtgcaagtacatctgataagctaatcgaacaacttgctcctaagttggcgactcctttttgctttgcatgacacgtgttggtcatcaacgaatgtaattactctatttacacagtaattacacatgtgtaatttagggacttacacatataattttagtatttacattgtaaatattctaaaattacatatgtaatttagatacttacatatgtaatttcgagacttacatcgtaaatatactaaaattacatatgtaatttaggaaattacaatgtaaatacatactgactattttttggtgaaaaatatggcgccataaatatagctactccaaaaaaaaataatggtcggaaacggtaccccttatacgaaaacgatgctcgctcgatttgaaatttccgtgacccattttcactcctaccggtgagctcttggatgaccaccacactccctccaccaacgagtcgataacgagttcgctgttaccaccgccctacaagagcatgatttttcctgtctcgttgccgccaccaccggcatgctcatcgtgcgtccccgagtcccaccgcctgcgccaactcgatgtcctccgcggcggcggcgtcgttgcacccgtcatcatcgtcatgcccggcgactcggccagacacgaggggcgccagtgcgccgcccgtcgcagccatagaattcgaagaagcagtctgaaaaccggcgtggagagatcattagttcagcatcgtggaatgctagaattcagttttgcagtgcagtaagaatgcaaatgtgctagtactactagagttttccacagggagggaggcattactgtgcaagc

SEQ ID NO: 54082 - DNA, 1501 bp, Oryza sativa
gatatttggtcattatttattgtatttgtaattatatacgtactcataaaaattattaagaacgcagtaaattcataaaattaagcagttttcatggcgaatctaataacattattttcacatataacattcggatattttgcctatcatgagatagttcgtatatctaaattaatccccaacgattttctagcagtgattcagatatcacaggctaatctcgtaatacataaagatgattatgttcaaaacatgatttaggttaaaaaaattccaagcgaatccgtaaactatattcatgtttcagatagccggcctttggttgattatgaaaaacgattatattattcacattttaaatagttttgtgctatagacatgtatatgaaagacaaaacgagttaaagaaaacttttttagaaaaaagaaactgtgtgaccacgatcttgatacaggaaaagtttgaattagtatgttcaattctgttcatgtacatttgctatatatattattgccttcatttgcaattatactgaatactcgctcgaggaataaatcggtacatgtacgcatgcctctcaataatttgaatgtgaatttgagagtacgtagttcatctcatcataatcatccacacccaaataaattactacattccgattactcataaataataggtaaaactaatttcaatttgacttgatttcatcaatggatcttcaaatcaaatcaaatttcaaacccatccatcagcagttaccaatcctgccatccccggcatcggtgaagaacctcttccagaaccaatggcggcgccacaccgtgtcgaccatctcgtcgatgggcacccccttcgtctccggcagcagccagaagacgaaggcggccatgataacgatccagatagcgaagaagaagaagatgaaggccttcatactgcacatcatggagaggaaggcctgcgcgatgaggaaggtgaagagcatgttggagctcacggcgaaggagaaccccgtcgtcctcgtcgccagggggaatgtctccgacgggattagccaccccaggggcccccacgaccacgcgaagctcgagacgtagacgcagatgagcaccacgatcgccaccgcccacttctcgcccggattgccgttcgccttcacgtgttcccacatgatcgcccccaccgctgtctgccatggatctttcatgttagtttgtagaactaaaggaacgcgaatgctaagaaatgacctaatatcagataattagaaggggtgaggcttcgaatacaggtcgtccccaccatcttgcggagctagccggaaaacctcttgccgttttttgggtttctcgaactgggagaggacttatgtaaaagtttatattaaaaattaatatatgtttcaaaatttaaatgtgtagtgtatttaaaaggaagttatagtaaaattatataataaaaagatatatttaagtgcatcatatatttaaaaagaaaagg

SEQ ID NO: 54083 - DNA, 306 bp, Oryza sativa
tattttaagtcattttttatcccaaaatgtaattttaacattaaaatttcaaaatctataaacatgtaacaatatttttagaccctaaacagttttaattcaaaaacttttcaactacaaagttgtaggtcgcgtcgagggctacaattttgatataaagtttgtcttctttaaagttcacatgaaaaagttatgaattatttttaaattttaaagtctttaaaccgtcctgtttagggaccggggtgacacaactgaacaagttggaggacctaaacgagtgatctgcaagtttagggatcggga

SEQ ID NO: 54084 - DNA, 376 bp, Oryza sativa
agtaagcaagtaattctttgatgcaaatagttaagaacaatgcttgattggagttccaaagaaaatgaatcaatgtgtgtgcaccgtccttgacaaatgcatgaatagagccttttttatgtaagagttaacaatcaattctttgatgaacggcaataatctgccaaaatgattaaaaaaaatcaaagaattcatgcgtccagcaagtattttaatttcaaagaactgcctattagtatcatcaaaggatgatgataggaaaaggaattgatggaaggtagggaaagaatttgatggagggcatcactccatgtgaggtcatcagttgacaaatatatgatcagcggaaatacagaatcgcgcaatcattcttttg

SEQ ID NO: 54085 - DNA, 1501 bp, Oryza sativa
gccgagggcttctccccgtcgccgtcgccgtacgccgccgatccgtacgacgccatcgccggagttgcggttgcgagacggtgacgagtcacaaagtggtgagatcaggaagagagagacgaggagggttgatgctcctgtcgtccaatgggagggcgccacgtgggtgacttagagtgggggagacgaagggaccaccggctacacatttgtcgacaaattttctcctaaaaatttgacaaatataattataatacaatcgttgtgtaattatactgtaacttgtatgtaattacactgtaatttgcatgtaactacagtgtaacttatatgtaagtttccgtaattttgaattgttagatctattacaagatttgttctggtgaagaagaaaaaaaatcatagcacacacatatgtaaaaggatttgttcccacgatctctattaattttaccgaaataacatgttacgaagagatttttaaaagttacatacaagttacattatagtcacagtgtaattacatgtaacttacaatgtaattacagtacgattctgttaaatttttggaggaaaatttgtcgacaaatatatagcaaaattgaagacgaaaccttagatgggccgggccgggcagacgttgacggcccatcaggcaaaaattctggctcgccgccggcgacatgcctcgtcgtcgttctgcgctccggcgatggatacggcgagagattaatgtactgttaattttttagaggaaatgtactgttaattataattatcctgctttagcaaggtatttaagctggtttgttggagcaagctactggctccaaagtggccttcagtacgtatctaacccatatatatctctcgagttaccgtgcactgctttctttttgttagtggtcagtaattttgagtggatgagtaattaattacagcaagttacttgctctaaagcagctttagccggtccaagtacacgtgtcctcagttcctcactgttgtcttctctgccatcctgtatatatacatggcagcatcagcatcactctaatcaaattatcgaactgcatttttcattataaactctaaaccttaaacctcaaaaataatggagctcatggctagagtgttcctgcttcttctcctgcctctctcctcctccgcggccaccgccgttgccgcccctccgcctcctcgatctcaagctcaaaccgccgatggtaatggtgtgttgtcgaatctctcttcttgcaataaataattaacagtctcaacttttcgcttatacttatacttacaagtgaaaatttaaatttttaatataaatttggaattgattttgatgtctttttatcatagtttatttttcagcctttgtttgtaaattgttaaatacatatatatatatatatatatatatatatatatatatatatatatatatatatatatatataaaagttttatttacaaattatttttcatttataaatat

SEQ ID NO: 54086 - DNA, 1501 bp, Oryza sativa
gcgccgagggcttctccccgtcgccgtcgccgtacgccgccgatccgtacgacgccatcgccggagttgcggttgcgagacggtgacgagtcacaaagtggtgagatcaggaagagagagacgaggagggttgatgctcctgtcgtccaatgggagggcgccacgtgggtgacttagagtgggggagacgaagggaccaccggctacacatttgtcgacaaattttctcctaaaaatttgacaaatataattataatacaatcgttgtgtaattatactgtaacttgtatgtaattacactgtaatttgcatgtaactacagtgtaacttatatgtaagtttccgtaattttgaattgttagatctattacaagatttgttctggtgaagaagaaaaaaaatcatagcacacacatatgtaaaaggatttgttcccacgatctctattaattttaccgaaataacatgttacgaagagatttttaaaagttacatacaagttacattatagtcacagtgtaattacatgtaacttacaatgtaattacagtacgattctgttaaatttttggaggaaaatttgtcgacaaatatatagcaaaattgaagacgaaaccttagatgggccgggccgggcagacgttgacggcccatcaggcaaaaattctggctcgccgccggcgacatgcctcgtcgtcgttctgcgctccggcgatggatacggcgagagattaatgtactgttaattttttagaggaaatgtactgttaattataattatcctgctttagcaaggtatttaagctggtttgttggagcaagctactggctccaaagtggccttcagtacgtatctaacccatatatatctctcgagttaccgtgcactgctttctttttgttagtggtcagtaattttgagtggatgagtaattaattacagcaagttacttgctctaaagcagctttagccggtccaagtacacgtgtcctcagttcctcactgttgtcttctctgccatcctgtatatatacatggcagcatcagcatcactctaatcaaattatcgaactgcatttttcattataaactctaaaccttaaacctcaaaaataatggagctcatggctagagtgttcctgcttcttctcctgcctctctcctcctccgcggccaccgccgttgccgcccctccgcctcctcgatctcaagctcaaaccgccgatggtaatggtgtgttgtcgaatctctcttcttgcaataaataattaacagtctcaacttttcgcttatacttatacttacaagtgaaaatttaaatttttaatataaatttggaattgattttgatgtctttttatcatagtttatttttcagcctttgtttgtaaattgttaaatacatatatatatatatatatatatatatatatatatatatatatatatatatatatatataaaagttttatttacaaattatttttcatttataaatat

SEQ ID NO: 54087 - DNA, 1356 bp, Oryza sativa
agcccgaaaggccgaaccatttaagcagctcggctgttccaaagcccattacaggttccagacccgaattttagtaacaaggaataagtctacggctctcatcggatggcctaatcagccaaagaaaaaaccaaaatttaaattttcaaacttaattttgagattgattttgagatattttcaacgtaatttcttttacaacattagcttttaagtcaccaagaacacatttataaaagtttcatctacaaatttatttttatttcctaagaagcaataggaaataagccaaacaatgaggacctagtagccaactggcaaggaataagacgacaaccgttgccgcgccttcacccgtccaccgccggcctccggtggtcgtccccctccgcaagccttcgccatggccaccactcggcctttatcataatcgttgcttagcttcctcgtaccgacagtaagggcctatgaagaggttttcactgacacatgggcactgaatttatcatttttttattttttgcaaatataataccacttcaacttaccacgtcaacaaaactacttcccaaaccatcgaaatagtcgatttgcacagaattttaataatagaaaatgtgttataccaggtttaacggttgcgattcaaccgagaacaaaacatgagagaggtcaaatagacttattccaattggcaagcggtgattcggcccagtaacaagggccatcttctcttgcacggtaggagtttgctccgtattctatttctgcaagcgcagactagggctctgtttggaatattagctcagggctaattttgagagctaatgtttagtcatgaattggtaggctaaacattagcctagggtggtatgtttggatccatgggctaattcaagactaaagggtgaagagagtagaaagagaggagagagaaggagagagagagctgctttttatggttctcacataaaattagccccattaacatctcttggaggggctaatgttttgaggggagctaattcacattagctcaaaattagcccatattttagattcttaagagttaatttgagactaagaggtgagagctaaatattagcccatgaaaccaaacaaagtgtttaggtggagagcacgaggccacccactccaaacaaaaaaacgttatcctgccgtcccacgcaggccaagtcaaaccgttgaatcgccagccttggaaaagttgaaatactccgccacgtcccacgtacgcgtggtgaccgacgcgacgctgcgttgctcgccgagacgccgaccacccgccgaagttgcaccaccaccaccgtcgccggcacgcgcagatgggagagc

SEQ ID NO: 54088 - DNA, 1501 bp, Oryza sativa; identical to SEQ ID NO: 54076

SEQ ID NO: 54089 - DNA, 1501 bp, Oryza sativa
gcatatatatataaacgttcatgcacaatgtacatgtacatacgaatttattagttctttttctcaatgttcagataagttttgttgagtgataaataatcactgtacactatattgttatttttttaaggaaatctttcatcattgtttgtactgcatcgaagagaaaaatgggtgtgtaaatgcacattctctcgcgagagattaaaatccatcttctattttgccttttttttctctataatttctagtggatatcgattgagaacagctagaaattacttataagcatatttttcatggattctatttaagatacaaaactactacacatgggtacatgctaaccaaggtttacaaatgcaaaagcgaatagaaatttgctgtgccgagctgtttttcaaaaagattatattcttttctcccaaagatgaagatgaagattaatttttttcgtaaaacgaggtgatattagcatatgattgattgagttttaattataacaaacttgaaaatagattaatataatattttagaacaactttcatatagaaagtttccacacgaaacgtacagtttagcagtttgaaaagcttgctacaaaaatcttaatcttcatccaacaagaagaacggaacctaaacgatagatctgaatccatgacttgaacatgcatgaacagtacggtgagttaaagagatacatttcgatccatgatttaaacatacatacataactgggtgcagatatttggtcattatttattgtatttgtaattatatacgtactcataaaaattattaagaacgcagtaaattcataaaattaagcagttttcatggcgaatctaataacattattttcacatataacattcggatattttgcctatcatgagatagttcgtatatctaaattaatccccaacgattttctagcagtgattcagatatcacaggctaatctcgtaatacataaagatgattatgttcaaaacatgatttaggttaaaaaaattccaagcgaatccgtaaactatattcatgtttcagatagccggcctttggttgattatgaaaaacgattatattattcacattttaaatagttttgtgctatagacatgtatatgaaagacaaaacgagttaaagaaaacttttttagaaaaaagaaactgtgtgaccacgatcttgatacaggaaaagtttgaattagtatgttcaattctgttcatgtacatttgctatatatattattgccttcatttgcaattatactgaatactcgctcgaggaataaatcggtacatgtacgcatgcctctcaataatttgaatgtgaatttgagagtacgtagttcatctcatcataatcatccacacccaaataaattactacattccgattactcataaataataggtaaaactaatttcaatttgacttgatttcatcaatggatcttcaaatcaaatcaaatttcaaacccatccatcagcag

SEQ ID NO: 54090 - DNA, 1501 bp, Oryza sativa
acattctcaaacatcacagccatgagatttacagccgcatcgtttggcttattcggcatatttataaatgaaaaataatttgtaaataaaacttttatatatatatatatatatatatatatatatatatatatatatatatatatatatatatgtatttaacaatttacaaacaaaggctgaaaaataaactatgataaaaagacatcaaaatcaattccaaatttatattaaaaatttaaattttcacttgtaagtataagtataagcgaaaagttgagactgttaattatttattgcaagaagagagattcgacaacacaccattaccatcggcggtttgagcttgagatcgaggaggcggaggggcggcaacggcggtggccgcggaggaggagagaggcaggagaagaagcaggaacactctagccatgagctccattatttttgaggtttaaggtttagagtttataatgaaaaatgcagttcgataatttgattagagtgatgctgatgctgccatgtatatatacaggatggcagagaagacaacagtgaggaactgaggacacgtgtacttggaccggctaaagctgctttagagcaagtaacttgctgtaattaattactcatccactcaaaattactgaccactaacaaaaagaaagcagtgcacggtaactcgagagatatatatgggttagatacgtactgaaggccactttggagccagtagcttgctccaacaaaccagcttaaataccttgctaaagcaggataattataattaacagtacatttcctctaaaaaattaacagtacattaatctctcgccgtatccatcgccggagcgcagaacgacgacgaggcatgtcgccggcggcgagccagaatttttgcctgatgggccgtcaacgtctgcccggcccggcccatctaaggtttcgtcttcaattttgctatatatttgtcgacaaattttcctccaaaaatttaacagaatcgtactgtaattacattgtaagttacatgtaattacactgtgactataatgtaacttgtatgtaacttttaaaaatctcttcgtaacatgttatttcggtaaaattaatagagatcgtgggaacaaatccttttacatatgtgtgtgctatgattttttttcttcttcaccagaacaaatcttgtaatagatctaacaattcaaaattacggaaacttacatataagttacactgtagttacatgcaaattacagtgtaattacatacaagttacagtataattacacaacgattgtattataattatatttgtcaaatttttaggagaaaatttgtcgacaaatgtgtagccggtggtcccttcgtctcccccactctaagtcacccacgtggcgccctcccattggacgacaggagcatcaaccctcctcgtctctctcttcctgatctcaccactttgtgactcgtcaccgtctcgcaaccgcaactccggcga

SEQ ID NO: 54091 - DNA, 1501 bp, Oryza sativa; identical to SEQ ID NO: 54074

SEQ ID NO: 54092 - DNA, 1251 bp, Oryza sativa
ggagatgggccgggggagatcggcccatcgacccccgggggaggcaaaatagacttttgcggaggaatttgatttggaaggatttggattcggatttgaactcgacgatagatcggggattgagatcttgagatggcatggacactagacaacaagcaaagaaacaaatttcgcaattagggtttttaagagataattttcccgctatgcgccacgacggaacgggcgctacagatcacttctccagtagtgaaatatgacaaaactcaagggcgtgatggaaatgataggaaattcaaacgcataaaaatttgagcgaaaactgatgagaactaaaggaattttctcaatgacgaactttgaagatgatgaaggcgctattgccgtcaagattgaaccaaactaatcgtatggtctttttccaacaaaaaaatattatatatcttggtacacgtacgcgggcgcgcagcttcaacaagaatctatcatgaacgggtaaacagctgaaaccatatcatcttcctacattatatatcttcctatatatttatttatttttatccagagaccatacaaccatagtgtacggcacgctactatagtacacgctcctacagctgactggggcaacattgtctcgcctgtccagtggaccaaccgggtcacggtctcacgtgccaaagatgaaagaccagctagctagactgcgtccaagatgtactccgacatactcctatagtagtatgatatgtccaacatcgatcatatctctctttgccggtacgcgatcgatcgaacccgtgcatgcacgggtaacctgtgactgtctcgtgtctgggctggtgcgaccaactggttcaaaactccatcgcaccactgactcgtccaaaatgcaatcacctgcacgaacgaacgcacgcgcgatgcttccgatgatcgaagcagccagcaaaggcgagaccgcgagaccttctcatgttggaaacgatggcgtcctcgcgtataaattcatcgcccgtgcactgcagcgaactcacatcgagatcaacgatagagccaagcacaaacacgagctagacgacgctatcagcgaagcagaaacacacacacacacacacaaaatctcccggtgttttgtttagcacagtctagtgtttcccatggcgcccgtgcagacaccggagcagagcaacgggtcactgacgttgaacccggtggtgcagcgcgtgctgagccgcggcaagtcgctgc

SEQ ID NO: 54093 - DNA, 1501 bp, Oryza sativa
aattgttcgctactttcacaaactccgatgcaatggttactctaaaattaaatttattttaaaacaaataaaatgagctaaaaataaacttattatgagatagaggaagtatttcgtagttgaagaagaatgatgatgcacaaatttgcatgcttggacttattttctcaaaaactttatttattaccatctcctctacgataaaagcacgcttttaaaagttttcagtgatgttagagcattttattagcctttgtcttttttaacatgtgttaaaagacatatttgaagtaggatgtgccatatatctttcatataatagaagaaaataaaattagaaaccataaattagggccctcttcgacataggcacgtagctctagatccaaaattttttgaaactgatattcgtaacttcataaatcgttagatctggattcacgattatattaataacatttaaataaatcattattttcctattatttagatgaaatccaaaattttagaacaaatataatttaacacacaaacttcatactcctatcaatacgtgaaaccgggcttaagtagccactccataataattcgttcaaatccaggtattttagcgtgcaagtctagttagtttagatactgaaagttttatcattatcttaaaaaacttaactagggattatcccatccagtatcaggttcttttatttatttatatatatatatatatatatataaaataatactccatctgtcccccatatatatatatatatatatatatatatatatatatatatatatatgggggacagatggagtattattttatataataaaaatagaaaaaaataatcaatattgagccgagatgcaaccccacgataaaacccacgcgagggagagaagccaccccatcctccccacctccctcctcgccggccggagttctcgtctccggcgaccgccgccgccgccgccctcaccgtccggtaagcacctcccctcctcgtcctcctcctcccgcgtccgctcgccggcgcacatgcattgctcctatcgcacgcatcgtctcggctcggctctgtcgcgatctcgagttccagacccatccccgggagagagaggagggggggggggggagcgccctaccgtcacgggatcgtggccctgctcgccgtgcggcctcctccatccatggcctgatcggcggctgattggtacaccgcatttgcggcctgggtgattggctagtatttttgttctttgtttgggggtgaaaagatgaggaggagaggttggggggaaagggacgggcaaaaaagggtgaagaaaataaatcatatccatccctttcgcactaccgtttgaattttttttggaatatatatgtgtgtggtttgttcggatttgggaggaaagtgaggaggtggatgctcctgatttccgtgaggaactttgctgctgttggttgcaggtggagctccggtgatcgacgccgcga

SEQ ID NO: 54094 - DNA, 1501 bp, Oryza sativa
tttggttcaaagagctcaagcataatttctgttatgatacaattataccaaatgagtcaacaatacctcttaatcactatgccttttacttcatagttttaattaacgatgaaaattgctatggaaattcctgacagaccgagcgttctttccttgtaagttgtaccgtttccattttttgcaatacatgagatttgatttctctaatttcttttagcattgttttgatatcaacaagttaaattgataaatactaaaaatcatcgatcggccaagcgtcctttccaaagagatgttacgattccaaccgttcccatccttatatagttacaattaaccctggtcactgttaatacaaactttggtagtatttgatggattacgtcaagagtaccttagtttctattttcagatctacaagactagaaaggagaacttgtggtgattctaccaagaggctggtacgtagttccctttccaaatcacacatcacaattttattgataattaaacattgtctctgctccttggcgaactaagacggcatcttctttttttattttttttagaatggttatttttatccgatctactcagattatcactgtaaccacgagaatgcacgccctctcataactaagacggtatacaccttcatttcgtttgaactagaaacgaggctagttatcttttagtggctcgtcgaggaagtcatctagagcccatgaaaatactattacagcgggctaacctatggagtcatcaaataatgctgttcatgcgacatggccacaattctgccgtgtcctcggctgctcggccatgggtctacccttggagccaagctgctatgctcttgttctactgcagtactgcctctcttggaaaaactcttgctttctgaatgcttcccattcttatagaattcagcagcactttgttttgcaattttgtgtatcgtaaacacaacaattttcgcgcatataacttttgcttagtaaagtggtgttggattgaggatcaggatagaacatgagatgcagcgggagtttttatgggtatgtgtcgctattttattctgtgtgtgctggtgctacctaaaagtatattattattattattattattattattattattattattattattatattgttatttcttttggttttgtcattagggaaaattccagatttcttaattagtgtcttacttgggtttgcttgacaagaagggtgacatatcatatatcggcaaccctccacaatgaaaagcagaaatgtgcatgcaacaccacgtggatgttggccacgttggttctaaatcctaagcatatcttggcattggtctttttttagacttacaagtcagtttatgagttaaaatatctaagcctaaataaataataattttttgtttgtctttcctaaaaccataagccacttttatactattaagctaaaagctagctaggttgaagaagtttttttttacttac

SEQ ID NO: 54095 - DNA, 1501 bp, Oryza sativa
taggatactgaactttagatatcttacatgatcaggtaggcaacaacatttcaatgatcatataagtatataactgctacgtagggacataatcttatagagggtcctcccttcatgtttgtttatctattaccggtggaggctatttttagttgttaatcatgcatggtgctcacttagatccctataccaacaatcccgagcttctacgacctcttgagcagcatgaatggggagaactacccttttatcttctccaaatgcatcccattccgagataatgagatattgtggtagaaagaggggaaaggaaactgattgggtaattgtggtttcagagatccatgtactcattataagcttgcattgccttccactttgttagtaattaaatgcggctatgccatttaatatgcactactgctagttgtacttgtggctctctagtgagagggtagaaaatggaggtgtggtgttcatgagagacttgttcactactgagtgtccataagttcatgctaatgtgaatggtactccctccgtcccataatataaggaataatgggtgaatgtgacacatcatagtccagattcactccagtatgatgtgtcacatctacccattatcccttacattatgggatggatggagtagtgatgattgtgtaagatcaaagtgtgttttgttccttattctgtgatgaacaattggcatctgtgattattggttttgatatttggagattatcgtcgaagtggttttggagataatcaattttcaggtgatgatcggattctgttattttatgtgtccggtccgaccgggcggaggttgccggtcagaccggcgctatgtgtgcggtcagaccggccaggcccgcggtctgaccggctaacgctgagtcggtttcggtttcggattggttctttggatatccatgattgtttcatggttatggcttctagatggatactatacgtatgtaatactgttgtttgctaacaatgagtcaagttgaggatagcttggtctcggaatatggtttctttgtttgtttcatgtgtaggtgactcgatgcctcggcagagtatttgcggtgatggaccgggagtcggcttggtggtaaaacgatgtccgtggtggtcagatatcatgcgggatactaaggctagagttgatgcacgtggttggtgaagattccatatggcatacggtggaagtattgtgtgtgtatgggatgcggagtcgaatttggaaggagtccaaatttggtacgattggttatgttaagtttgtgtcttgtactagagggtttcctaaggtgtttaggactcttagtatgagtttggttcgtggttttaggctgcctacctcatgtataaatagagggggagcgtgaggcttcccagtatcgctttttggtatcactttggagagcaattgagttgctagtttagttagggtttcgagtttagtcgaaatttttgtaaggagtgatgt

SEQ ID NO: 54096 - DNA, 1501 bp, Oryza sativa
aacgacaatgttgacattcagacccacgtcttacaaacatcataaaagtcttacataaatgcagcggaaaagcgaaagacaacaggagctaagccttgactagaactgcagcgggaacaccactccacaggcatcctcgacggtacggacgaagcctactcctcggagaaacctccatctgacacatactcgtactctggggttgggaaaaaaaatagagcaagactgagtactacccactgtactcagcaagtcataccggaataggggtatgatgcagggaattatcaaaggagagctagagtggttcatttgcataaagcgagcatttataaacagaagttgaaagatttaaacagttgtaataattaattaatattaactatccactatccaacgctatcccacgttgcaacaggcccaaccatccacctaaactatccaaattcaaaagattacactaggatgagactaatcacggtgaatctggttgaccgcccataaccgcgggcttggctattcgaatagttttactctgatcagaggtgtacaactgtacccacaagacacagccccacgacatgtttccgtgcgccgacatgccaccacgacataccggaaagagaccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgactagcaaaaccatgcacccacagcccaccatgtgatttattttaattaactaacacccaagcggtggcactaatccaacaataccattagaaccaacagtctaaacattaataggattttccccattgtgcactagttgaactaagcatggctaagcaatccctagtccaatctctagtcatgttataaccccaagctgacaaagggacatggtacaacaatagcatggctatgacaataggtaaacatcccataataacattataaaacgatgcagtatttgaagaaaaacaatagagcatttgcaatataggatcaacatgttcaagtggcaagcatgacttgccttgctctgctgctggaggaaactcggcgactatttcgaagtacaccggagcgtcggaagaaccggaatctagcgacatacaaggcaaacattgcaaacaggctataagactactgaaacagagaacaaaaccatttttaatggattttacacgtttttcttgatttactgagacttgaatgggcttaaacggagcacggataaattagttatgaattttagaagattcactgtgttt

SEQ ID NO: 54097 - DNA, 1501 bp, Oryza sativa
tttctccaattaatgaggggaatttttagcccccacagcgaacgtaaaaatcaaatatgattatcgctgggttttttttttttactttctagaagtcctgctaaacgccttgaccgattgcttcacgacttgcccgtttgtaattctttttagtcgtcattaggattctattttgtgttttattaatagtttttagatgtctttattaatagtttttagatgtcccatcaaccaccaccaatatactcctttataggcatgttacttaattaatctcgtcatgtgtttcagatggtcttttttttagtaatcattattttttatctttgacaaaatatctggtgttggatgaccttgggaggttgacggtgataggatatgcaaaataacatctctatacacatgggtttatcttggaggggggggggggggggagggggatatcaaaccatggtcatattaatgtagcgtggaagcctataagatatatatgctggtgctaagtcactcgatatggattagacgtaaatgaaaccctagtttgtattaatagtatatatgaacattttttgtaagttgttacaactatttgcacctatcatatataacatatatgcaatttactctacctttgaccttgatattttgcactgaatttaacagagttgcgtgatgtcaaattgttcactaatttacgcgcatccaacataataaaaaacaaaaaataataataataaacgaattaactgcccaccagatgtttttgaacacatcacgagatagtcacccttccaaaatacacacggcagcagacgaacaagaccccaacaacacgccacgaaacgcaagcaatagatttgtccgatggttaggtccaaccgccgcgacacacacaacgttcagttaggttccagtagctcacaggtcgcaacgcccctcacccaaacaacgattttgcccttactcttagcttaactcttacacccaatactgatgactagctacttgctccaatcttattagcagctaatggttttttctccggcccccaatttcatcatcaccaattcaccaagtaattaatcttcacactaaaccgagtcttctttttctctctctctctctcacaatctcagtagtaagagccagcctctgttctagaaaccgtgcgtgcatcacagacaaagctgtgcatggtgtgtcgtgacgagcatgcgtgagtgcgttacacgctcaagaaaagtgtgttagcttagcttagctagccaaccatgcatatattcgtcacgttcgtttcgagttgatcgatcttgtgtttaattccaagctcctcttgagcggccgtaattcttgatcgtcgttcccatttgctatagctagctagccatggaggacctgtcgctgtcgtcggagctcgacccggcgctcctctcgacgtcgacgtcgtcgtcgtcgccgccggactccgcctcgccgtccttctccttctaccacccttcgc

SEQ ID NO: 54098 - DNA, 1501 bp, Oryza sativa
gttcctagcagtcttgtttgttgaaatccaaagatgtgtagctcccctattttctgttcacgtgtccttaacatttttaaaaaaggcaaaatttgctataggacatttaaaatttgtggcttttactatgagacacctaaagaacatatatcttctcataaacactgcaaaaatatggtggttaacggctggaaacccgtttcattattttattatttccggtgaaaacagatcaagaaacttcaatgaaagacaagtttgcccttgcagccgccgtgggtggaggtggaacggcagtggccatgtggatgacggttgctgtggggggaagtcggagatggcacggtggtgcgagaggcactggagctcggcgtgtcggtcggcggccatgcgcatgacaagctcgaggtgcgcttagtggcagcggatctagaggcgggcgtggtcagggggcaggtcatcattgtggtcgaggtcccgtgcggccatgtggacctagtcgtgcaagatctaggcgtggtcgttgggccagcagcgggcaacgtagcagacgatagaggcagagatggggtcgaggagcccttgcggctggatccatcccagtcctagtcgctgtcgctttggcggcgggctaggcggggtcgtcgggccaacagagtggcagccgcgggaggtcgcccattgccggccgaggagatgaggcacgggctcaggttcatggttggatccatcccagtcctagtcgctgtcgctttggcggtgggctgggcaaggacgatgacgacggcaacgatgggattgggttggaagaatttgataaaagaagagccaatgccctccgatgacgacaagaaggaggattgtgatcaatggagttcctcagcttgccactcactagaagggtggattgtgaatttgtgatgtatggatagtgccagattcttacttttgttgttgtttctctctctgttttcaccagatataataaaataatgcggcgggtgtccaacaactaattactatatttttatagtatccacgagaagatacacgttttttgagtgtctcacagcaaagatcacaaactttgagtgttatgtagcaaattttgccttacagaaatgaggtgaagatcaaagaattggtcgcttaaattgtttgataataaaagtgtgaaacacatatattgtactattccatctattatacattactataagatacctttgaaagaaggcaccataatcattgtgaagtctagaaattcacacattaataaaaaaagaagaaaaaaacttaaccattagatcatagtggactcatattataatggtatagaaaaaagaaggcaccatgacatggttgttttcagagagacggtgaacaatgctgaccatttccctcacccaccaccatgtaagtgtagtttaaggatctatcatgcataacatttaggcttagcattctaaattactcgatatgactttacttattttgtagg

SEQ ID NO: 54099 - DNA, 1501 bp, Oryza sativa
gactttttagcacatgtttgaccgttcgtcttattaaaaaaatttgtaaaatatgtaaaactatatgtgtacatgaaagtatatttaacaataaatcaaatgatatgaaaagaataaataattacttaaattttttgaataagacgaatggtcaaacacgtactaaaaagtcaacggtgtcaaatattttgaaacgaagggagtatattatctactattcctatgtaagtagcccctgtgattacatgggccatatcctaaaaatatcacaactgttgaatcgtagtgcgtattagatatctgccatcacatacaattggaaggccactaatgttaggctcattcttcacattaaccattgccgcaataaaaacacgatgaatggtgttaattggtatgtatattatcaagtaatgaccagccttaaacgaaaattcttttatgcttatacttattagctaaaatttaaattttcaaccttaaatttggagctaattttcgggttttttcatcgaagtttatttttcagcctttgcttttagattgctaataacacgtatataaaatttttgttcacaaattatttttaatttgtaaatatgtcatttggcttattccccgaataagccaaacgatagggccggacacctttttaatgcttaaagaaactgtctaataaacattcaccctaggacaattggtccccttactcttccaatgttctgtaacaacaaaaataacttcatcacaaaatccacattcgtagctcccacttacacattgtagttttatccatggttttgctttcgacccaaaatctctccatgcactgctcatatcgacgtcccagtggtggtaggtggatttcaacaccatcttcagtttcaacaacaatgccacctcttattgtgatggtggtgatgtatttgtttggccaaaagtaagataggtgtttttctttgttttctattaatcacgttttggttattcagagttatttcatagtattcactgtggagattatggataccccatacctacacagcatgtatagtccaactgggtatggggtgtcatgtatagatagaatatctttaaaaggactcgggttcaattctaaacttgtatgtcaaggaaatatccgagatcctagtcggttacgattgtattttatctgtaactacctattccgttaggaatatgggctgtgctttgtaatacgggccccttcccctatattaggagaggtccgggtgcctttaggggcacgattttcacccagatcatacaatcaataatatactcggcggatcaatctctggacaggagtagggtattacttcttgattaagaaggcctgaacctgtataaaattcattgtcttttaactcatccacttttccagcttgatagccacccccttttagtattgccaaaatcttgtttcgacagttggcgcgctaggtaggggtagcgtcaagttcttcgccgactagtgtga

SEQ ID NO: 54100 - DNA, 1501 bp, Oryza sativa
tcatataaagttgagatatttaaagaagtttaattttgaaaaaagttaaagcgttggagcgagtagaaaatttttggacaaattatactctaaaagtgtgccacaaaacgatctacaaataatcgtggcctggtaatctacagatacttaaataatcttgagtgaggatgataattgtgggccctactaactgccatccaaagtagaggcaaatgactggctcgtttcaaaatatcaaggacaaaatcgtaaaccctactttaaaatcacaattagaactaaaagtgagggcaaaaatgtgattgtccccccccccccaaacaaaaaaaaataatgtgtgagctagagggtttacatgccaatatccctccctaattctgttggaaaaaaaaagtaatgtgtggagctagagggctacatgtcaataaccttaactgccaacattttatctttacttttttttcctttaagaaaaatgacagtaggtaacaaatatattcagaattcaggaaatgatatatgcagaaaataatgctaataataaattaatgataattttctttaatacaaatccgttgcatcacacgagtcatatgctagtctaatccttaaaaatcctagaaacattatctaagtcaacaaatcaacaaataactaatattcttacatcagctactataattcttcgatgttgaatagatgaataattacgaattaattaaattgtaaagttgaaaaatcgattttttctaagaaattcacatatagaaagtttatataaaatcacaatgttcaatagctcggaaatcgtgcaaatctgctcactaaaaaaaatgctgactctataccgaatacacatccctatacgtataagtctataggtaagaatttttatatatagagaaaataacccgcataagtttatagagcatatggtaattgtgcatcatatgatattaggataaaatgaagaaaatataaaggtgagagtagagttttggataagcaaaaaatccatccatccatcctttaaagccgttggcggcgttggccggcccaacgacatcgacggccaaatcccccaatcccaccttccggaaaaccaccaacccggcagcggttttccggcagccactgccgccggacagccagccaccaccgttgctggctactcactctcacagccacagtgaccgactcggctcgcctcgcttgcagctgcacccaacccaacctcctcgccttcctcctctccttcctcttctcctcttctctactccactctgtcccacgcgcgcacacacgcacgcagcttcctcggccttggaggggtgaaggggggagggaggaggagcagaacgaaggatcttggggctcgggttggtcggggtatggatcggctcggcgcgggtgtcctaatgccgagctttcttggcaagatccatggccgccgcgcgagaaccctcgtctcgtagacagccctaaagccctcgcggcagga

SEQ ID NO: 54101 - DNA, 1501 bp, Oryza sativa
atagaatccattaaaaatggttttgttctctgtttcagtagtcttatagcttgtttgtattgtttgctttgtatgtcgcttagattccggctctcccgacgctccggtgtactttgaaatagttgccgaggttcccccagcagcagagcaaggcaagtcatgcttgtcacttgaacatgttgatcctatattgcaaatgctctaccattttcctttaaatactgcattgttttataataatactatgagatgtttacctgctgttacagccatactacttttgtaccatgctcctttgttagcttgggatataacatgactagagattggactagggattgcttagccatgcttagtttaactagcacaccgtgggggaaatcacattaattcatagacttcaggttctagtgttggtgttggattaaagccaccgtcctggtgttagtcaattaaaatataccttatggtgggctgtgggtgcatggttttgatggtcgcgcccatggcacttaaggaccggttcgcgggaaaccctggaaaaattcctcgtacttaccacaagccagcgtgggcaacggctgggcttgtagtgtagctttcctctagttgacgcattcaggcaagggtgggcatgatggagcggggcgggcactacgacggcctctgtcgcttccgaatttacctaggcacgagaggggactgctcattgcccgctggggacgggagtgaaacctgaggtgtggtgtgcttggctagagggggttatgcgaagggtcctgtcacggcctctttttggtatgtcgtggtggtatgtcggtgcacggaaacgtgtcatggggctgtgtcttgtgggtacaattgtacacctctgatcagagtgaagctattcgaatagccgtgcccgcggttatgggcagtcaaccagattcaccgtgattagtctcaccctagtctagtctaatggaattgattaattcaggtggatggttgggcctgtcgcaatgtggtgtagcgttggacagttgatggttaatattgagtaattattacaactgttttactgctttcaactaccgtctttaaatgctcgctttatgcaaatgaaccgctcaagctgtccttcgattatatcctgcatcataccctctattccgatatgactcgctgagtacgggggttgtactcagtcttgctctattttccccaaaaccccagagttttagtacgcgtcagatggcggcttctccgaggaataggcttcgtccgtgccgtcgaggatgcctgtggagtggtgttccaactgcggtccaagtcaaggcttagctccagttatcttttaattttccgctgcatttatgtaagacttttataatgtttgtaagacgtggatctgtatgtcaactttgttgtttgtgtaccccggccggtcctggacgggggttttaatgcacattctgcttggaattctattcgggaatttctgggcgtgacactgaga

SEQ ID NO: 54102 - DNA, 1501 bp, Oryza sativa
aggtacagggactggtcatcactgtttggatgcatatcgacagtcagtctactgttagctactcttttcgttccaaaacatactccctccgtctagtacatattcgccgtgggacggagagagtaataatttaggataagattatacacatcataatttatccagattaatagtactatagattaatagtactatagtgaatctaatcccaatttagattagaggccggtagtatcctagaaaatggctaaacaatacctgctgggcagaagtgcaagcaactgatgatcaaaattagactagttcagattagaaaaccagaaagagtaatttgagatcaaggcattgtttagatttaaacttttttcttcaaacttcaaacttttccgtcacatcaaatgtttggatatatgcatggagcattaaatgtggacgaaaaaaaaaacaattgcacagtttgcatgtaaatcacgagacgaatcttttgagcctaattacgtcatgatttgacaatatggtgcaacagtaaacatttgctaatgatgaattaattaagcttaatagattcgtatcgcagtttacaggcggaatctgtaatttgtttgttattagtctacatttaatacttcaaatgtgtgtccgtatactttaaaaaaatttggcacacgaactaaacacagcccaatagttcgcaagctttttgacctatcctatgaccaaatacaccattagacacattgtggcaagtcgttattattggatttagtcccacattggatattcaattacagcctcatcggttcacttatgcatatgcttatctgtactgtttattagcaaccaaaaagtaatttgtgagtacaagtattatatatatgttcttagttattcaaaagcaaatgatgtaaaaacaaactgcgctaaaacaacaaaatcaacttcaaaattaagttttaaaatttaaatttggcttataagtataagcacaggttaaatgatgttctcacgcaacttagcttaattattctctctagtttcatttttttttacattttagataatggcacggtaactttgattatggttaatctattataatatacatacaaaataagtaaatatttgattatggttatctactatcttcatcagactacacatctttttcaaaacaatagaaccaacggaagtatgagcttaggattctttttgggtgaaagaggctctgagaacttggttatgtttaccttaggccggccgaagattgtcttggagagctggatcaaattatttttgggctaggctggaaaacaaatgaaaagccatgtttgggctaggctggaaacaagcccacttgatcctttactgtttgtcaccagctaggctggaccgctggagatgaagatagaccagtagtaattgtgtgattgtgtccattattatagttaagtgcatgtttccaaaaaaacagagatttttgtcaaaagaatgaatttattga

SEQ ID NO: 54103 - DNA, 1501 bp, Oryza sativa
aaatatactttcatgtacacatatagttttacatattttacaaatttttttaataagacgaacggtcaaacatgtgctaaaaagtcaacggtgtcaaacattttaaaacggagggagtacaaaacaattaacacagttcattttgtatttattgtggcaatggttaatgtgaggaatgggccttacatactagccttccaattgaatctgatggcagatatataataggcactatgatctaacggttgtgatatttttacgatgtggcttctgtaatcataactaatatataggaatattatcgataatatatagagtaattaacaccattcattttgtttttattgcggcaatagttaatgtgaggaatgggccccacattagtagccttccaattgtgggaatatatcttatgcaaataagcttttagtgcacactccgtacacaataactagcaaatatcacagaaaattctaaaataaattggacacatactttcaataatattacacttacatatgaaatcttattttcaaatccattatattttagccataacaaaaaaaaagataaaattatgacatatttttactcttaaaattgtcagatttttcacctttttttacagctaaaatatactgaatttaaatatgagactttgtagatatgtataatactattaggagtaaatgttcaattttttatagaatttttcgtgacatttgctaattattgtgcacagagtatgtaagcaagcagcaagcttgtgtgtataggaaatgttccttccaattgtatctaatagctaatactccatctgtcccaaaatataagcatttttagacactaacatggtccaataatatcaataaaagtaagatgttttaactaaaaaaagttgcatattatagtagtttgtttaacaataaatctaagtaacatcaattttatatgattattcttttgaattttttttgctattaataatagttaaagttaaaaatgtttaacttgttactataataaaaatgtttatattttagaatggagggagtatcttatatgcatatttttgatgacgtggctatatgaaatcgcagctaatggatagatattgttcacccacgcgtaaatcgtaattaacccatttttatatacactcttttttttttctcgcccggtcgcggcggccataccgcaacaagttctcctccgccgtcgcttccacggcctccccccatcccaaacgcggtcgatcgccggcgaatccccaccggacgccgaggcgactgccccgccgctcgccaccctccatccccggcgtccccgaagtaacccaccgcctccttcttcttccctccatctctcctgcacccgagtgagggcgaccgcgatctctcagatccaccgaatccggagaccccgctcgcgatcgagtcaaacgcctccgaacccttaatcctcgccgccgccgccgccgccgacgacgacgacgaggacc

SEQ ID NO: 54104 - DNA, 189 bp, Oryza sativa
ggtacccgatgggtttgtgttccagcgaaacagaaataccaaccttaacaaaaattgacagggtgttttgctcacatgagtgggaagaaaggttccaaaattgcttgctttcagctatctctacgatggtctcagatcattgtcttctgtggaggaggtcaacgcacgagaggacgggggcgtagtagc

SEQ ID NO: 54105 - DNA, 1501 bp, Oryza sativa
acgtaaaatggtaactgtactaaggtttagatgtggatcaggcgtgcatgttgaatgaacatccatgttgcaccagttaggtacagtaggactgtgttgcaagttacattgttgagcatgattttgaaagcaaagaaagatgaataagaaaagcaaagtccaaccttgatctcccttccccttgatatggtggattcctaatataggctttctttgttcatatgattttccatatgatactataataagcctctcctgaaaatgggtggctactcgaaccgattgaagttgctctttggcataggtagacttcagtacctggataggtcaaccttgctaccatttatttgtcttgtccttcattcctgctattcctcatcatagaagtactccccttccattatattgtagtatggggaaatccaattgcaattgggcatgccaatggttgagtcattgtggtgtgtttctatttgtcaaataattgtaaatcattgtatttttaaactttggttatttgttctctttttgactgattgctagggtgttaagaaaaacaatcatggacttcattcaaaacaagacactatttgacttgaactataaaacaattcacttttcaaccttggtcctgatcttctgctcccaaggtgccactgtagtgtgatgggtctttcaaggatcgaattgggcatgatctggcctcatcctcggggagaccttcaaataaacacattcaatcaagtaatacctactgttttttggtaacctgttttggttctaacacttgatgcaaaccagaattgcttcccttgatcaatattgctgagaataacagccactggtgaaccaatagacacttgttctctcatcaaaaagtttgtttgggccattacataagaggattggtcaactggaaaatcaggacccactaatttaagactttccaaagactcttggccatttcagcttttacaccatacgttccctgcacatctgctccacagcaaactgaatttgttttaacttgcagtgttccctccatttcttgttatatgcagctatagagctttaggggtacagattcaaactttactgcataataatgtctgattattgattcagttcttctacttcttgctgcatcttcagcaagtattggagaaattcttggttccactataaagtattataataacctatggtctggtttcaaagttcaagttgtaaaatggacaattgtgccattattttgtcacctgctgctattttttaaggcaattgaaacagcaaatgacaattatgagagtttcagcagtatcgcaaatacaaagctgagatcagtccatctaattcctaatcttgtgtaccaatctgaattgccttttcaggccacccttgtgaaaatggtcaatgaagccactgcaaacattccagggtgggacgaagaaaggtgattaaatggttttgcctcgctgatactcaattcagctgatagtgt

SEQ ID NO: 54106 - DNA, 326 bp, Oryza sativa
ccatcgagctcttgccatgcaagaatcagcttgcagtaaagccttcgatctccccgatctcacaagccaccactaaccaaaactcccatgggcatctgccagaagacgagacgagagcttagctgaaatatcgctctctctagctagctgcctctcactctcactctctcagcgtgtgtgagctcagctagctcttgtaccgtggagacaatgcaagcaggcagctgttctattctttccaggattcacacatgggttggctacttggcttctctggagtctggaccaaaagtttgggtttcttgctttgcttgcttgcttgcagg

SEQ ID NO: 54107 - DNA, 1501 bp, Oryza sativa
aggcacgtccggtggtgaagaaggccgacgtggcgtgatgaggcgtggccggtggtggaggaggcgaccacggtgcgaggaggagctgctggtgggtgtggcgcggtctacgacgcacgacggctagccggcggggggcgccggtgcaggggtcccacatgtcggcggaggttgggcagtggtggagcatcggtgcgttagccgtggactcgcaagtggtgagcggcaggtgaaaacccaacccggccttggccggaccgacaacgatagagctcgagtgtcattccccctcctaagggcgttgtcgtgccgtctcacccctcaagggtggttgccgggcgaaagcctagtcttctctcttttgaaaccttggtggacggtggcggtggttttcgtcacttctctccttggagttgtcatttaggcatccccttgctgaaaccactcgagcaattggtgcaagcacactctagatttttcatcctcttgtggtggcgtcctagtttctacaagttgactacgtcggagggcctagggggagaggtgctccatcttctctctcaccctctctccctaaatcctgaagacgtggatagagttgggctttgtggtggttgtaagagcgttttttgggcgatctcgtttgtgttccgtttttagcctagcggcggtcggtcacgcttagcggcgatcggtccggtgctagccttctcccggacctgtgtgttggtgctgttggtgtgtgggtggtggtatattttttatttttttctggttacgatcttgcagggttataattttataattgttttctgctctatcaataatcgcaccgtctcatgtgagtcgttaaaaaaaactagttaataacattatttttttttggttagtgtctgaagaagattaaaggaagctgggagtgaagagatggtgatttttcggcgcgaccaggggtggatatagttgcaggacagctagagctatagctctactcctattgcccaaatatccatagaatcatactttaaaatttaaaaagcccaaatatccatagaaatcatactttaaaatttaaaaaatagaagacaaaagataaatttatttagattatactagttcagccctactatgagcatattctggctcctccactggctgggacggtggtgaagaaatgtctggactaattttataggccgtgtttggttcacccccaactaccctaaacttacaactttccatcacatcacatcacatccaaaatttttctacacacataaacttttaacttttttttcaaactttcaactttccctaaacttccaattttttttaggaactaaacacacccataagattgagggaaggtaaaatattctcaataaacatagttgttaatattacaacgtgtcctgcgaacgaatagaactttacgtcgtccaaatccaaatcaaagcatgtatacgtcgggttggctatcagcaatgcactagaaaccggc

SEQ ID NO: 54108 - DNA, 222 bp, Oryza sativa
tccatactgcaagtaattagcatgcgtatgcatgcaatggatatagctacagtagcagtacaatctaggggcatgtcttgctgaggcgtctacaaagccatcgatgtatggtgatgatgctgtcagatacacgatggatcacacaaagctctctcagctgcttctcttcacgggcagtagataagaagcagccacccctgctccgtgcctttgcatacacat

SEQ ID NO: 54109 - DNA, 1501 bp, Oryza sativa
acatttccagtgcagtgaggagttcagtatcatattcagtctcacaatttcagtactaacattttgaaatttccgaaaacaaaacaagttttactgaattttgcaaaaaaagaaaaaaggaaatcaatttaacaaaatctgtttaaatttccgaaaccacctaaatgtttatgcagtctgaaatagtaaaccctgctcacattgtagtggtctgcatttttactgcctaatagtgatagctttatattatgctgaattctcacacattagtagtattcagtactcttccctagactgcaagtctgcaaccaacttgattacaccaaacgacttatatttgtgccctaacaaatattcctactgtacttttcagtacaattagtaaagtgcagcttgttcaacttttgcctttgcagcttgttataatcgcaggctgctagagtgctagctggctagctgccacacagagcttcccggcaaattcatgatgtagcagttgaaaagatacacaccatagtaccatacacgttaacttttgttccttttttcaatctgaagttagctagcacatgcagaatgcacaccgagagcagagagaaaattcaccggcacgccggagaaacttaccgccggcgaagaccagcttccgcaggacagcgcgaatgtcaccgacggctcaggccagtccagtccaaaaacccctctcgccgccgccgccgcgccattgccggatttcacccccttcgggttcacctgtccacaaaggcataaacatcatcttatatcctcctcatctcttcgcttatcaagattcctgttatcccgtcatattatacggaaattgtggggacgctttgactcccgtgtcgctctctgaggcgacccgggaggagaacaggactcccagcgcttttcccctcgtcgcccacctcgccggcgccggcgccggtgccgcagccgccggcggcgcccccacccacctcctcccttttcacctccccctttcacctttttccctttcccatttctcccttttccaccttttctgctcagcgctcggcggctgctggctagttgcccggtcctgtaaatcctcaccgccgtcgtcgcttttcaacttgccaccgttcgagcaggtcaccggagagtgcaggtccgctgggttggcggcaaggcttcctcctcagtccccttcctagagagagggcggcacggtgggtctcgcctggctccggcgagcgacgcagtggaggtgatgtcgacggcgggagcggccacgcccagtggcagtcggcaaggcaggcgcctatggcgccggttggccgggggtggtggcagtggtggaggttgccggttagtggggcgctccggtgatgggcatggttgctgtatggcggcaagttctccatcaccggtggtctcaatgggcggtggtgacaggggctagcccaccgttccttcctttgtcaccgacggcgtcgcggacttggtgagtagctgt

SEQ ID NO: 54110 - DNA, 1501 bp, Oryza sativa
agatatatttatattactatcctagttagcaatagtagaaatgttgaggggcattattgtaaaaaaaaacaagtgtggaggggtataatcgtcatttaactgtgactaaacccttttttacttcttttttggcttttttgatggaatatgagcgataccagtgtaatagatgaccacataccgatctagccgggaaaaaacataaatgacaaagttaccctttatcattgtattattgtattagtaaatcactgatttacccttaatactaatggtagtactatactaccatactaccagtagagagtactgaagcatcactaattataataaatcatccttagaaccggtttgtactgccttgggcagtactttgccttgttctgatagttaagggctataaaatgttcggtttcgggtgttctgtagataaacctgatagttgtaatggtcagagggtgtaacaaatgtcaaacaattacgagtgatattatagtcatataaagccttttatctaactataattaaattaatagaacaagttacaatgattataaatgttcattttcatttacacacaaattaaaaaaaatcgacacgaggtagcacaagtgcacaacacaacaacccaaactaaaaggccgtctaacataaggtacaagtacaactgtttctcatatctttctatactccctccgtaccattaccaaaaaggatacaattgtagcatttaaaagataaattaatagggaattaaatgacctagatgtcctttattaaatgagggagtagcattgaggtaaaaaaaatccacgaattgatacatggagttacaatagcctcgctcaatcgggagatttgcaataatgacactacaaacattaacctttgctataatgacattggacccacatttcatagacacagatgggcccatttttcatccactcgtagtgccaaaacagcaaagccccaatgtttgcagccccaatattgcaattttctccgctcaatattgcttacaatattgcccatttgtcatccgctcaatattgcttacaagaaaaggccaaaaatgcatttgatatcaattactctgtccatcccaaaatacaacaaaccagcaccaggggcaaagccaggtgtggggtagcttgggcttgagccccatacctggcagaaaaaatatatacaaggaatatgctaattttcttattaaaatttattcaagaagttcgtaatctagtgattaagccctactcttggcataatcctggctccgcctctgcccagtactacattagacaccgcataataatacgaatctagatatgctgatttgtgatactcaacttcatggacgtgctgatgaacggagatagtttctgaccatgccactaccacatacccatagtggtagtaccccatgtgaaaaactggggctctgattggcacttcgtcgtacactgcggcatataaaccacagcacctctctcgatct

SEQ ID NO: 54111 - DNA, 1501 bp, Oryza sativa
gtttaaccgtccgttttatttgaaaaaattatgaaaaaaattaaaaaaaacaattcacacataaaatattaatcatgttttatcatctaacaacaatgaaaatacgaattataaaaaaaaattcatataagacggacagttaaagttggacacggaaacctaggatttgtcttttttttttttttgtgacggagggaatacggtacaatttttcaccagtcactccaggatgtcaggcaggcagaggcaaaagcagcaagctgcactgccttttggcacatgactgactcttgaatccatttgctgctaggcaattgcccggctgcagtggccactgcccactggccataccttccgtgggctgcctgcagtgacaaacagtaactttgtggctttctgcgatggaagcaggcaggcaagcatgcacaaggtaaaaaggtatctagtggaccatggccaaagaacaatctaccatgtggttgacattttagcgtgtgttcagcaagctagtgaacctaaggtagggatgacaattttggccatgggttcggatatcagcggatacccggcccgaatgtctgatgagcactagtgtgggtgtgattttgtacccgtgggcacgtccgcccaagacccaagacgttatgggcaacagccgggtttcttttttacccgtggataacctatacccgacctgatacgtttgtattagctaatttcgactcatctcttgattcttatacccctttctcttggatcatttgttatgctaactgataagaagttgtgatgtaattcaaattatcattgataactgataattttgtaaaatattgattttatttctctttgttaaattacttatctttcgagttattattcatgtgagattcattgggtacctgccgggtatgcccgtgcccgtcgggtatgggtacgggcacggagttttgctcgctaaccctagtgggtagggtttgagccggcgacattgggcatcgggtagggcatggttttgctttacctgtgcccgacccgacccattgccatccctaagctaaggccatgtataaagcagtgtctcagacctgtcgtctcaagttctagctaggtttggatgccacgctgaaggtttagggtggtctcgcagggtggcagtggagcctgcaaaggtaaatgtggtctacggtggctctaggaaagagaataggggtttgtgtggtccaggcaagaagcaagacgtgctcacgctgaggtcactgccacactccgtcgtggccactgcacctcgctgccgccgccgatgtcgttgttgcactccgccacggccactgcaccctatcgctaccgttgatatcgttgtttgctccccacccttgtcttcccgcatggatccagcgagaacgaggccgaatccaccgccttggatctcatcgcgatggccagggagtgaccaaaacataccattttgacatagatgtgttctttcaaacataacttg

SEQ ID NO: 54112 - DNA, 1501 bp, Oryza sativa
gagggaggccggattggcgcgagaggcgcgtccagtggaggaggccggcttggcgcagagaggcgcggccggtggtggaggaggcgacctaggtgagaggaggagttgtcggtgggtgtggcgcggtctttggcgcacgaaagctggccggcgggggacgctggtgcaggggtcccacatgtcggcaaagcttgtgtggtggtggagcaatcggtgcgtcagccgtggtttcgatctcgtctgtgcccctttgttggcctagtgacggtcggtcatgcttagcggtggccgatccggtgctagccttctcctaggcgtgtgtgttggcgatgtcggcgtgtgggtggtggtatatttttttcttttttctggttacgactctccagagttataatcttgtaattttttcctactctatcaataaaacttcgcaccgtctcgtacgagtcgttaaaaaaaaaagtgccaccgatggatcatggatcgtatataggaaatctgcttcattccacaccgaagattggtagggttacgcgccactgactacgtggaccacgtcacatggacagtgtcagttcgggaagaaattttgtcgagacaaactggccaatttggctatcaaaacgagaagaaacgttgttacttgccagctccgcgactctcatctcatgtgcccgggcacaaaagctttgtatacatcatcatcaccatcgccatctctccaatgtaagaatggcgagcgtgtcgaatcgaggcacattttatgtgtgaagccggtttctagtgcattgctgatagccaacccgacgtatacatgctttgatttggatttggacgacgtaaagttctattcgttcgcaggacacgttgtaatattaacaactatgtttattgagaatattttaccttccctcaatcttatgggtgtgtttagttcctaaaaaaaattggaagtttagggaaagttgaaagtttgaaaaaaaagttaaaagtttatgtgtgtagaaaaattttggatgtgatgtgatgtgatggaaagttgtaagtttagggtagttgggggtgaaccaaacacggcctataaaattagtccagacatttcttcaccaccgtcccagccagtggaggagccagaatatgctcatagtagggctgaactagtataatctaaataaatttatcttttgtcttctattttttaaattttaaagtatgatttctatggatatttgggctttttaaattttaaagtatgattctatggatatttgggcaataggagtagagctatagctctagctgtcctgcaactatatccacccctggtcgcgccgaaaaatcaccatctcttcactcccagcttcctttaatcttcttcagacactaaccaaaaaaaaataatgttattaactagttttttttaacgactcacatgagacggtgcgattattgatagagcagaaaacaattataaaattataaccctgcaagatcgtaacca

SEQ ID NO: 54113 - DNA, 556 bp, Oryza sativa
ctctatcattataattacaggaaactgatgaagaacaagatactgatcacgtttgattcaaccaacaagatgaagaacaagatacagatcaacatttgattcaaccaataggtaaaaatctttcgctatacaaataatgcagaccaataatttttggcatatatatgtggagaaaagtagtagcattcagtgcatagactcgtccgttagccattctattttaccagagaaatgaaatggagatttatcaaatgcttgcattattcaagctcttacacggtttatgtctgtgtaatccacattacatatatatccaagtgtattaggtttaactatttagagatcttgagacatttttaatgtatctaaaattacttgtcagtagcaaacatttgaagccattcatatatatccatcgattatatgatgttccaggttaacataggttcaattgagctggctcatctagttttccacttggttttttgcattcgccatgctttaagtgattttgattggcaaacaactagtgttttgactcaattagctagtgcta

SEQ ID NO: 54114 - DNA, 206 bp, Oryza sativa
atgttatttttcaattgtatttctatatggactctatactctacttctaatattccttatttttaattccgaatttctattatttcttaattgtatttctatatggactctaatcttctcttccaatattccttattttttaattccgaattttaactatttctaaattgtatttctatatggactctgtttttctttttctccga

SEQ ID NO: 54115 - DNA, 1501 bp, Oryza sativa
agaagggcagaatggcttgtttttttgtgtagcacaagtttgcagctaattgctggaattttttttttttgcatttgtaaagggaaatacacatgaagagttgagagtgatatatatcatgttgctttccactgaagaattggtgttccgtgttcctcctacctacagtgaccgtcagagccgacaaactaaaacttgacagagaagtattgttgctattttgatttatttaaaaaggtgacatttgaaactaacacttgaaatttcatcagttagaatcccatcgctgcctgctggtggatatgctcgaggcatcttcccccttttagatgatcagttgaacaacagcttctctctcactgagctcaatcaacagaaatccgccacaatatttttctatccatggtgtcgtagttgtaatttgtttggggatgtttaggcttcattgaggctcctccatttttcttgtggattaatgtgtatcaggttggtatccatacgtatcaggccttgtacttctgtggtattaggtctaacattcatatacgagacctgatacatataagtattagacattctgggaaatccggaaagaaaaaaatcaacggttttcgagcaaaaggaggctgtggctccttgccttatggcaaaaattgttggccaaaataaaggaagaaacacgaacttgggttcttgccggagcttaaaaaacttagcgagtttatccctccacacgtatagttatgtatagctttttttctttcttctcttaggggttgtacttttctcccgctatatttaatgaaatagcacaatctcgtgctgattccattaaaaaaaaagccttatggcaaaaataaaggaggcaaacttaggctatggcaggagcaagtggcttggagaatttctctcaaatcaaccataggcgttgtgtagccatgtacagtatttttccttacacctagaggttgtattttttatctttacattcaatgaaatagcacaatatcgtattgatttctttcaaaaaaaaattattagacctggtacctcattgctatcatatgcagggatccttagaaacctcctatcttaaaagcacactacatgtactagctattattattggagtatatttagtccaaactccaaacttaaattctgcggctatttcatgtttggcagttttgaactctaccatccaccagctagcaagcaactgcattgctagcaaactaatcgaacagcgacagaaaaaatgagttttgttttatacattgtacatatccctcttctggtccttactgaccattattagcttacagccataccagattcggtatcttctagatttcggctactattacaacccaaaattgggaattggttctgtctagtgggcctgcacagcggcacctcactggcccactaaacactagtggccgtcctgttaatgggccttactgaatcttaacactgacactgatcactcactaattcc

SEQ ID NO: 54116 - DNA, 216 bp, Oryza sativa
ggaagatgggccgagagaaattcggcccatcgaccccgggggaggcaaaatagacttttgcggaggaatttgatttggaaagatttggattcggatttgaacttgacgatagatcggggatttgagatctgagatggcacggacactagacaacaagcaaagaaacaaatttcacaattagggtttttaagagataatttttcccgctaggcgcca

SEQ ID NO: 54117 - DNA, 239 bp, Oryza sativa
aggggagagggccgagggagaggggaagatgggccgagagaaattcggcccatcgaccccgggggaggcaaaatagacttttgcggaggaatttgatttggaaagatttggattcggatttgaacttgacgatagatcggggatttgagatctgagatggcacggacactagacaacaagcaaagaaacaaatttcacaattagggtttttaagagataatttttcccgctaggcgcca

SEQ ID NO: 54118 - DNA, 343 bp, Oryza sativa
ctctagaggatccccttacaggcgatagccacggcgcgcgcttttgcgatcgattggcctgttgcatgatagctggcgaccgatcgagtagagatgagaaaattctcgagctcccaaccgggcgtgacctaatcctgtcccgcccgaacagtgctgcgattgccgctcccatctcgcgcggtcgcgttactggttcgccttttttttcgccaacccggccgcgcggtcgttgtcgcctcgtggaacctaccattcatcgatcggtggccgatggatggatcggtcattcgatcgcgcgaggcagaccgggcatctccacgaggcgtgcgaaaggaagggagga

SEQ ID NO: 54119 - DNA, 1501 bp, Oryza sativa
gttaggcatctaaagactttctgccaacttaattaatttctcttgacatgcttatacaaattgaccttgatactttcaaaataatgtttttaggacatagataaatatttttaagaaagatgatcatagtgtccgaattacacatatgatctatgaagtcactaatcatagcaggtattcatgtagcaatatagacaatagggtgaaaatgaaggtgtggttggttgaacatcatattgataagcatgtgggttgtacctaaggattttaaccgtggaacaaccttgcagtggctttagcaataaatcaagtcagttccatttaggaattaatgaccatgtcctttatttatttatttttattaaacttgctacagtacattgtaaagtcttgacgtagaacaatctaaaacatgtatttgttataagacaatacactttagtgatgattcgctaaatacattatgaccattacttcaaaatttcaggagagaaaatttagaacgtatacctttaccccatactaggttatgttttcttatattttcgtcccaaattgcaaagatcaaatcatttcaaggatgattaatagaatgaaactatccaaaagaaaaaaaataaaaatgggcataaaataaattgaaaattgaaaaaatattgctggattttaaatcaatacttgattgaaaaattcaaacattttacaaggatggttagaatgaaaaaatatatctataattttaaaatacaatcaaacaaaaaaaataatattattgaatttgttttgaggttgtaagatatccttttggcgagttaaaataccctaaattttatcataggaaccacctccattgtttcgacacaatagtttctcatcaattaaaaaccacatgatctcaagtaattttattttagaatttatatgttgcacgggtaattataaaaatataacaagctttcaaatcacacaaaataagtttaattttagtttagaacataatatatgatattttaataaaaagccacccgcatataaatattcataataaaatttcactcacattatacgagaaggtgcacgcgcatgtgcgcgggctaactttctagtttaattaaacttgaaacaatttaactttgacatattataacctgaaacggagggagtagtatataaaaaagaagtatcaccgttttttttcttagggtattagctgtagttgggatccacacccaacgttctgtaatcggattattctactcccgtaattgggccagctcagtcctaacatgaaatggacggtgagagcaaatttaagtagcttaataaggtgtaacagcacacccttataaaaacataatgattccaaacgtaagaatgcatagtaggaagcagttctctctgtaaagcgcaggtgtgtcgacgtttgatgtcgcggttctggtatttgcatggtatggggatcgtcggtgctagggtatacgcgagactaaggtaaaagaga

SEQ ID NO: 54120 - DNA, 1501 bp, Oryza sativa
gctgcaaaggccatgagcaagttagctacctcaatagtcttagagaaactcaccgccggcgacgcggattgctcccttcccggtcagcggcaggccgacagcgagggttgaaccgtcacgggtggtggtggaacaggcgagccccacgagtgaaggtggatcccgcccaggacgtgggcggcacggctgaaatccgtcttgggcaggggctgcgccacctttgccaacgcattcgtgggccagcgatggtcgtggaaggagacgtgggtggaggggatcgtgaggcagtcggtagagctttccccgagaatatgcaggttcaggcgcgactccggccgagaaggacggcgccggaggcgtgaaacaccttgggaagcggcggcgctggggttgggccggcaccacctgtgtgcagcatccagggacggttggtggcgcgcggcgtggaagtgcgatggctgcgagcggaattaatggttcgcagtgccggcgcacggtgttgtggtgtagcggcgacggacggcaggcgtggagagcgggcggtgggagggcgcacacggcggtgaatgcatggatcgctggcgccgggcggcatagtgacgccattctcggtcacgagcggtttttcctccttttttcttatctgatcgtgggatcgtgtgtcccttcagcgtttctttttttttcttcgtgcgcgacgatggtgcatgatttctttcttagggatgacaggtgggtcccacgtgatagtggatctgaaggattgtaggattagggatgaacttgtactttttatagtatatagatgtttgttcttggatgaaattgcttgaactgatcagctatttgttatgggttttataggcactaaccaaatagaaaatcaataatagcgtcttgtgctttctattatcagttggcagttctccattcgatagaatggttttgttggtgtctctttcggttcgtattccgctgactatactgtaagatcaaagtgtgttttgattcttattctgtgataaataattggtatttgagattattggttttgatatttggagatgattggataggagtttttgagatgattggatttacaggtgatatacaggtactgctgttttgtcaggtccggttagaccgggcaggtgatgccggtcagactggcgctatgcgagcggtcagaccggtcagcccgcggtctgaccgggcgactctgtgtcggtttcggtttcgggttgttcgtttggatatccgtgattgtttcatgtttatggcttctagatggatactatgcgtatgtaatactgttgtttgctactaatgagtcaagttggagatagcttggtctcggaatatgatttctttgtttgattcatgtgtaggtgacttgatgcctcaagatagtatttgcggtgatggatcgggagttggcttggggttaagacgatgtctgtgacggtcagatatcatgtgggatacttacgctagagttcaa

SEQ ID NO: 54121 - DNA, 1452 bp, Oryza sativa
tattagttattactaccgactcatgatttaacaaggaaataaatttgagcaaaataaaaatgagatacgcatctccccagatggatattatctactaaaaaaaatctccccaagatggatgaagtgtattatgttgtcttactcctaataatgtctttcttttaaagtttggagatttgtatttatttgttgaggggattataaaacgggagcagtggacgggttgggtttggttgtttgggcaggccaatggatgttttttgttctaattttttgggataaacaagtgcagaaaccgatgtaagcacgggacaagtgtctgtatggtcggtggggcccaaagaacagcgaattattggggcccatgaaacgtggcctccttggagcgtgatgacgaggatactgtgccactacagtgtccgcatgttatacacatctgcagcgttggacctggccatctttccattctgcccatgattatattgctttttgaaagggaaaaaggtaaagaggagaggaaatggactaccgtctcttctttgtttaagctcaattaatcccccttggttttacaaactgtgatcaaacacaaagttcactattttttatttttattttttgcgaaacagtgaacaaatggtagcactgtctcgttgttggctcgtttaattttcagataggatcgttttgatcgcatcgagctcgagcgatccgatggcctcgtcgacgaatatatatggaattaatgccgccattttgttgttttgtggtgcggtgttgtcgtgattacgattaaacagcttatccatatttggtttttatgacgaacgaggagaggatatgtagggattatatatctgcatcttcatgcattccttgtgcgatcgacacctgatctgcatgcgtaatgaaaacctgccacgattggtacccgtctcgttcgttcttatcaactggactagccaacaaggcccacgacgaatgcatgcgtgcctaagcaggatttacgcatgcatgcaggcatgttgtataaatctttttaccgtagagagattgtctcgattaattacctggtctagatatttacgcggaaaaaaaaggcatcgaaatgtgttcagtggtgaaatgggccattggtattttttttttcttttggcacgagggagaaattaatatacggtcgatcgatcgcctgaagtcctgaactgtagcgtactccctccgaaaaaaaaataaattatgggtttccgtgtccaacgtttgaccgtgtgtcttatttaaaaaaaattatgaaaaaaattaaaaagacaagtcacgcataaagtattaatcatgttttatcatttaacaacaatgaaaatactaattataaaaaaattcatataagacggacagtcaaacgttagatacgaaaacacaaggttcgtcttttttttttatttggaacggagg

SEQ ID NO: 54122 - DNA, 1501 bp, Oryza sativa; identical to SEQ ID NO: 54067

SEQ ID NO: 54123 - DNA, 1501 bp, Oryza sativa
acaagttccatcttttcctttgtaagctgtgttttccaccgtataataccatatcaactggattagggctattacctgtcaaggggcctgaaccagtataattcttgtcttttgattgctcgatgtcgtactacgtagatccttgtaccagcgtaccccaataccctctatatccggtctacgggtatcacccgtcgacagtggcgcgccaggtaggggcacttggtactcaaggttctactactatgccatcaagcttcgtcgacaacaacgtcaacaccagctccagccaagcactctcgacttcaacgatgctggtatggactcaagtgggcgaaatcgtcttcccggtttacaccacgatgccgatctcaaccggtcctccaatgactgaaaactagaacgcagtggctacaaaccaagacggctccatgtcgaaaaatccacccgttgaaacggagaacggattaccgactacatccaaacttgggaaggattctgatgcggccaagtcttgtccctccgacgtaaatcacgggccgacaaagatgacttctgaagctatcaggtcttggtgtcctatccacaaaaccaagaaacatacccttcaagattgctgggtattcatcaacgtccgtgctgaaattcgcgcctgcaaagaacgtggaattcaacgtatttctccaactcgggatgtctattgtcctatccacaagacaaagaatcacgatctctcgagctgtaaagttctcctcggcgccatgaaagccccgtctcctaagtcatacgtccccgccagggataacggcaaggaacagggagcgactccagcctcagatcgattcgttggggtaatcgatctcgatcctcacgaaccatcggtcttacatctcctcgaagactacgggtcatcgacaacaagtgcgccgcgggaggtactagttatcgatgacgttggcacgtcagcgcaagccaacgcagaagcggcgaatcaatcgactactccagcctagcacatcagggctattcaagctatactgagggaaactccttacgatcccgttctgaatgacgacctcgagcgttggacagaacaattacgggagtcggtgaccaacctcagcaatgcgttcgaagaggtcgctaccgcagcacaccaagatcagccaccaatcggcaaccccaatggtgaagatccggagcggagggaatcgcctcgacaggctacccctccacctcgtggcactggcgatcttcgagatcaaattaacggtcgccgagaagcacggcgcacacgggacgacgcaaatcgctctcggcgtcatgtttcttcacggcaccatgatcgaggagaccgccaaaacgaggaccgagaatgcaacgatcgcgaacggcgggggccagacaatactggtcatggccatcgccgcaacgacgacgacgaaggagatcggcgccgagataacagcgagagacaacgacaagattcccgggatccagg

SEQ ID NO: 54124 - DNA, 1501 bp, Oryza sativa
gagaaggtattccagtctatgaactggcattggccctcttggtagtactcgtggcctgttacagatgtcttaggaaaaagtgtaatgtagtgggagatttatgtaaaaaaacagtaagaattattatgtgaataaagaaatctatctttaacaaatgttttcttactctggatgttgtgtgtgtaagagtgtgttctcagttaacgactttagttagccgtttgagtcgtacactctccctagcccccagccttgtcgtaggagggatttcctcgggtgacaaggctcctggacccttggcccgtcttggttgaataagctctgatcctagcccccagccgtgaagttggaaagcttggtttccgattacacggcttggttaatacgcacggcgagaactcttacacgaccagatcttacatggtctttcgtctctaaaggatctgacaaggccttatcggctctgggcgtccctagccgaagatcccttaggttcctcggaggccttgtcgagacggcgtaaagggacataaggacaggtttcaacgctaggcgtcgtcagagtaaggggtcattgggtgaaaacactttggtcgtgatatgagacctaggaataggctttattgatactgtaagggtgcttacaggtatagcggtattgactcatacatagaatttacgtagttggtcaatgttccacgaatttgctagttcgcgaacgtcgccgtcagcgattttgaatgcgcctggccgcaagacttgtgtgatcgtgtagggtccttcccattttagtgagagtttgtttcgccccgcttgggtttgaactcgtctaaggacgtagtcgccgatcgaaagtatgcgtgctcggatgcgcttctcatgataacggcggagggcctgttgatagctagctgctcggatggcaactcgctcacgatgctcctcgagaaggtttagatcgatctctcgctgattctcctggttctcgtcggaatgcttctgtactcgtgtgctttgatgccgtaactcgtcggggagcatggcttcagaattgtacacgaggaagaagggtgtttccttattggatgttgtcggtgtagtgcgcacggcccatagtactgatgggagttcttcaacccattttttgtcgtgtgacatgagtctgtcgtagacgtgggtttttatcccttgtagtactatgtcgttcgccctttcgacttgtccattgctttgagggtgagagaccgaggcgaaacatatttggactcccaagccgatgcagtaatcctggaaatcggcgctgatgaattgagagccgttgtgggttatgatgcggtgcggtagtccgtatctgcaaaatatccctctgatgaacttgatagcattatcggccttgatttccccggtgggtactgcttcgatccacttggtgaacttgtcgatcgccacaaataggaatctgtagccgccctgtcctcatgggaatggcccaagttagtct

SEQ ID NO: 54125 - DNA, 406 bp, Oryza sativa
tctttaacaaggtaagagtggcttggctttaaaaaagctaaataaaaatgttgcttatttgtttatgcttaaacttcttagcttataaatcagtttatataagcctaaacaaagaggtgttattataatatgaaatggagggagtactatttaggagaacatttgttgaaactcttcaaactttaatgacaaatatttttttcaaatgcttagttgaaaagaggcatgcgtagatttgctttggtgaacactatcagaatattataaacctatatatattagaatttacagatttattttaatgtaaaattgatggtcaaagttttgaaagtttcacttttctaaatatcaattattcattaagagaggaagtatcggtatcttaccgctgctatgctcacctagg

SEQ ID NO: 54126 - DNA, 1501 bp, Oryza sativa
ttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgatattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccgttacgttccccggtccgcgattttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacagaacaacagattaagtgcaatcctatcaatgcataatattttgcaagcaatataattagatttcaaatataggctcaagatgttcaaaggtggcttgccttgcttgagatctggagcttgatcctcgaaatcctcgcactgcgggtcttcgggctccgaaactacacgcaaaacgggacaactcaataaacggcgaaaataaagccctattaatgacctctaagcgtgccattagatagatctcgagatttgagaaattttggaatttgaacggagtcaaacggatttacggctggaaagatattgaatttctaagattattggatttttggtctaaaggaaaaggatttaattaaatcctttttttttggaaaagaaaagaaaagaaaaggggagagggagggaatatagacttccctcgggcggctagggcgcggcccgagagaaagggcggctcggccgagcttaacgggccggccggcc

SEQ ID NO: 54127 - DNA, 241 bp, Oryza sativa
gggctatagcacagctccagtgcttgaaggctgaagagtaatcagcagaagtaacgaggtccattgttggtctacagaaagtcaagggccgtagtttcctggtagataactttcctgaattcctctcttctttcttggcgtcaaactctctcttctcttggtttcctgctgagatcaaccaacacagataaaaccagctccatatccaacactgaaagatcgaacatcattgaatgtatta

SEQ ID NO: 54128 - DNA, 1501 bp, Oryza sativa
aaaaaacagatttcgcaattagggtttttagaatttaattttcccgctaggcgccacgacggaacgggcgctacacgtaatgttcaatagttaaatttttgttttttcttccgtggaatgtgtacagattgaatgttgtactgtagagtgatatatatatgacattgtgatatatgtagttaatttttaaattttttgtagcatttaaattacatgcaagatattactgtagacccgattttcttagaaatcaaaacataattggacattcttcttccgacatgtagaaatatcgtcaagacactctgggtgtgtttagttctttggtgtaaagtttttgaagtatacggacacacatttgaagtattaaacgtagactaataacaaaacaaattacagattccgcctgtaaactgcgagacgaatttattaagcctaattaatccgttattaacaaatgtttactgtagcatcacattatcaaatcatggcgtaattaggctcgaaagattcgtctcgtaatttacatgcaatctgtataattttttttccatatttaatatgacgtttttggccaaaatttttttgggatctaaacaagacggcctcagggtactttgcgctatctctggaacaaaaatcaatggtcaaaggggcaaaatagcatgcatttccacaaaaattcatcattctcctccacaaaattgaaatgtgagggacacaaaatcaggacttgctttttttctttcacggaatatgcaaaaggaaaatccatgacttgctgtctgtcaaccacatgctcatgactgatctagtccatgttcatgaaacaaaccatactagcatggaaaaggttgttgacagacaacaagtactttaattcttcctatttcttctaacctagcttattatctctctctctctcttgcggacattgcaagttttttgtgacacacatcatacatataaaagatacatataaaagggggcgtatattttcacgtacacctcgagagattaattaatattgcaaccaacatattgttctacagttatgcgcctatataactataattaatttaatattgtactggcggctaaagctacgtacctaaccaaggaaacaacagttgacaggtctgcattaattcgcacatgcacggcatgcacaatcacctatacgtacagatgttcacgtatgtgtccggctaacgcaagccaaggcagcagcaatgggcaacatatgcatgaaggccagaaaacaaattaaaaaaccctgtaggcgccaagtgtagcagctgaccgtgtgcttagttagcttgccggtttgatcgcttccaacttgtgaaaattttcttcgatcacccgttccattcctaggagcagaaatggtggtgcaactgacgcatgcaaacgacaaattttatagtgatcgcttcaactgcaactgtataagctacgtacaaattaaaagccgtgtacgttctttctttaatcctcc

SEQ ID NO: 54129 - DNA, 1501 bp, Oryza sativa
gctttattttcgccgtttgttgagttgtcccgtttcgcgtgtagtttcggagcccgaagacccgcagtgcgaggatttcgaggatcaagctccggatctcgagcaaggcaagccacctttgaacatcttgaccctatatttgaaatttaattatattgattgcgaaatattatgcattgataggatcacacttaatctgttgtcccgtctgcaaggcagattggcagacctacctaatttgttacatttgatccttccattgttaattgttataccatgtccccttgtaaccacccagttgcggctcgatattcgtgcactctgtgcgagtatcgacggtcgcctttaaacttaaaatctgagtaacaacttgggtaaaactggagttttacaaaagacttggaaaacccgacacctgggtcggtgcttgcgaactaaatgaatttccaaaaccgcggaccggggaacgtaacgggtgtacggtttcccgctctcgcacttaaggacagatttccttggaatttcatccaaacataagacaagtacgaccacatgggtggaatgggacacccctggctgagtaactagcttatcaggggagctttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggattcgatgtttgaaaaatcagcagctgacgggatcagctaggcccgggtggccgttgaaaagttgttggcccgggtggccgtttgaaaagctgttggccgggtgccaatcttgtttcaattctaaagattgatgcattgcacatactccgaccggacgagacgcactgtctcatccgtgtcgtttgagaagcactcacttagactttttagaaaagagttcaaacaaaatcaattacgaaaacaacagcctttccttgaagcctgcattagacacttatttcccctggcttgctgagtactcccgtactcaccctttctctatataaataatcccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttc

SEQ ID NO: 54130 - DNA, 179 bp, Oryza sativa
tcctgcagcccccattgcgctcattagcgccaaagtttcctactattttgggatatgatgtggaaactcaatcaaccaatccattgttagtttatgccacaccattcatcacaacagcctcaagaagccccagcttcattttctctgcccttaccaaagtcaccagttcctataaaagc

SEQ ID NO: 54131 - DNA, 275 bp, Oryza sativa
agtcacaggagggggctgccaccgccctacctcgggcccgatcccccctcgggggagggctacgtggcgcttggggcagcctcctccctctagtcttgatcgggacgggcccgacccccaagcgcggaggggataaccgccactccaccccgggcgccatcccctcggggaagtgccatgtgggtctaggggcagcctccttcctccaaactcggtaccctaagctgggagggggcggcagccactccacccgagcgccacccttctcaagagac

SEQ ID NO: 54132 - DNA, 1501 bp, Oryza sativa; identical to SEQ ID NO: 49664

SEQ ID NO: 54133 - DNA, 156 bp, Oryza sativa
tatcaaatatcgtgcctcggtgtcgtcatcatgtttggatctcctatgacgtttcttccgcatttggtttctgatgtgatttcggggccggttttctaacaagtggtatcagagcctgcgggagatccatggtagaggtacgagggaggtgctcca

SEQ ID NO: 54134 - DNA, 263 bp, Oryza sativa
ggtcccccatggtaccatgggccggcccattggcaccacttcaaaccatgtgggtcacgtggtctgggttcctaacttcctattgggcttctgccttagcccatgggctaggcctactaattgctctctttgttctcaactctcctccagcgcgagagctgctctctcttgctcgtagcgaggtcgcagatcctcaccgccggcgatcccccgcctccgtttcggtaccgccgccgccgccgccgcgagagaggggagcagaa

SEQ ID NO: 54135 - DNA, 1501 bp, Oryza sativa
tatttgaaaagcattgaattatggataataatatatttcaaaaaattagaaataatacatgttttggtcccttgtgatcactaaataacaatttcagttagctatgtccataatatgagcaaacaaatcaattcacttgtacatgtaagagtttaataaagaaaatataaatcaatccaatgacagcgcctgaagtcaagtgaaaaagggtttggttcctaaaccaggttggaaggtcgacccccaccctggcgcgttgttttcaaattatttctttttcatatttttttcaacaaagttttgcaactaaaatggttggtttacaacgtgtcgcggatgatataaaaattatatattgcaactaagtggttagccatatatatttttttctatgaagttatgcaactatgtgattcgactacaatgtgtcagttatagataattatttctttttcatattttgcaactaagtggttggtctacaatgtatgcagatgatatgaacaagttgatgatgaatcctcctcctaattaagtaaaccacgtgaatatataaaaaggtaacaaatgcatattggttactacttactagtagttttttaaaactaaaccggcaggagaactgccaattatatttcattaaataggagtaaaaactcagatgggctacagaaaaagaaaaaacaacctctcggcgagtagagactcgccaagcctttccaccgtggccagtacaaccacacagcacacggagctccacatcactctagccaaactatcaacgaaatgatggcggaatccaacgatgaacatcgatgtcgagatgctgaagaggcggcacacagcgttgacatcacaaggcacgtgtcatcgttgccgagctagccgcccagcgacccagtagctccgactccatggcaatcatggcatcattgtaggcatcgccaaaccgagcaaagcaacaccaagctcatactttggacatcagccaagcccctgaagcgccaaagcctgtactagcaacacccacatccctagagagaaactgcaaatgttatcgttgccaagcttcgtcgcaccccaacgacgtagcagctccgactccacccgacagagacaaacgaagaagctggatgctaccaatacaagaaaggaaccaagaaggagaaggcctcgccaagcacctaggcatctagcgcatcgagctgacacaggagtccagcagcggcaaatggtgcatgggtaaggttctccaagatgatgcccccaaggaggatacaacgtgaaacgccgccatcgcccgtccggaaaccggatcacagtttttacctggagactggtagcggtggagaaaacgctataacgacgcctccaagaagggaatgacgccaaaggcgccaccgtcgtcgtgccagccaaaggctaagcaaggctttcgccaacgatttcgtccagcgccacctacccacacaacaaccgttgctgaaccaccacatcatct

SEQ ID NO: 54136 - DNA, 1501 bp, Oryza sativa
ataaagttacacctgggaaccctttgaaactcatatagataaagatgaagatgaagataaagaatacgtgttttacgcaaaacgatgtggtattaatatatgattaatcgagttttaattattataaacttgaaaaatatatttatatgatattttagagtaattttcatatagaaagttttcgtacgaaacgtaccgtttagcactttaaaaaacgtgccatgaatatctaatttcatccaacttttattggagaaaagaacggagccgagcagggttcgccctggaaaaacaagaagataaagaataccatctggcttgtgtacaatctactctgtcagcaaagcctatattaaaatagagtattataatgatcttgggactgggagaagtcctattctgatgcaaaattttacctatagaattcgtgcccaataatcctccggccataaaatttgcagacaagtcgtgcttagcttaaattggtcaataatttgggttttacccctaaactgtgccactaacctttacaaagttgaggctttcgttaagttttaccagaaataaacgtgctgtgtgggcggtttgctatcgtgcgcaggtgcgccaggcaggagtcagggccgtgatcacgcagacgtctctatttggggtttttgctacgtgcagccgtgttcccatatctgatacgataagaagtcggattatggtagtataccgtgcatacaccccttgtttttaaaatcctagtaactttaaactctggtaaaaattttattcgaaaaatatgaaaactttcaactaagaattgtaaaaaacaaatgattcaaaatagaaacttaaggtcccacccaaaattttataccttgtcgcatcaaacgtttaaacacctgcatgaagtattaaatatatgctaaaaaaataactaattgcacatattgcgactactttgcgagatgaatcttttaaggctaattgctccatgaattgataatgtggtgctacagtaaacatgtgctaatgatggattaattaggcttaataaatttgacttgacggatactgtaattaatttttttattagtgcacgaacaccccatgcgacactctactttacacctttagatctaaacaccccctttctacatgtgcggaaaaaaaaatacaccccctttctacttgtgcggagaaaaaattcagctcaaactagaaaatttttaactcgataagaaactttcaaccaaaaaccacataaatttgaggtttcaatacaggataaaagtagatttcgggacagtttttgaaaatttaaacagtaaatttgagtgaaatatggggaaagtccgtgggaaagataaaccttaacgttttcatttggggccacgagcacggccaccgcaaccatatcagtatcacattccatcccaaatcgccaaaaaatcccaccaatccactactattccactccacctcgtccagggcaagatccacaggatggcgt

SEQ ID NO: 54137 - DNA, 1501 bp, Oryza sativa
ttggtacgtagtagtaattatgtgacaaaattaattagtagttcatgtgatgtttaattttatatatacggccaatattatatgtaacaaatgaaaaaaactgaaatatcaatagttatatttgtagttattgatattgatattaatagtattgataattattaaatgtggtagaaaaattaaattaaagttgtaattaatttgtagtaattttaagttacaattaattagtagttcatgtagttatttatttagtaagaaatggaaaaggtataaatattcgttaagtagcgggaaatatatggtgtgcttaaacacatgcttaacattgtaggtagttatgaatgaacaaagaaatgcagtagtacgaagaactttgaaattgggacttttatatgagcaaattggttgaaaagaagaaggcaagacaaggtatggtactataatggaagacaatttgtaattaatagacagtttgtaatttatttggtattgtaactaaagtgcagttaaataaatttatgtcatggcaactagttttaaactataataaattggtagttatgattaatttgattatgtaattaatgaagtgaagttgaacttagttctattaatttatcatgttatgattaatttatagataattttgtactaactgatagttacaaatattttgtatttaagtaaagttacggtccgttagataatttatataatttatagttaaagttctaatatattaaatgtactcatccaaatttgcaatattagtattgtttcagaggtcatatctaagtatgtacaaacagtctgtagcaaagaacatgatgcggctaaatgagtgtcgttgtcctagataaagaatagaaagagctaaccaaaatgatttttaacttagctttcgtcaatgtttcttcggtgcaagtagtcatttgctgtattaaacttaattgattgtataattaatttgttagttaaacatatggattatgcagtgaactaaactttgaggcagcaattgttatacgagcaagctggttataaaggagtaggcgggatctgataaacgtaggtaaatattaaagacttcatatttatgtacgatatggtatggttgtgttgttttaagtattacatactcttttatttaaattaattgccatagttatgtttaattacgtgttttaattaattaatttgtattaatattattgtcatgtgtttattttttatgtcaaagttgtagtacaattataaataatgaattgcattgtcatgtattcgtaagtaaataatttatgtttacgtaattatttatttataattttttattacaagtacatgatttttggttaaatacagtggaaatataagtaagtagttattgataaagaatatttattcaaaaaaacagtatgcgtgtaaagtaattttggtcgtgaataggacacgtttgttctgtaagacttccatacggagtagtctgtgttttctacaa

SEQ ID NO: 54138 - DNA, 1501 bp, Oryza sativa
tgtcgaaacaagattttggcaatactaaaagggggtggctatcaagctggaaaagtggatgggttaagagacaaggaattttatacaggttcaggccttcttaatcaagaagtaataccctactcctgtccagggattgatccgccgagtatattattgattgtatgatctgggtgaaaatcgtgcccctaaaggcacccggacctctccttatataggggaaggggtccgtattacaaagcacagcccatattcctaacgaaataggtagttacagataaaatacaatcgtaaccgactacgatctcgggtatttccttgacatacaagtttagaattgaacccgagtccttttaaagatattctatctatacatgacaccccatacccagtcggactatacatgccgtgtaggtatggggtatccataatctccacagtagcccctgagacctttccagtcgacgaaatagtcttctcttataatccaaaacgaaaatctgagtactccgacttcttctgccctgatctccgagtatcaaaatcaaatactgtgaaggtctgaaaatagaaaaaaatcgggtgcatcgactagatgcacctaattaggtgtagccccgactatgtgattagttaaaaactaaacatatagtcaaggttcgaataacatccaaccgagtggttttacaaccaaatgttccaaagaataacacagccgagcacatgtgacatttaataaaacatccacccgactgctttagctttaatataccaaaaatggagatataaagaggcccgagtaaaaaatactccaaaggtccataaatcaacacatatgacaaaaatccgagtaaaaactctcaaagatccatcatatgtggtataaatatgatatcatgacaattgatgagtcgaaatagcctaggctatgactcacgccataatcaaaataagcatataacatgccgagagaatgactattcaaaaaccaatcatctcaacaaaacccaaacagcctttgcagcctaaaaaggcttacaaaagaagtataacacctttctgtcgggcacctttttatttgcatcatgataattccaaggaattatctaactgcgtcaaaaaggattttagcagcattgggctacaatgttgcgagcaagtattaccgaagcaaaaagcctaagtccctaaggatcacaacttagccacgctgatagaaagaaatgggctgaagtactgttccgggcctaggcccattagtactcccgataccctaataataccaaaaaccaaacaccgcttcgtcttccccaccgagactctcgccactttccccattccccgctacagtgcaaaaccgcaccggcgaaactagggttcaccgattcgctcaaatccgtcctccaaaactccacagaaatcttccgcgcatccaccgcattgatcccccatccattcccagccatttcgaaagcaaatcgcatcatccaattcgcatcca

SEQ ID NO: 54139 - DNA, 1501 bp, Oryza sativa
aggaaattgtggaacgtatgtgaatatgtttttttcgtatatatgcagggaacagaccggtcaagcttagcgttgcttttcactctcaggataaaggtagtggatccaaacggactaagcgcaaccagatgagtaatttggaagctaagcttgatgacctgcggagagagctctcttccagtaatggaggcgtattcccacatgctgttctttctgcccagcaaatttccctcctgaaccgccaaaaaccaaccactgttgctgaggtgaggtttggttcaaatattctcttatcctacttagtgctatcctaagtgtatatatggaccgtctctaatttatatgtacattttatctgcggcctgcagcttgaaaagcttataggaaaggttaagacaggtaagtacgggagcgcgatcattgagctcatgctgttacatattgattcagaagtagccggaggaaaggcctgtgcatcgaagaggcaaaagaaagataaggaggatgttatttgtgttgagagtagcgaggaggaggatgtttaagcgttatcatggtttttcttttgaaggctaacgaggcaaatttattgttgaaccttgagtgaaccttgagttgtgttgggatttaaacgagttctgaaatatatgtagttgaggaattacagtgtcaagctaaggcaaatatggaatatctagggaatgttttggtttattgtcattttcaactttaccaggcttggtattttttagaaaaagcaacaaaccatcgtccgctaattagctatcatatcacaatttgataattacataagttcacttataaaaaactataccaaaatttgacaatccttcaaatcgaacacattctaacattggccgtgtttagtttcatgcccaaaatttttttaatgtatatggacacacatttaaagtattaaaagtaatcaaataacaaaacaaattatataatcctaccgtaaactgcgatgtgaatttattaagtctaattaattaatcattagtaaatgtttactgtagcaccatattgtcaaatcatggcgtaattaggctcaaaatatttgtctcgtaatttacatgcaaactgtgtaattggtttttttttccgtccatatttaatgctccatgcatatgtccaaacatttgatatgacatttttagccaaaaatttttacaatctaaacacacccgttactaaaacttcgtagcattgtcatattttggaaaggttgacttttttttctttcaaaccctatttgggagagcttgaaactagtacaactctcagaatctctggctcagaatttttcccgaaatagggcctgactgatgttatagaccggagaggtcagaaaggcagcatgttggaaatcaaagatgatgcaatatcccaacacgttgaaatgaaacttgggaaataaaaatggaaatccaacaaaacttgaagccaatttggcatggtaatgagtggtgccgccagt

SEQ ID NO: 54140 - DNA, 1501 bp, Oryza sativa
gaattttttctccgcacaagtagaaagggggtgtatttttttttccgcacatgtagaaagggggtgtttagatctaaaggtgtaaagtagagtgtcgcatggggtgttcgtgcactaataaaaaaattaattacagtatccgtcaagtcaaatttattaagcctaattaatccatcattagcacatgtttactgtagcaccacattatcaattcatggagcaattagccttaaaagattcatctcgcaaagtagtcgcaatatgtgcaattagttatttttttagcatatatttaatacttcatgcaggtgtttaaacgtttgatgcgacaaggtataaaattttgggtgggaccttaagtttctattttgaatcatttgttttttacaattcttagttgaaagttttcatatttttcgaataaaatttttaccagagtttaaagttactaggattttaaaaacaaggggtgtatgcacggtatactaccataatccgacttcttatcgtatcagatatgggaacacggctgcacgtagcaaaaaccccaaatagagacgtctgcgtgatcacggccctgactcctgcctggcgcacctgcgcacgatagcaaaccgcccacacagcacgtttatttctggtaaaacttaacgaaagcctcaactttgtaaaggttagtggcacagtttaggggtaaaacccaaattattgaccaatttaagctaagcacgacttgtctgcaaattttatggccggaggattattgggcacgaattctataggtaaaattttgcatcagaataggacttctcccagtcccaagatcattataatactctattttaatataggctttgctgacagagtagattgtacacaagccagatggtattctttatcttcttgtttttccagggcgaaccctgctcggctccgttcttttctccaataaaagttggatgaaattagatattcatggcacgttttttaaagtgctaaacggtacgtttcgtacgaaaactttctatatgaaaattactctaaaatatcatataaatatatttttcaagtttataataattaaaactcgattaatcatatattaataccacatcgttttgcgtaaaacacgtattctttatcttcatcttcatctttatctatatgagtttcaaagggttcccaggtgtaactttatttcctcctactcttttgagtctgaaatccaaataagtcacatactccctcaataagtcattactctcaccgtttcatactacaagtcatttaaccttttacttagtcaaatttctttaaatttaatcacgtttatagaaaaatatactaatattttttaatataaataaatatatttaattttaaattttaaaaactaatttggtattgtagatgttgctaattttttctataaacttagtaaaacctatatttacctaagataaaagccaaacgacttataatatgaaacggagggagtagt

SEQ ID NO: 54141 - DNA, 1501 bp, Oryza sativa
catggacatctttttatatgttaaggggttaccaataatattctttataggtaattaatgtgtgtcttgtcctctcgacgtgtgaagccatgcgcgccttaccgtgacatgggccccatcccatcatgccgaatgacgtgggcgtccgcccatgtcattcctccttaaatgtcgatgatttctggccatccggctccaccacagggtagggatctctcgaacggaccggcgtggagaaaatgttggtccgagtctaagggagaggcaaaaaaacccctcattaatggcgacgggacggggcagacgcaagccatgtcccctgccagcagcaggcgcgtgtgcatagtgccctgtcctatgcctatccgtcgtcacatcggtcattcccgctgcaagcgacctgttagtgtgcatgctcgccacattaaatgtggcgtgccgcagcagacaggacctcattaaacgcggtagttggacgctgggaatgcaagcccgtggcacacacgcgaatcaaagcgaggaggggctcagggcgggccgacccctggctcgggaggcagccaccgctccaaccccgggcccgaccccccttggggggtgccacatgggtttggggtggccttctccctctgtacggggtacccccgggcccatatcaccgacggacgtagattaggttcgctttaaaagtggcccacaattttacatagattagattttctttaaaagtgtcccacaatttgattttgtcatctacggtggtgataatacaatctagcaaatcaacgaccagatttttttcattaatttgagaactcgtataaactgcccgattagtataggtacttttccttttccagaaagggtaccctcgtaatttatatatcctatatagttagaaccaaaagcttgacatgcatagggccacatacttacttactgtagttatattataataaatctaaatatccattagaaccatacatgtcacctagataaattatagacacattagatttttctcatgtttggtatataacaatttatgtgtcatatacaataaaaattttaaatcaccagatatcaagcttaaaatattatctttttatatattataatttcttttcttaaagcttttttttacatatttctaaatttttccgctgcaacgcgcggggtaatcgctacacccctggtttgactttttacttaatcaaactttgttaaatttgactaggtttatagataatttagcaataatcaaattagttttattaaatttaatatggatatatattgataatgtgtttgttttacgttaaaaatctaaagtttgcaaggaaaaaaaagtaaaacgacttgtaataaggagtagtagtatttattcatcttcttccccgcaccgcacctcggctctacctacctctcccgattccccaatctgcggtgtggtgtggtgcggtgcgagccggacgcaggcgtcgcctcgcctcagtcgcgc

SEQ ID NO: 54142 - DNA, 321 bp, Oryza sativa
tttgataggaacgaggaagtatgctatatctaaaggtatatactccggggcaactgatttcagtctgcccttgcttgggagtgggagggagatgttctttaaacaaactgctaaacctagggttacaagtgcctcaaaacatagggctcagcgaaacttcctttctatggccattggcggtcttaaacaactcatacgtctttcaagataaaaatgcttccttgtccgttgacttattgtaggccaggattttccgagcatctatgagtagttgcatctatcatgttcattttggcttgaatcagtgtcctgttcccaggt

SEQ ID NO: 54143 - DNA, 322 bp, Oryza sativa
gaggtatccctgagactttggatggcaaaggccttttgtgtgcacaaacgggtttgttacattacaggaatggacattcaagttgggggccggcttggtatgttttttttttctatggttgggcgagatggtggaggcggcagcgtgcagtggcagaggagattagagtaatacggagagagcgtggggactaatacagactgttgaaatgtgaggggcagatttttatttatattcctagcaagcaaagctgataataaagcgattagttgatatgagaaagagatagtatagcgtagcagcaactataatatactatata

SEQ ID NO: 54144 - DNA, 1501 bp, Oryza sativa
ttagtggcaattgcaaaatcttataccagtgcatgtctatgcgttggcttgctcatagcccacagtataaatatgcgtcggtttatcataaatatttggcttttatgacaacattcgctcaaacatttaaaattgcttgctcatagcccacagtataaatatccgtcggtttatcataaatatttggattttatgacaacattcgctcaaacatttaaaatttcaacctaataatttctcaaatgcttagttttgaaatataagaaacagtggtagctcaacattcagctgaatattagattttataaacttattctactactataaaattgatgctcaaaaaattaaaaagtttggtcgaatcttatcccaaatgctagatatttatgacttgagagagtaaaattaaagactcgatggtattttcagttgcatgttttatttacccttttatttaacacaaatcctcaataggatctacatagtgtgatctatctaattaacggtcagatcattctaattaatatagtaaacatagatctagctatttcttagagtgctcacctgtacagttttgttattagatgttggcgtttggaagagcttgtgcacacgattaatagtggggacttaattggaatgggactttagataatataattaattttgacctttgcttaagaaaaaagttgtaactaattattatagaagttgcatggcaaacgattgcgaattataaaattacaacttaagtaaaaataaaaaactacttagagtaccatcttaaaataaagattatttccatatagagtggtgagaatatgcataaccattgttttttcccaataccttgcaagttatattgtcttccgcaaatcgaaaacggaatcactgaaatcaactgtagatcattttgtccattgaatttctcacacatcatcaccggtgactaacgtcaaaccaaaatagaagataacgtcgaagggtaattgagcagtgaatcaatcattcgccaagatcttaccaccgtcatagccattgaagctaatccaacacaaaggacacccaccagcaatagaacctccaatgcgacgcctctaaaatggtcatgccatctatgatatcatcattgctattccgtacaatttgaactaggttttcacctagagtctttcacccaaagagtctacccctaaacacgatgagaggaagggagcgtcagtgacatcgcctcaaggaatgtgtggtgctcacaggcatcaccggtgtgggtgctcccagcatttagggcctcagttgtatatggtgtgggtgctcccagcatttagggcctcagttgtatatccacgacgatctaaactttgacctcctcagcattattaatcatctcatccttttcagtttttctcctcgtagaaatgggcaatactttagttaattcaatctattggacgatgtaatgagttgggtacttgggtgtctggagggagttcaatcacga

SEQ ID NO: 54145 - DNA, 404 bp, Oryza sativa
tgaaggtttcaccaagtatgaacagccagaaactgggtgcggcagcatagtggagtaatcgggtaggtagctttatgtggtactgaaggaatgcactatcaggcatgtacagaagcagcagcagctgggattgggctggtaaaatttaggcgaatggtcgtgaaagtaaatgaatcagaaggttcctagccttgttaagcaaggcttccccacctaaattttaaaacgacatggcagctaaaaacccaacaccgcccattccctcctatctagccagtgcgccattataagcattcgttacctccgtatttccatgcactgcactgcactctcaccagctcttagttctccttcccctgccgctggtcacgcagcaaacatggccgtcctgccggagtcacgcc

SEQ ID NO: 54146 - DNA, 1501 bp, Oryza sativa
catctcatagaaattttttatagaaaacgttatattacaatggctttactcctaaggccttaaaaaaatttgtgtacataatttatgaacagtgctatatgtactttaaaaagttcatacaaataaagttttcaaccatttaatttaattagtagggatttatataaaataaagaccgaatgacaggtgctacatcaacctttgtagaaacatttataggaaaaggttttgtgtataacttttcccaacatgtaaaatcattctaaaagtttttccttcaacctaatgaggcctaatcattttgtaggtgaagcccaagcccaacgtgcgacgggcctgtttgggaggcctacgatccaatctcggagcattcccaggcgaccgagccggcggcgacggcggcggcggcggcgtcggtgtcgtcttgcccccagacgcccaacacctcgactgctccagggcgcttcgtcctcaacgacggcgcctttgcacttcttctccaccttcctcctccaggtccgtcttgtttctgcctttactggtcatcctctcagatcaagattcgtccttagctaagtattgaaatttcgccttaatttggtgtgcgattatttcctcctaagattagattagattgtgacatgacttgtgccttccactcctgtcatcctcttagattagattgatttagtattttcgttcataattcgggatagtttcctcgatctgtaaatattttaattgatttgtctgcaatgttgtgaaaatcttgctgaatgcatggaatcttcatgcaaaatactaagatattgatgtggcaacttgccatccctagaccaactagtcgactagccggccacctttgtgaacaatggttggtaatacgatttaactgtcttctattattggggacaaataaaatacctttcttctctagctatgggtttccctgaacttgagtatctagtagtctacgcatcttacaccaccaacaccgctctagagtgtttcatgatatacagcaataagctctacggtttccgcttttgtatcacttgacagatgctgcttggtaatgttggggaaatctgaaagtaggctgctgtgatttgcatgagactgtcctgatttgcagaagcccggaattgacaagtaactttagcactgctttagtgaggtacagaattcatacctcccagaatggaggttgttgattcagaaaatggtagtcaaaatacagtagagtgtcaagctcaaatacttgcacattactgcctttctggtacgaggtttgataagatcgtccagaaaatgttgtttctctgcatccataaacgccagccaggtcacttctggaggctcatactggccgttgccgacgttttatataaagaaggtgtcccattttaaggagtaaaaggtaccaaaccttaccgtgcccagttaattagggaaaactgagtgaaaatcaaacctaaaacaacacatcaataactaacct

SEQ ID NO: 54147 - DNA, 337 bp, Oryza sativa
tctaaacaaaaactcaaaatcccttatattatgggacggagggagtacagatttgctaaatatcattcaacggaaatttagacattaaattttacagattttagatcgttagatccgtgccaaaattcgtgcactatattcttcaactccaacgagcttatccttttctcctaccctaacgtctataatgccctaactccaataaaggacatatggattaggatttagggttaaggttgggtagcaggggaggttggggaagagggaaaagaggggtctcccaaggacatagagggatgattgtgggcgacggaggaccaacaatggacggtggaca

SEQ ID NO: 54148 - DNA, 436 bp, Oryza sativa
ataatttgatcgtactatttgattcgttacaattaaatctttacaacaagacctcactcgattatattctgattattttttaaaacttattttttaatgttgcgcatagttttactcagttgtttcaataagtatttcttagtgtttcactattccatttataaatgttacacatatttttcccacagtctaaaaaatgttttagcaaattaattattcttgtgaatatattatgtttcacatgacttttttaatgtttcattagttaggactaaatgtttcatgcagtaattgtcgatgttgcagtcagtattatcgaaatgttgcatctctttgaaacacatttaattacatgatgaaacaatttttctataaggggtgaaacaacgctcgattttttatcaaaatataaccatatgagatcttgttgctaaga

SEQ ID NO: 54149 - DNA, 1025 bp, Oryza sativa
ttggaccaatggatgatcctgcgtgcttgcagctgcatcaatcctctgtttctgaagctaaagccgtctccggcgccgatcgagatctatcgatgaatgatggatgaagatgaatggccccttcctctgccactttttgaatgcatatatgtgcacgtgttaaataacggttggatcactatcagtgtgtcttgattaattaatcaaccatgcatgacccatgaagagccatgctctgttttttacgtcctctgtttcgagcgatctgttgaagagagagcactgctctgtttttacatgttctgttttcctgtgaagtgttcaacttgagtactctgcatttacatgatctgtttctatgtctataaacatttgcacatgttatttgcatacaaccttaataatcgtagagaaatttgaaacagtctaattagattggtgattacgatatgcccttggaggagaagaataacaaaatttagtactgcaaaatatagacaagatatgttatttgtatttttcttagtgtgtagctgcatgtttatgtactaacttatattatcacaaattaaaatactttactaattgttttgatatttttatttaactatttacaccacatacatagactaggtgtaattttatcggtgttaataaagtaatcacaaaaaggatatcgagatacggagtagcactatattttctaatgtaaaacttagtacatttatactagataaaaattaatgtcaacttttagtactactttatcaaggacagtaaaatttataaaaaaataaatatttccttgcacctgtttttcctgggaattaactgttgaaaaacaatcagttgtctgttagtacgatacaggcagcggcacacagcaaaagattagctagcttctcctgtgtccaccaggttattatcccacacaacaaaaaagaaaagcagatatactcatcaaagtaccctttccttagaccatagtggcctaattccctgacttttacgcaaacgacctgaga

SEQ ID NO: 54150 - DNA, 574 bp, Oryza sativa
tggagattatagtattctggctgtagtggtttacttcttcttgcggattatagttttctgtgattttctgtgaagttcgatccattgctttgctatctaggtttccttttcattggtcatatactctgcttccttccttgatacttgagttaaataaaatgctaacatcagcacaatctgctgtatttcgtacgttcaagtagttgtagttactgtaactgcaataactggcgttttgtttttatgaattatcaccgaaaagaattccttaatgtatctctaatcacttaatcagtatgtaaatcgaccttcttttgtggagtatttacatataacaatgatgattgaccatactcccatatggtgcaatagatctgttattgaacagacttatagtttgttttttcacattggacaaattgttctccttgcttagctgaattattctagataacttgtacatcattcctttatcttgacatatctaaaaaagtcctattgcattaaatgaattattggtagcaattcttattgaatttccttttatccttgcctctttgtacgattctccagc

SEQ ID NO: 54151 - DNA, 1501 bp, Oryza sativa
tttcttatgtcgtgtatatcacatcaatattttcttcttctttgcccaggcagtcgcatggtgcatatgcacaccttggagaggctagtgatgctagtcgtcgctagagtccgcagtacggtgtgcttgcatatatatatatatatatatatatatatatatatatatatatgcgctaataagctactgcgtggatcagtaagccgttgaatctgacatgatgagtagtagtttgttaatccaacgggataggtgattcgacaatattgatgtgtatgaagatttccatggttcaaagatatgcatttgcccggtcggtcgaaagaaaggccgaccaaattttattaagaaggggtatgtacaacgtacttaccattttgctagggtggcaagctgatgtgcagatatcctaagtgactattttttaaaaaaacttaaattgcacccactaacaaggttttaataccaacatagtcaggtttcattatcttgtactcaatcacagccaacaaccaatatttatgtacccacggtataatttactcaagaagagggtagaagaaagcaaatgaaggaaatgatgacaaggaaaaagatggaccctgcaatgagcccttccttgcatcacaattaatctgaccgaaaaacaaagaaaagaaaaaaagagctaaaaacaaattaaaagattgaagcagaagaagcaagctaagcacatgatgaagagcaaggcaaggcagggataatctttattttaaaaaaggaaagaaaaaatgtctgctggtagctatatatacgcgtacgcgcgggcactgactacttcatcaaccaatctgccctccagtgtgtgttagtgtcgaccactcacatatggccattgttctggatgcgttcgcgtcatacgtcggcgacctgctcaagcaggtggccaaggacgaggtcaacctcctcttcggcgtcttcggtgagatcgccaccctccacgacaagctgcgcatcctcaaggactacctcgctgacgccgatcgccgacgtatcaccgaccagagtgtccaagggtgggtgacgaagctcaagcacgccatgtacgacgccaccgacatcctcgacctctgccacctcaaggccatgcagcgccagcgcggtggtggcagctcatcctcctccaaccctgtgggctgcctggactcgctgctcttcttgctccgcaatccactcttcgcccacgacattggaagccgcatcaaggcgctcaacaccaggctcgacgccatctgcaagagcgctgccgctttcagcttcctcaagctggaggcctacgaggacatggcagcgccccgacggtccagcgccaccgaccgcaggacggacccggtgctggggaaggagagatcgggtgttgttggggagaaaatcgaggaggacaccagcgcgctggtgcaaaggctcaccaacggcaacacggctatgacaacgatcatggtggttgccgtggtgggcaccg

SEQ ID NO: 54152 - DNA, 1501 bp, Oryza sativa
cagagtccggcgagaccgcccatggctgcagctgcggttccagctgcaggtgcaacccttgcaactgctaagatgcctgcctgcatctaccatctatcatgtgtgcgtgtgaattgtgatgcagaaaaataaagaagcttggccatttgggttggtgcttgaccaatatatatggggtgtgtgtgtgtgtgtgatgggttaatcgatgtgctatgttatgggtttccactattcacgggaaaatgcttgtaatggtgtacccccaaataaagtgatgaaatattttaaccgggttgggctatatttcctatggaaatgtattttgtaccttcaatagtggctcattacgaaattagtccaataattcagtttaatatttacccggttacctgttactcgtaatagtaataatatactcatacattataacattgtaacataccaagctcataaattagaaatgagctacaagtatgactggggataaaaacgttggatacgagtaccacgctgcgcgtggtgagagaaaatgtaaagactacatttttttaactgcagtagtgcagttaatctgtttattagtactattattatgcaagcaagacacatctcacctcaaagaaaaagggaaaaaaaagcagagagaaaaagtactacagttggaaacccaatctagcggctattcttgcccccaccaccgccgccgccgcctccatccgcctcgcctgacctaggcacacgctccgccgccgccgccgttgcccgcgcagcgcattctccattcccttctctcgcggagccccaatcacacgagagaaaccgccttcccctaaaccccggcggcggcggcggcgaacatcggatcgtggacgaggcctcctccaccgaaaccaaacccctttgccgaggtctacctccgccctccgctcccttcgcctctcttgtgtttaatttgtccacaatctccactacaagatccaactctgtttgattcttctggattttactcctcttgattgcctagggttcgtgtacgtctttctctccttaggctaatattagactgattcggtggttttagcaatctagggtttgacggtgaatagaggttcaaatttgggcgttttcccatcctataatctttagttattccaggtctcataatctagggtttcaatggatctcaagggaataatacagggtttgatgtcggcatgtattcaagggaaataccacctctgtttcatcacaacctattttgatgcgtcatgttgaactgaatctggctggcttgacgtatgtgtggatggattcattgtgcagtactacgaggcaagaagcacagagatagttgaggcaggggaacctttgggagtgtgctgatatgccactaattgcttaacacaccgagaagcttctcggcatttgccaaatttggcttcccaagacaggtgctcgcggctaactatcatctattgaaacacttgagttatttttgtat

SEQ ID NO: 54153 - DNA, 1501 bp, Oryza sativa
catttcagcaacactataccgaacatcttcttcctcctccttttcctccgttacctcctccatgtccaactcttcttcatcgtcctcccaaaattcatcatcctcatcatcaaattgatcattttcatctacccccacctggtgtggatagctagtgccatcataatcttcggtgcgcacaaactcagtcatgtaatatggttcctttccccgatgatttctgtttcctctttcacaatcattttcagcagtgttcttcttggaagaaatatgttgactggatcggctgctatccagacctttcatcatcttgctgccaatacgactggagctgaatggtgagtgttcaacagcatctgggatatcccagggatctagagctctggttggcttatttacagaaagagaaggttgctccccttcaactagatgaataacagtgcctactggtacctgcgcaatctgtcacaaacaatagaagaaagagatgtgtcaccagttttcttttgatagagaatcgcatatatatatatatatatacatatactggtggtaaccttgtcagaacctcttgtcccgatctgattctttgaaactccattggctcctcggcttgctttctgaaaatagagcagtgtacaggcatcaagtgaggtaagcaactaagcatgaattttctccagacatatatctcaacagaattgctccatatcatatgaaactactccataacaacaacgaaatatttaggctctgaagctagccaaaacaaattagtacttgatacaatttcaccaacaacagttgaacaaaagaatttccaaaggaaacacatgataatcagggtggataaataatcttggtcagccttttattgtaacaacctcattgtgtcttttatatatgcaggcatatatcaggatccttcatattctttcgtgatgatttttttttaaaaaaatctttaggatcatgattgggtagggttagccccttttagttcaacaagttcagattctcagcaacggcacagtgtttttaggaacacagatcctaaatctagcacaatatgatgttttcaaacagcaggaaaccaggaaggtgcagaaaaagtatgcatctctggacaaaacggacaatatgatggttttaaacatataccatgtgatgttgcaaaccactgaaatcccagacagaccttgaacactcaagaatgacatcaccacctcttcctccattaccacctgcatatttcacataaggaagatctgatctggctccattgtttaagaaagaaaatcctgactgactgactgtcaaattagaacaaatagcatgaattatctttggccaacttaaatagtacaagcctagaaatattctgatatagtcatgtgtgaagcctcattgacagggcataactaaaaagaaatccctttatcaaggaaacaacagaaacaactaggcattattacactacaaacaaatacacgaaaaagat

SEQ ID NO: 54154 - DNA, 1501 bp, Oryza sativa
cggcgggacgaggaggcggcggcggcggcgttcgagtgccggacgtgcgggcggcggttcccgtcgcaccaggcgctcggcggccaccggaccagtcaccttcggcccactaccacaagcggcggcccggcccgtccaagcctctaatccacgcgtgcgaggtgtgtgggtttggctttcagatgggccaggccctaggtggccacatgaggaggcatcggcctagaaatattgatctgggccataagcagatcgtcatgccagaattcgggccagttcctccctgcagctgcttgatctcttcgtttagatacactcaatatacagtggtttatgtgctgtgtgctatagtaccgtactgtcttgcagtatactacagcgaaaaaaaacttacagccatttagtacaaaaaatatttaggaatcaataaaacagatacaatgtttagcctatgacaatgtggatgcactacttaataaactttttttttctaccaagttagtatttgtgataagcttcccttcctcgcgcgcactgatgactcagaaacacgcacgcaagcacgaattgaagttttagtcagtagtaggattttgtttggtcaaggtaccgcccctgcctcaaatcaagcagatgaacaagaaccaagcaaccaaagattggactcatttgaatggaatatttaggacttgtttttagcaaaattttttgtctctatatgtcaaatcggatacgaacacacatttaaatattaaacgtagtctaataataaaacaaattatagatttcgttaggtctacatgtcacatcggatacgaacacacatttaaatattaaacgtagtctaataataaaacaaattacagattccgtcatgaaactgcaagacgaatttattaagcctaattaatccgttattagcaaatgtttactgtagcaccacattgacaaattatggcgtaattaggtttaaaagattcgtattgcaatttacacgtaaactgtgtatttggtttttatttttatccacctttgatactccatgcatatttcctatgtacagcacacgacttaattgcatgccacccagattatgaccaaagttgcagctgattatttcgttctcgatctagccagctcatcaatctttttttctctgcattcacttgtatacatgcatgcaccagcactactgcatcccgtgctatctgcagcacacaggaagagaccgactgacttcaatttgtacacggcgccgacatgatccgtacatacgtacggtatgtctagctagtgatcagtgagctacatatactgactgtcactgacttcaatttgtgtactgaatgaactgaattagtgtgtgcgtgttgtatcatcggcccgatcgagaagatgtcgaagctccaactccggccgcctctgttggctactctgcattgcagcttgctcgtgctcctcatcatcaatggcgccgccgctgccggcaagaccggcgagc

SEQ ID NO: 54155 - DNA, 1501 bp, Oryza sativa
atttttagttcatcgattatgcacggaagaacatataaacacaagtaccatttagcagtcagatcgactagctactataattcttgtaagaaagagtaatgcatgctaaaaaatatacaaaaatataattatagcacggaaatataattccatgctcgttaattagctccaacaaaagaaattatcacacgatcgagaagcatggagccgatgaccgaaatataatactactagttgcgtcgtacggccggttgaagtagataggtctcgaagttttgaccaatccacgtcgacttttgtcttgttgacggccaggccagcaattgacgtctatacgccatgcacatccgcatcagcatatattaattccatcttacgtgccattgtcaaaccgcatatatatatatatatatatactttaatactccctccatttcaaaatatttggcaccgttaactttttatagcacatatttgaccgttcatcttattaaaaaaatttgtgaaatatgtaaaactatatttttttagataatggaaatggattacatctccggcttctgtcataagacacacaaccataagtttaatagtaataaaaatgtaagataaaagtaaatcaaaatgagaaataaggtgatgggataaatccccaactcccctttattattgactagcgttaaaccacataaaatattttagctagcaattcttacggaactacgccacccatagtggaataagagacccttggctaccgatttcaagagtgtagcaccattgcacacagtatcctgcttctcctgtggtagcattgtagaccaaaagtggagccagtaggaagacatgaagataacctgcattgggttagataattgtttaccattaaaaactttatcattacgacaacgccaaattgaccaacatacaacactagctccaattagaatcatcttcttaatggacctagatacctctctaagccaattaccgaaaatgtttttggcattacgggatggggggatattaaaagaaaaaacacacatctccaaacaaactgagcgacatgacactcaaagaaaagatgtaaaactatatgtgtacatgaaagtatatttaacaatgaatcaaatgatatgaaaagaataaataattacttaaattttttaacaagacgaatggttaaacacgtactaaagagtcaacggtgtcaaatattttgaaacggagggagtatatatttatcaccatcatgtctcttagctagcgtacgtagcgtgtgctcgcggcaactcgtacgaaactcaccaagcaaaagaaaaaaaaaagtgccactgaaagtttaatttgaaacaaactctcgatctatatatatgtctatatcgatctgttgtataactactactccggccgggccggcgccggggcccgcgcgcctcgtcggtggattacttcaaacccaactcaaccacacgctagctaggctaataattcttacttg

SEQ ID NO: 54156 - DNA, 1501 bp, Oryza sativa
cggagctcgacgtgcagctctcgctgtcgctggcgtgcggctcgacgacggcgatgtcatcgtccggcgatgaggaggacgcggagccacggcgtcgccggcgggacgaggaggcggcggcggcggcgttcgagtgccggacgtgcgggcggcggttcccgtcgcaccaggcgctcggcggccaccggaccagtcaccttcggcccactaccacaagcggcggcccggcccgtccaagcctctaatccacgcgtgcgaggtgtgtgggtttggctttcagatgggccaggccctaggtggccacatgaggaggcatcggcctagaaatattgatctgggccataagcagatcgtcatgccagaattcgggccagttcctccctgcagctgcttgatctcttcgtttagatacactcaatatacagtggtttatgtgctgtgtgctatagtaccgtactgtcttgcagtatactacagcgaaaaaaaacttacagccatttagtacaaaaaatatttaggaatcaataaaacagatacaatgtttagcctatgacaatgtggatgcactacttaataaactttttttttctaccaagttagtatttgtgataagcttcccttcctcgcgcgcactgatgactcagaaacacgcacgcaagcacgaattgaagttttagtcagtagtaggattttgtttggtcaaggtaccgcccctgcctcaaatcaagcagatgaacaagaaccaagcaaccaaagattggactcatttgaatggaatatttaggacttgtttttagcaaaattttttgtctctatatgtcaaatcggatacgaacacacatttaaatattaaacgtagtctaataataaaacaaattatagatttcgttaggtctacatgtcacatcggatacgaacacacatttaaatattaaacgtagtctaataataaaacaaattacagattccgtcatgaaactgcaagacgaatttattaagcctaattaatccgttattagcaaatgtttactgtagcaccacattgacaaattatggcgtaattaggtttaaaagattcgtattgcaatttacacgtaaactgtgtatttggtttttatttttatccacctttgatactccatgcatatttcctatgtacagcacacgacttaattgcatgccacccagattatgaccaaagttgcagctgattatttcgttctcgatctagccagctcatcaatctttttttctctgcattcacttgtatacatgcatgcaccagcactactgcatcccgtgctatctgcagcacacaggaagagaccgactgacttcaatttgtacacggcgccgacatgatccgtacatacgtacggtatgtctagctagtgatcagtgagctacatatactgactgtcactgacttcaatttgtgtactgaatgaactgaattagtgtgtgcgtgttgtatcatcggcccgatcgagaagatgtcgaa

SEQ ID NO: 54157 - DNA, 1501 bp, Oryza sativa
acgtggtgaacatgccggagagaggatggggatgacggaaagattgacggggaggatggaaagagtgacggagtggcatggtttcaattttagaaatttacagtggcatccagcagatagcgtgaatagtagtggcatatttttaatttgtcatatttgcagtggcataaatccaattaacccttactttttcaactatcttctttggctcttttggaagcataggaataggatcgactcctaacaattaatatactagcctaattaattaattgcatccaaatgtatttgaatgctcaacttggctttgatcagttttgtagctaccaaacggcaaactaaattcactagtgcattcaaccacttggataggcaaaagccacaggtttgttccgtatttaattttgactggtgactttagaacaaagtcattgtattgttctgttgtgaaaatgcccaattgcccataagttacttctaaaatatcaggcaatttttaaatttcaacaaaggggtacctgtacccgaaaccaataatcattaattgcagactacatagattgacagcgtatttgtgtatcacttccataaacaattgatgagttccttcgcaagattgaatatgtaaatcaacatggaccaaatctaagtaagtttcctccctgtgggagacaacacggctggaagcaaatttagctcactgtttgcctttttatatattatcaaaacagtgttcaagttaagtatttttgtcatacactttctctgatttgataaacaaagtctcagtctcaccattggttttagccagtacacaagttactctggtccatatccaaccaaccgaacaagatgcattactaaatcttaattaagtcttggtcattaattgatattaagtacaaactaacactctcctaccagagaaagatatgaatgccacttcaccaacaaacaagaaaagatgaacattttgaatatccaacacgcttaagtttagttgtaattagtctgcagattcagtttttaactagtatcttatcatttaaaagtaatactaaataccaagttgtcctgaaatctcaattatgatattttccatgatttaataattttataattttgaactagtaaacatcaagatgataacatggattgtttaaaatagttatcatgtgacacacgagttaatggccaatagaacatcttacatggttaatttcctccttctaggagacaacacggctagaagcaaagaaatagagttttagttcagcgtttttgctatccaatttctgttaattatttgttaaacatattaagtctgactctcattctgagtcaattggttagcccgtttctttgatcaatatccaatccagtaaagatgattcgatgttaagtctaggtcattaatatttgttttttttttggatagtggatattgagtagtacaaattaatacttttcaactatggaagatagaagatgcatgtggcac

SEQ ID NO: 54158 - DNA, 1501 bp, Oryza sativa
cctgttgttgtagtacccggggttgccgttgttgttggacatcgccggaagtcggtggcgtggcttggctagctagattaaccgtgggcaaagtgattagcggtaacttacttatcatactactcctacttatggaggcttgacgacggtcacaaggattgtttacttgttactatcgagtggaaatctgtagttcatatcgtttttatcgttttctctggttactctcaatgctctgggagatgtccaaatctttactatttgcagcacgattgctctttgttcatcatcctcaattcgtagaattagactactttcatctgcatacgaaaaaccatgagcaaagttgtgtacagttctgcatttcatttcaataggatattgaaagtcagggtgtcaatctaaatcacctgcagatgtgcataagaatgagtaagaatttaacagttactgctagattgatttgcagacaaacatttcatcattgatcggattgcatcaaatccaggcaaaaaacgaatttcatttctgcatctccctccaaaaactgaagcagagcagctgcttacactccgctacggcaccagccagccatttggttaggccggcgagccgcccgcccacagctataatatcgcggtggtgaagtgggtgctaggtgcgcactaggatttcttctagggagacggagatggagaggtggtggtggagatcgccggagctgggcgtggtgtcggcgcggcagagcgggcagctggtgttggcgcggagccaggtgccgatgcagtccacgtggaagtagtgcatgcactccggcagcacgcgcaccgcctcgccgtcgccgaactccgacaggcacaccgggcacatcgcctcgccccactcctccgccttcttgtacgggcacaccaccagcttcgcctgcgacgacgagctcatcatgtcgtcctcgtcgtcgtcgtcgtcgtcgtcctccccctgctgcacgtgctgctgctgcgtggaggtgccccggcggcgtcggcgtcgacggcgcctcctggtgtcgcagaaggtgacgaggacgcagtggtgcagcaggagcacgacggcgacgcacatgacggccaggaggccgatgaacaccggcgacttgaacgtcgacgcgctcacccccgggagagacatgggcgacgaggctttgatgattgagcccgatcgcgatcaggtgtcgctctgctttgcttaggcatggttgttggccatggcgactacaagacaaggtgttcgacggttgctacgaggttggaatggctgatgtgatgtgatgccgccatttgtagccttgtgctttggaaccaaatgccacgattttttttatttttagattttgaaaggaatttttgttacatggtcacgtacacagaaatcacacaaataatttaatcgcaagcttattaattccatcgccaattgaccacatatatggatgatggcttgatcgatcagtcatcaattggtt

SEQ ID NO: 54159 - DNA, 1501 bp, Oryza sativa
ccccaatatccataacgaaatattaatagaggatgccggtgttgtgttatgctgacgaataaccccaatccttagagagcgatggaacatatccaaagggtggttccagatcaatgcaggtggcactccgaaggacgacgccatactgcagttgatcgccggtgacccatttgggatcaagccagtggcctcgcatacaacactgcttgcagccttgctatgactgcctcgcatacgtcgacgaacattagagcggtacaagggacaacgtccccctattttccctctggttaaataaaaaacaggcgcaaatatgtcaaacaaatggccagttaggccgttacccctaatatttaacatcggggtaatctttaggcttattatgtttagaagattagaaaatctacacaacatactttgtcttttttcgaacacaatattttgaaactatgaaaacagaaaaaggtaccgatcctacaggaatataaaacacatgaacttaacatgattgatgacttatttggatgattcacaacaaaataacaaataaatttagatggactgtagggagggaaggttgcattggacttctcgaagaagaaaaaaagaaaaaaaatgcttgagcttatgtgctactacttcctccgtttcacgatgtaagactttctaacattgcctgtattttcatagaagttaatgaatctagtcagatatacgcatctagatttattaacatatatatgaatataagtaatgctagaaagtcttacattacgaaacggatggagtattttagcaagtatagaaaatcaactaataaaccaggaaaaaattgacttaaaaatctaaggccacaagtctagcataaacagaaaggggttagagtagtactagctactaattgttttcggtttaaacaaatcaaaattagcttccaaccgaatacgtttgggattcaaataagaaaagtttttttttttgaaacaactcaaaggagaaaagataaacttatttgtatcgcgttgacacggacgcaaagaaaaggtcaccccgccgcatcgcgtcacaactcactaaaacgcgttacggggtttacttggtgacgaatcaatcgaaacccaatttatcaaatccatcgcgaatccccaacccaaccgaatccacccaagaagaagaagaagaagaagaagggttattgcatcgatcgcagcgagggggaaaggggtaatcgcggagcagatcgaaacccgaatccaatcgatcgagccgccatgagcttcatcttcggcaagcggaagaccccagccggttcgtccttcctctttctcctccttaccacatctgcgtgcttcttcccccccgattgggatccaaactcgagatttttctcccgtcgccggaagaaccctaatagcttccttccgatccaacggcgttaatcttgtcggaattggttcttggagcgaaatagaataagtctttgtgttcattgaattcgttt

SEQ ID NO: 54160 - DNA, 1026 bp, Oryza sativa
aaaaatatgtgtcaaaaaagaggaaaaaatatgtacttagtatttgcaaggaaaaacatagatatatagcatcaaaaatgttgcatgtaaccacattatatctttttaattatatcattcccatctatataattatatgctaattattaacattatagattattccatcgtatattacccatgaacatgcataggtgaatcaaatatataataaaagaaaaaacaaaacaaaaaatatattaactcatatgttaacgaacgatggtgatagacgagcttagatataaccggaacaattcgcattcgcactgtcattatagtttaagggtgtaattcagactatttccttgtaaaaaaagtcacttccacataataaggattcatgatacaaatttaatcaatactaatttagtaaagtgcccgcgcatgtgcgcggaccatcttcctagttaaattagaaaaattgatgactatttagtggacatgcaagaaaaaaggggaaggatgaaaatcaatctcctcatcgttacaatgaactggagtatttgaattacaagaaataacaagatatcactactgtagatatgcacaaaaggaaccggcacgtatagtgcttttgtcctagacgcgcgtctgcggggtgccatcggctaggaccgacacctttgtggagagataggtgccggttctaaacaaaaactagcacatatagtcttaatgccggttttttcagaagaactaatatctatatataatatattataggtctctcctctctcggtctctctccgcctcctcccctctccctctcccccacgccgcagccggccagggagcaacgacgctttcgtcgcgccgccgccgtctccttccaaaattcggtcgatcctttccttctccggccgaattgattgaggggaaacaatctttgagatatcctctaccttttctcttttggaatcatcctctacttcggtttggaaatcgatggattcgagtttgtttcggattcgttcttcccgaagt

SEQ ID NO: 54161 - DNA, 1501 bp, Oryza sativa
gctaatccttgtgcaagtaaatggtgtaccccatgcttgttgataagtttatgttacatccatatttgctgataaattttgctacaaaaggtaggataaaactttgcacatgggtacatctttgtacaaggaagactagcagccagcttactagaacgaaaaactacaaaaaggaccacatatttgtatcctgtgtctgtatgcacggtcgtgtacatccatatttatacggttggtgagaaaatgctgaagaatgaagcagagaaacttgtttgtttcccggcaaatatggtctatgaagcaaggttgtatgtactatactctactgaggaccagacaaagacgcatcttctcacctactagctatgctacctagcttcatttccagaacatattggtatatcttttgcaatagtatgtctgaataatacactaatcttgacgtagtagtagaccagatcaccagagggtccggtgccatggattgaggctacaagtgtcattgttagtgcaattgattatgtctagcatgtatagtgtacatgtatgatgatatagcccatgtctcgaggtgattaaagcttttaagctctcaaggttggaaaaaaaaaggtgagaccatgtgtgtgtacagtaatttcagagtaactgcaacggcaaactgaaacaagtgtgaaagttttcagttgtcaatttggggttcagttttgtttattggagagaatcctggagtcaagtggagattccaacaatcaaaatttaaaaacaaacatgacctgaaaatcaattcaagtcctctagaataaaactaatgttgtgattccttaacaccctcatttagctcagctaatgtaatcatcatcatcatcatcatctctaatccaatccacaaatccctccaaaggccagcttaaatatataggctgtcttgaggacaatgttgatttgttttttgcagaagcaaacatgagagtccctctctccccttccacattccacctccccatgtgatgtgaagccctcccctgtcccctccctacctccatctctctctccctctcttgaacactgagcctctttgcttacatacaattcagtagtgtagtaattcactgcagcagctgcatttgttttggtgctgcactcactcactcgtcttttggtttcttgggggtcaactgtgctgtgctcttccatctttcctttctcctcctcctctgcttctttgattgctttgcactgtttcagctgggtgtgtgcttctcctccattccttggctcctgcaacttttcactgttcttggcaggttcctgtgttgctttgtgttgttgctcttgttctttctgactgttctcttgttcttccataggatcggatcggtacaatacagccattccatccataaaggtggccaaacctcatctttcagattcagcttggttgttttgctgcgtgtgagcaagttttctgagcttttcttttgtgcaagaagcaaagaac

SEQ ID NO: 54162 - DNA, 351 bp, Oryza sativa
atgcacaatttgtggaaaatctcagagctgcaaagaaagaaagagaaaactacttgatggggctgatcgtatacacacttctttttttcctttatgacatctcttgggtatatacatagtgagggattacttgaatagatataatataatgattgaaaataatatatccactggtttatgtgtaaataaacagtcatattttgcttttcttaatatattttttcttatatgttctctaatttattagagcgttaggcggcatcttggaagtgcaagaatgctattagtcatagtcgtaattgattacttgaagagatctaatctaatggttaaaaataatttatccaccag

SEQ ID NO: 54163 - DNA, 369 bp, Oryza sativa
tgcatcatgatcaatctctacctgcaatatatctctcccaatatatgtaatgtaatgtaatgtaataatattcgaataaaatgaggtcacaaattatattataaatatggatcagccctcagatgattttttttttcgaacgactcgcacgagacggtgcaaagttttattgatagagtaggaataaaattacaagattacaatcctggagggtcataactaggaaaaaagaaaaaatataccacctcctatacatcgacagcgccaacacacacgaccaggagaaggctagcaccggaccggccaccgctaaacgtggccggccgacgctagaccaataaaggaacatagacgagatcgccctacagc

SEQ ID NO: 54164 - DNA, 476 bp, Oryza sativa
acaaaatcgtacctcaactgaaaaaatatttggggtctcttaactaatcaaaacccgttcacaatagatcctttatggttttgatcttggttttgtcctatgtgacagttgagtcagcgtgggacccccacatatatgccatgtcatctctcccctccctctcctcttcctcggttcctcctctctctctcttctcttcgttctttttccggcgagagtgccgcggcggagcacgagcaccacgccggtggccggagctggaggagctcctgcggctgctcgtgtccgctcaagcgagttgggagggatggaggaggcgacgggcgccggagatgtggcggcgtctgatggtgcttcaccgccggtggtgaagatgacgacggaaggtgggaatgcggcggcgggcgacaggggaggagcagcgcgcgggaggcgggagaggagctgggcagccggcgacgagcggcagggtggta

SEQ ID NO: 54165 - DNA, 1501 bp, Oryza sativa
attattgcgcctatcaaaagtttactaatgctgtttgctgcaacgcaggaatgtagcattggagaagatgacacaccaaactacggtagtccagatgaaatgttcagcaaggatcttaatccttgcctaactccatgcatctccaagagtaaatccgaggtattcaggccggtcttggtacaacttttactcttctactaatcctgtccatttacaccatgaagaattgccttctcctatgatcttatttctatccgcaagccaaagcaaagtgtggattctttttctcattcaaatcatgaacttgaacaggagtacgagcaaccgatcaattctcatcgcagcggcacgaaggccggacaggacagcctctcctgcggttcccgtagcaggccaatgtcgaagagctctgatcatcacaagcctacctcaggcaccaacagcaagcgacgagtatacagatccgaccaagacaagttccatcagaacctgttctagctttgccgtttaccacggccttttccccggcctcaatcacgcttccagcagtctcccctgtgaaatattcacaagcgtgtggactcgtttggtccattgatacatgtctcgagttgttgtaatggcgtcttggtttgtgctttgctgctttgcagtgtatgcttgcccctgctgtttcgaatgcttgtccaagtcatgtggataaactgtcttgagaagaggaaatagcagatgatgttttgcttggattaaggcgatacctctttttctaatttttgcacttaaggccagaatatggcaattttaactatgaagcgcaaaatgcagtagttgatgtgtggtgtgtgtcagataaatctgatggttgagttgttattcggagaaatttgattctgggagtatatgtttgttgaacatatttcagaattatgatgaaaatgattgaatcgctcaatttcggaatacacttcaggctgtcggaactgagacaagtcagagttcaaatcttggtatcagatctctctaggcgtttgcgggcattaatcgcaagtgaaaaaaaccagagccgtcagatctggaacggacggtccagatcccaggatgccgaatactagtactagtacaatctctctctctctctctcctcccccgctttcctctccgtgtcgcgatctgcgatggtcgtctcgtccgcgacaccccggccccaattccaacacgcgtgcccagcagccgcagatctctctccaaattccccaatccaaatccgccctcgcctcgccccgatcgatcccctcgattcgattcgatcccgcccgatgcgagtggaggcggcggcggcggcggcggaggccgtggcggcgtgcgcgcgagcttagggtttctagggtttgcgctagggtttgggggcgcgcccgcgatgggccggtctcgcggggtgcccaattccggcgacgatgaaacgaaccacaggtttgtttctagcagctgcttccccccgctt

SEQ ID NO: 54166 - DNA, 312 bp, Oryza sativa
tgttatacaaaacccagtaatacatcgtgctcataatagttgactcgctatactacaatactaagcgtgtgcttggaagaaggggaaagaaaatttttatgaagatatgtaaaacaatgtgaatcgtattaattattttaaattaaaaaatgaattgatatgaacttttaaagaaactttcctcctttttttttcaaaaacaaactgttagtaattcgggaaacatgtaagccaaaaacaaaagattccttctcaatttgtcctcttagcatacgcacccaattttccatccgttggtcattttttttaaga

SEQ ID NO: 54167 - DNA, 410 bp, Oryza sativa
agaaggggacatgttgcagaacaaaaagagagaaataaaccctctatacaaaaaataagactgttctgacattctgtgcaaggaatttcttcatttattgtttgttaggtagcatgtaaaaattatatattatagctacacattcaatacatctacaatctctgaaaaaacttgcatatcatttttacagaaaccagttaacctttttcctttaatgtgtatgtgaggtcatttattttagatacagttgtaattattccaattgcatgcagaaaactctgctctttagaatcaggaaacatcttactcagagcatggataacaccaaaacatgattacttatgttgtctactaatacgaacatcaatcattgttaatattatgtcaatcacttcatgccatcttgcagg

SEQ ID NO: 54168 - DNA, 1501 bp, Oryza sativa
acttcttcagcggttcagcctgagattgcgactcagcaacctgacatacatgttgtgcctgcagttggatttgccgcccagaattcactcttgtcgttggtcctcatgtataatctagaaaccgttgcagggacggcgaaaagccgaaaagatccacttgccgtattcgtgatatttaacaatttgctactttcacatatgatgatttatcatctagacccatatatcgtagacacacgagaatccatacgtcatagacatataagcggtatattgttaaatgtcaaatctaaaagtgataaatagtaaaatgccccgctgcattctcccctttctactagaatctgctcaacctgtctcaagtctcgacaaagatgcaactatcagtgtctgacatgaagcagaagccaagtgaagagttgttgaatcgaatggggataagatgattgatcagcatacggacctgccgcgatttccatcgagaagacgaagacagcgccatctttgctcaaggacacgccattggggaactgaagattgcggtggagagtgcattcattcccgtgtgcagtgtgcatcctatttcaagagcctcccagtctctcccagatggatccgcggagaatgaatgacaactgcataaaatgcctgcaaatgaacaaaacagccacacctgatcgatgattggttccaacactgaatctctgttaacgatagaaccttcataacatagatatttgaaattatcgctagcctccatttctctgagcatgtgaaaggagcacacttgcgatgggcagtgtacgtgtgtgtagcgatgtgtgtgcgtgcatgtcttacatgaagaggtggagctgaggaagcagaggatgttatatgtgattctggatcccctgccgtcacaattgtactcttgaccgtctattcgaaatttccaatggggctgcgtgtatcccgcgggatgtagaggccgggtattaatctattatctaaaaaatttcaaaatttccaatgatgtactgtccaaatttacatctataacactcaaggtacagtagcatgaataatgttccatgccactacaattgctactttatcctgaacactttttttctcttattcgagagatccatattgctggttttgtactacctccatcctatattacttgtccttttgagtttttgtttgtcaatgtttgatcatcgtcttattcaaagaattttggaattattatttattttgtttgtcaattgctttattatcgaaagtactttacatatgacttatctttttttatatttgcactaatttttcaaataaaacgaatggtcaaatattgcaaataaaaagtcaaaaacgtcacctattatgggacggagggagtattgataaaagtagagagaaactgtacatgccccatcagaggttagagtaagatgaaaaacaagaagggcatcagagacaagtggcttgtaccggcccaataggatccaacagt

SEQ ID NO: 54169 - DNA, 822 bp, Oryza sativa
cacatctcttatataaaaacttatataagagaatgcacatctcttatataaaaacttatataagagatgtgcattttgtgaacaatcttacaaatcactttgttggatgaagaaatgaccaaaatagaatcttgatgagttatacaacctatataagagatgtgcattttgtgaacaatcttacaaatcactttgttggatgaaaaaatgaccaaaatagaagttatagatcttgatgagttatacaactttgttattgatggctttttcaattgaaatcattttgtatttgaaaatgttatttaaagttgtcatattttgaaattcaaattcaaacggtccaaacagagtcgtatagaaaaatgaccaatacaaaagttgaagatcttgataagttatacaactttattgttgacaacttttctatttgaaatcatttactgcgtgaaaaaattatttgaatttcttatattataaagttcaaattttatatagttcaatcaaactcggatggagaaatgaccaaaagaaaattggtagatctcaacgagttctacaactttgtttttggtaattttttcatatgagttcatttaatatcataaaatttgattcaaagttctcataattttagattaattttttccctcctcaccacttcaaaatttttcatctcttctcctctctcctctctctctcccctctctgatattttcccctcatctctttctcttcctctctctcactcactctttctctcctctctctcaacctttcggaggcgcctggcgagcggcggcgccgggagcgggcggaggcgca

SEQ ID NO: 54170 - DNA, 166 bp, Oryza sativa
acaaccccacgccgcctcgccctcgcccaccgcggcgacacctacaaagcccgcgacgagggccaatgccattggcgtgacaaggcggggagcgcgacgcgacgcgagggcggagagagcgagggaggggagaggaggaggaggaggttgatggcgtcgccggcgg

SEQ ID NO: 54171 - DNA, 189 bp, Oryza sativa
cggttccggtatttacatagtatggggatcgttgttgtaaagatgtatacgagagtcaggtaagacacatcccgcttagtatttttatgcacgttcgggcccgtgaattgtcaggtaataaccctacatcatgttgaccgaagccggtactgctcttattcaccatgatcataccagtatatcatctgg

SEQ ID NO: 54172 - DNA, 1501 bp, Oryza sativa
atacagctctctgtcttatctcataaaaatacttcaaacgtgctgatattttatagtgacggagagagtaccaatttgtcaatgacagatatagtacgatgaaagctatcggatcggtgataattgtgcaaacatctcgcgagagctatcagctactacgtactatgcattatttcagttgatgtgcactttttctgaccaaaatgcatatacactgaaagaatttctctctcgtcctaccgaaaatagagtactactgcactacattcagattcgcaaaatcgcaactcgaccgttcaaatcaaaatcctaaaaatttctacgggacggaacacgccaacctgagcttttgttcgtgtttgggggcgcttttccacagtataaaatcacagatacccttttgattttgataaaatcccctatgtacctatgaacagagttcacccttccccgcaaaaaaaaaaaaacataattcacctaatcctttctatactcttgaattttgctcaatcccttacatacccctgaattttagtttggatcccttccatgcccttttcgctagttgaccgttaaatttttttaaaaaagtccattttaccctttgctatgaagaaacataataaattaatgaagtatattgttggaatgtaaaaatttattggatgagactattatatttatgagtatgtaatgcaccatattatttgtgacaaatttacttttacatatgatataaaaagttaatacttatttattagttattaaaagttcttttgtgtagcatatgtgtttttatagtaatacaacatatttgtttattactatcagaacacatatactaaaaaaaatcttttaataactaataaataagtaataatttttttatgtcatatctaaaagtatatttatcgcaaataatatggtgtataactgtctcataaataaaatagtctcatataacaaatttctatgcttaaacaatatactctattaatttatatgcttctttataccaagggcaaaattgactttttcataaggatttaacggtcaactagtggaaagggtatggaagggatccaaactaaaattcaggggtatgtaagagattgagcaaaattcagagatacagaagacattagataaactttcagggtacacagattttctctttgattttcgtgtgcctccatgccgcgcgtttccccttggccgcaggaactaaaacccgccttgaatctcagccctccacgtgtctgcctaagagcaccccacgtcaccaccgctataccaacaataccgcgcctttttctccctccctcctcgcggcggcggcggcgacggccgacggcggaggcggaggcggaggaggaggaagacgagaggagccgagacgggaggcgtgtccgtttcttcgtcccgccctagggtttctacgagggggaggcaatggctgccgcggcgggggtggctgctggaacgggaagaggtagcgggg

SEQ ID NO: 54173 - DNA, 1501 bp, Oryza sativa
tttgtactgtactacatgaatgacaccttcacacactccaacatgttgacacgaagaagggtctaaaaaattcagagaatgcacacgcctacaagctcaatcgaagtactgtagaacatcactgcaccactccatgctttgttttttttttcctctcctcattgttcttggggaatgagctatgtcaccatttcaaattcaaaatgtttaatttagaaagatttcgatttcgaaattacttagtagtgctaaactgctaatcactgattaactgagccaatgatcagagcctgtttgaagtaatctacacagatcgcgcgtatcgtccgtatcatctcgtaactcgcggtcactcactggttggaactagaaatgcgttcctaattaaccacacctttgtactattaacttgcactaatactagtaactctgtactagtactagtgattagtagcattagcacgagaggtagccatggaaagaagagaagcatgcagctaacgcaaggcacaaaagcaaaagaacaccaccctaatcagcactaacgcgatcgctaaagccgattttttctcacagaaaagaagctgaagttgagtgagtgataatactgcactaaagccagggacatcagatgcaatgatagggagagagcacacaactcgttctgcattacatgcaaacaagaggcagatcatacggctaatggtagggcccaccataatagtatgattaatccggttcatacttcattaacccctttatatggtttaagttgtgcaaaactattaaagttaagcaagataagagaatcttaactgacatggctaaattttttttaataaaaagaatcttaatttcaagatttgatttgattttaagtatggtgaaataaagaacaattgattttacggcatgattttttaaagatatatgatcatggcatccggaatatcgtgttatgtgctaaaacgcctgtaatcacaatacatataaagttacaagatactccttccatcctatttttgatcatcacctaaacacagagactgaaacaaccaaatttccatcattctataattaattctcattagttaagatggtatgttgcttcgtgtctcgtgaatagtaccaagttttaaatattgcatgtagttgcatcaataaaaattaatcttgattggttgcatgcagcatattcaatgatgctcatttactctttacacaaacaaataaagagacatttgttataggatgattattttgaaaagacctcgaaaatcttaggtgatgattaaataaggataaagaaagtatttatactttgtaattaagcctcatttgatgccatgacactgtccaagtgtccatttttgctctaagcccattaatccaccatgattaagcggctaatataagtagcaagacgcagccaccgtctcctgccctcttgtctcagcttcagctccggagccacgagctctcaccttggcaatggcgagca

SEQ ID NO: 54174 - DNA, 203 bp, Oryza sativa
tttaaaagagggggatagcatatggggcccacaattaataagtgagtgtggttgatcaaatttggcaagtgatcagtggagggatttggtcaaccggatggtttgaccattcagtgggagaggttgttgaagcacgatttttaactgaaattatcaaaatttagcttgagaagactgatggagtgattgttggagaacggaga

SEQ ID NO: 54175 - DNA, 186 bp, Oryza sativa
ggatcccccggacttttttttcctgataacaaagataaacatattaaaatcctttgtagaaaacaaagagaataacagaaaaccgaaagaagcaacttactgcacgagaattctcagtggaatcttcatcagacgaaccgtcgtaaccagattcaatgtctggcttttcacggttcgatgatgtca

SEQ ID NO: 54176 - DNA, 279 bp, Oryza sativa
ctactgtactatgaacagcttttaagaaaccatcgggcttaacccatgcaactttctgcccttgtatatattcccaacggcaacccctccgtgtggcccttctctctgtttccctccttgcacgcttgctgctcgatccttggctcattacactgccatcaagatcacctcatgtctcccttcatatccatttcttcttgctgatcattatcactactcgtgtgcctagctagtgccttgccatgtcttgcttgacctctcctcagctggctcccaaga

SEQ ID NO: 54177 - DNA, 386 bp, Oryza sativa
taaccccgagttgaggaaacggtactcgacgagcaccacctaagcgaagtctcatagtattgttattctcttgttccgagctagtgccataatgcctcccagtattagcacaatccaatcgaccataaacaccataacctataaccttgtttagacgtgataccctacaataatcgcgctgcgagcaaaccaatatataggcacacactcacaaatccatagtgtccatctagagaacgagtaagatgtggacataagcgatattgtcaatcaaaaccaagatagcaccaatctataggttggtgtggaagaccttgaatatcgatgaaaacattatttagaagtacacgttaggtggcagcagtcaaggtcggatgtaggcgtga

SEQ ID NO: 54178 - DNA, 248 bp, Oryza sativa
cctgcagccctatttttcgtcacccctatgtgacttagtagcatttcaggcggatacacgatctctggaggcgagctctttcccccagccgaactcacaaaaaggggatctcacgatttcccgctagagaggatcactcctcgacagggacggagggagtatatggaattatatcaacagtagatatatatgaaccagtaatatcaaccggtgttagaagaagaatgttgtattgcatagtgcataca

SEQ ID NO: 54179 - DNA, 275 bp, Oryza sativa
ataccttatctgggttttatttttattgcccccgcgagcttgaattgtggacctcgaacgtgtcgattggcccagctagctttgacggttactagttcgtttcctctcagttgcaagtggagcagtacgagtacctctgtttagattttactcctacataaggtgtagatggatcataacaggagctgaaacgaactttcggtttcggattggaggcaaactttctcgttggtaatctcccctatacactgtagttgttctcgcgtccgacgcca

SEQ ID NO: 54180 - DNA, 314 bp, Oryza sativa
cgaattcctgcagccctggtttctatataagccaaagataaagaagacagtcgttgctcgttagcctggtgtaagagcatctccaacaacatctctatcttcctctccaagttaaaaattgacatttttggacaaaaacacactccaacagactctctatctccctctccaagccatccggctggccaaaccactcctcccgctggccaactttggccagccaaaattgacttgccaatcatgggccccacgccttttcccctctccctctcccctcccatattctctctccacgccctcaccctcctcccaga

SEQ ID NO: 54181 - DNA, 163 bp, Oryza sativa
ctgctgcctcgcctcctccgccgcctgccgccgtggtgccgtgcgcgttcagagagtgagaggagagagagaggaagtgtgagagagagaggagagagagagaggggggaatagtgttataggggtatgacaggtgggtcccacatttttttaataactaaaa

SEQ ID NO: 54182 - DNA, 1501 bp, Oryza sativa
tttttgggaaaagtttcatccagattgtcgagcccatctatctcaaagtccacgggttcaatgcaaatggccccacttgttcttaacccatttaaactttttttcctttcctgattagaggcccctagcccacatacgtgtctcggtggccaaatatagacatttattcctaaaaactttatatatagaaattttacatatgtgaactttctacctgtaaactttcgacagagaaactttatgtggaaaattttcaagcaaaataaaaataataatttcataaaagaaaaataatgtgtaaactttctattgggcttattggcttaaactagccaaaaagtggaaagtagattcaaaacatgcaaaagtcagagaaaaatgtgttctacatatctcatataggtgcatgtcatgaaatatactcttgatgagatcatcatgtgtttaaaactaaagcacaaaatcagtaactaagaaagggaatgcagaagattttttggagaagaaaactcgaaaattaacatggggggttattttgcgtgattgatcggccttatcttttcgcttatgcttatgcttatcacccaaaaattaaaatttcaatcttaaatttggagttgattttgggtttttttatatcgaagtttatttttcagtctttgcttttagattgctaagaacacgtatataaaagtcttattcataaattattattcgaataagcgaaacgatgaggcggacgtgcgtgtgcttgttcacaaagtactcttttcacatatagtcttgactttagagaagagtcctgtggaggagactacaaatcgggcatctgatttttcatcaaaaatcaagtgtcttgtcactcttagtcgaacaatgtttcaccgttaaataaaaaaaatgtttcaatctattaaatgctgaaacataggtgaatcatgattgaaacaattcgatccaacaaacaaaacatcaagcttcaaccgttaaaatatcaagggatatgcacagatcgatgaaacaatatcaaactatccaatgcaacatttcgatccaacccaaagaaacatcaaagatacattggttgaaacatcgaaaaaaaatgcaccagtctagattgagcttcttcctcctctccggtgaccactggctcatttggtttccgttgcagatccacactgggacgtgcaaggctcttctactccaccgaggagggcaaccacagctgccgagacactaagcccttgtcaccccaccattgtgccatcgtcactcagacgaacggaggccgcacccaccagagagctgcggggaggacgcctcactggtcacggcaatcataaccgcttggtccgccgcccacctacatatatatggtgattcgaccaaacaactgaaaaatcattgtagcaatttagtttttctaactaaatgaaaaaaggaaaaagtacggattacccctccctaactatcacggtcgtccgaattacacccctgaacc

SEQ ID NO: 54183 - DNA, 192 bp, Oryza sativa
atactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtca

SEQ ID NO: 54184 - DNA, 220 bp, Oryza sativa
gctccaataaagaccacaagaaagaccaatagctccccaccacttgtcaagggccagaagcgtgaacgcggcaaggggaaggtcggggagttggcgccggagccaaaaaggggcaaggctgtgacgtcgatgccggtgagcaaagcggggaaggtcgtgagggcgccggcccaatttgagctaggcatgccattggtggaggacaatgtgttagccgtga

SEQ ID NO: 54185 - DNA, 177 bp, Oryza sativa
atggaagcttgcggcagccgggcaccagccgcccgagcaccttcgccttcctcgccagagctggggctttcggccctttaccggacgacgaggatgggtggcgagacggcgggaagatggcctcgcggaggcgcgcgcggcgcgcggcctggatgcggcgacggtgggacgcgagga

SEQ ID NO: 54186 - DNA, 1501 bp, Oryza sativa
ttcgaaacggagggagtatatcacatcggagtattaaacgtagactaataacaaaataaattacataattcacgagacgaatttattaagcctaattaatctatcattagcaaatgtttattgtagcaccacattgttagtcatagagcaattaggcttaaaagattcatctcgcaatttacacgcaatctgtgtaatttttttcctaaatttaaacatggcaaaaagttttactaggagatccaaacaggccataaagtaacttcaaatcatctgaatatattgatgcttcccggttgatatatacaataacatatacagcaaactgagagatgtaggcttctttaaaatcagagtatttttacgcgcattatttacttcgttataaatactaaattaatttttttatggaaaaacttagcaagtatagtttgagttttataacaagtgtgcaatatagcaggaaaacaatttttttaagaaatcgtatttttaagagtcttggagtagagattccataacaataattcaataaagtacctataaaagagtaaattttacccaaaaaatatacaattatttaaacaaaattaccactttgctacaactttagctttgtagtatttcacacaactacaacaataacaaatgatttatcaaaaatctgcaacttatccactatatggatataacatatgagctcaacttaaaacaatagtactacaaatgtacaggacaagtgggacggcacaattttacaatatagacaaaagatacagttttacaatatcatatattattgttgtacaagttaaacttgtataacaaattgaaaatttttcacgaacacgtcaaatgattgtgcgtcagtatattagacgaaagagtttttattacacaacgcaactggccagactttagcgggtcattgccggttataggaagaggattctgagatgaagaaagagataaactaagaaattaaaaaaaaatgcaactcctatctagcaggagggggtggcagccgcctaatctcccaatagatccccccaagtacgcggcaccagcgagggacagagatgaccctcaaactagtttatcaaaccgatatttttgataaactagttatagcttttttaaatttactcaacataaattgagaatcaatatgcaatactaaaggttcaagccacaacagtgaataggagtaccacgccacacacatgcgaccgacgacagaataataacatcaacatttctccccaaaaaagaaaaagaaaacatcagcaaacaatgcacacagacattgacatatccatggtccagggagctcacccgtccagcgtttcgccccttcacctcccaaccaactcgtatttaaacccccccaacctgtactcttcttgctcgcgttcgcgtatatatccctctcctcacacacacaggtgttcgtccaaaattccgaacacaaccaagcgccattcttgcaagcgcgattccc

SEQ ID NO: 54187 - DNA, 990 bp, Oryza sativa
tcctgcagcccagaagctcatgtaactccaaaccaaaaggaccaataaccaattactaactaactaactagtatcataatcactaactaattaccaagtaagtaagtagtaattactaacttgccaggtcagcatctttagttcttttcacagcttcagaaaggcacaaacaaaccaaaggcttatatcagccagaagcagcagcagtagccagcagccagcagccagcagccagcaaagaaagaagccaagaagcgccaaaggaggaagaagactcctctctcttctcctcccttggctgcaattgcaatactgcaatacagcaaatccatatccagagaagcggttgaattccaggagccgtgtttgcgcagagaacgcatgctgcttctggaatcgtttcctgcctacttttcttctcctcccgtttggctgggcgccgctgctctctccgcctcagctcctcctcctcctcctcgtcgctctcttccctgtcgcggctgttgcgttttgccagttagagcccgactgcgtcggagccgtggcggggattgttgttgccggtgccaaaaatctgatcttggcgaaggttttggggtggaaagattgggttttctttggctgggattttcatggttataggaacctgtggcagacaggatttggagttctgagtttgaagtacttttgatgtgattcttggcgcttcggagatccatttttgtgggtttgttgcgaggctctgaagtttttcgctatcaaaggtgtggaagcagtttatttttccagtacagaaggactgttagtactgtggagatttcgttgggagctcaagtgtttgtctgattagctaaagctccaatcgttttgttgattgaagaattgaaggtggaggtgttcttgtggacactgagtccgaattttgtgtgtgagatcacctgaatttgttggaggccgaatgcttattgctaggataaatctacattttgg

SEQ ID NO: 54188 - DNA, 1501 bp, Oryza sativa
  unsure (1)..(1501): unsure at all n locations
actaacgagtaatttctccataatactgtaacgtaggcagttgttaaccaaacagaagacacacggagtatcacagaaaatactgctatgtttagttaattgaaaagagctaaagaaaagtccttggttccacagaaatttactcgaacatgtcctgatattagaattgtgttgcagaaaggttgttcattaacttgctccatcacattgcggatgttgacagctggcaaacagcaatgcaatccaactatatatcatcagagtatttgataaattgcttctgggaaagaaaggtaagtggtctagactccactaaatgaaactgcataaattctaatgcagatgagaagtcaaggggttgctttgcatctaatcattagcagccacttgttctttcaaggattatccttggcttgcttgtggaagagacatcagagttcagaaggacaccaaaaatgtgcatgactaattttgaaacataacgtattaaaaaaaggatcaagtttggtattttcatgatttaatcaaaaggaactacacttaccgtatcacccttgactctagacccagnnnnnnnnnnnnnnnnnnnnnnntctttcaaccatccatgaggtaacccctccccagcaggctcaatcttaccatcggcctaaggagtaagaaagcagtaggaagtaaacaaagttgtcaaaaataaattgttacagaaatgaactaaaatggaaagacatttaaacaaaaaaggtcaaaaccttccataccgtgacagcaggttttgccctaacaatcccacttcgtgttatacgatgagagccctcgttggaatccatagtctatttcccgttttgataatgaaatccacaaaatcctgtttatatggaacttcctaagtcatatagatattaaatatacagtacatatgtttttgtaactgactataagtatgcgttcttgtgaagtttattctaatatgtgaaaaaggtggagtttattgaaggaaaaatggaagcaatcgagctgtacttcgttgaaatacattgccgggtcggacaaaagattgggtgacctaatttcattaagattgggggactttattgaaatacaatgcctcaagtcttctgcagagaaacccagaggcataaggttgccggtgcactacagagagtcattacataatatgtacatcgtggactcgtggttcaaacaaacaagtgggctcaaaataatccagggaaacttatccaatctcaattactccagctactaagatgggcaaaacttagagctttgcgggtatacggtacacataatcctaggacgagcttttatttatattttttgtcaaagcaaaacttagatatgactaattattccatttcaattaaaaaaaacttgcttgaggtcagctaccgagtttcatagagcaagaacaagcttatagggttagaatcactcaaaagaacgaatttaacccacaaaccttttaacagtgtaaagacct

SEQ ID NO: 54189 - DNA, 1501 bp, Oryza sativa
tttagggatgacgaaagcaagaagcatcgtgagtatcatcctgattgcgaggttttctataacagcaagaaattcacgaaatcacgagagggaacggaggcaattctgttcataaacaaaatatttgattgtacggttttcttatctcttgcaaaagttgcaatgactggaacagtttgggctttggggtttggcaccacctaccaacaacgtgcgatccatcgttttccacgtcgaacacgtggcacaggaagaacagggggtccagcactccagtgtccacatctgcaaatttctcctctctgatgatcatcatcaagtgatcagccatatcactatgcagcacagatacagagagaactggattcccctgtgcaatcttactcatgctatcatgcatacactaatctattcatcccagtgattgctctacttttgattgcttaatcagagcatctcattcgtctggattagtgctttgatctgcttgcttgcttgtttattctggctgtctacctctgccccatgacctgactgaacttgccttgcctctgcttttgcttgcttgctcatgaaagaaagcaggtgtgattttgtgagagaattcttcttgccaataattgatggcaagaagaatggagtgtgagtgtggtctgattttttcttgcagaatcatcaagggctatctgctatctcatcttgtatgacaaagattgattgcagctgacctggaattggcaggatatcagttgagagtgaaagtgaatgctactgctagcagtagcagtgatgcagcaaagctgccacaagccgaaggcacgttgacttaaaagaagcccttaaaaatcaccaccaaaaagaaggcaaaaagaaaaagaaaaaggagtagtagcacgattcgacaccggaaaaagaccccaaattttgcataaatctcgggtcattttgcctaattaacccaggcaataataaacatctcaccaattctgtactggcgtagtaccacactgtactgtactgtgtacaagcaaggagagagaaaaaggaatcagacattaggagagagagagaggaaaaaaaaggcagaagaaaacagatgcctttctctcctctttatccaacgctgctgctgctgctgctgcgactgtcgcggccatggcgtccaccattcatcatcaacccgggggggttgccaatcaaatttattactcctacaaggacaccgtcacagtccacacatgagtgagtagtagtggcagcaatcgcaatagcaatagcatcacgttcacaggaaggagattgctagtagtagtagtagcggaggagacgcaacgagacaagcaaagaaagagatagagatagaagactctgtgtagtgtagtgtgagagagagtgagagagagagagaaagaaaaagctctccctagtccctagtgcgtggaggagtagaggtagagcaaaccactgaaccacatcgccttctttctactggtttctaccg

SEQ ID NO: 54190 - DNA, 1501 bp, Oryza sativa
attgcagcaaggaacataacacaccataatatgatcgaactcgcaaataaagccatttagctaaattaacttcctataaaacttatgcaatttaacaaaatgtatttgcacacagactttaaactaccttatacgttccagatatctatcatgtgaactagtgcatacaacagtatgtccttaaattagcacttatatacatgctgatggagtttatgtgtgggtttgtgtgtattttgagatggcaccaaaaaactggagaagataatgctggaggcttgaaacagccttgctgtggacaggtaactgcccctgagcatagcaagtgatgagcttgcaggcttgcagccaggtttctcctataagaaggccaagctagaattgaccaagacagagaataactagaagcaataatgttttcagtaaggcagcttctggtccaccctacacacctaacctgctggatgtcatagtcaatatatatgacatactatgccacatgtacatatcttcactttgtaccaatgtaagtcccagagcttaccagttctggtctcaaagaaaataataagtgatgaacaatcagagttttctctggataggtttttttcagatttttggtgctcattcattgcaattcacaagaaaaaaaaagtctcaaggtgtttcttaagtttcaaaaaaaaaaaaatcagaaggacacttgtgaatttatattcataagtcatgatgaggagccagcagaacaaggtgaaaacagaacttctcttaaatggagtacttccaatggagttcgggaaccatcatagtgacttatatggtaaggagattatgctctccttatcaggaggcagttgaggcataggaggccaaggctcatacatatttgcctggtgtgtcattatctgtttttgtttttctaagagacttcagccatgttcacacctagtaaggaatatagtagttatgtgctgtgttagtgttttatgcatacaaattctttgtcaaaacaaattgtgtgccacttgcctgaatgttgcagtagttacaggttaccacttcaggcagtccattttgacatactcttcccaaattcaacatttaaataggttcatgactctatgaaacatggaagacaaggcagtagttcaaatcttcaacatagcattttatcatgtatcaaaagtatgaaatggtcctcgacttgtttaagtgtgcatttttgacatgccataggaatatttcagtgatggacatcttttggttgcgattcaaagttgattgcaatattaccagatacaatatgaatgagaaccactttggcaaatgtttaactcgagcgtgaacaaggtgaatgtgctgagcatgttacaggagttgatagatagaatcatagaaaacttcgatgacaagtgatagcaacatccaagtattctacgggactcctcggtaaaggattctacagtacacgtaggagggcgatataaaccatagaggacat

SEQ ID NO: 54191 - DNA, 1501 bp, Oryza sativa
tgctcccgctcatatggtagaatttggatagagaaggaattgctcccgtacatgacatgcacgaggcaaatcgatagttgttcaggcatgaataaaaatatgtataaatcatggttggtctgataccaataagtctcaaactcatcccaagtttatacaaataaatatccagctccaatatttgatattgataatttagacagtccaacccccacgagggtcaagctcgccttatatttatttgcagcccatattaatcgcttgacaaagatgacgtgtgcgtgtgcatgcgccactggggatacttatatccatggctacaagttcacaacgcatccacgacatattcatcgatactccactttactgttttaccgtccggactgtgtaactgcacaacactacggtatatatttgctccctctagaagataatgccgggcgttgttgtgtttgtattggataagcaacttgacggagaacgagattagcttgttattgatgactcgccgatagagatgccatcagcgccggcgactacaggttgctgatccgcgatcacgcaccctgcgtcatgcgcgtgcatcttctttctaatctctctacgatgtagagaatattgtgtgggtgcgagtgttcacctctctagggcatattgctgctttaatggcgcagcgcttgtgccgtgtgttcccccagccgcgacgaggggtcgactgctttatgtaggcagcgatgaccacaacggcctcgctaattctccgtgaatcgagcgtgataacgcgtttaatctgttttggcctcatcgatctgctactgcagataagtgcgacgcatgcagatgccggccacctgatgcatgcggatagagttgctggtgtcggagataatcactgagattaacatggctgatgacggtgggccccacgtcttatttgaatttgttaccagtgataattacccaccggtgaagtaacaaaccgattaatgggtatactgctagtactagtggatctcttctcttttcaagcttatatctcttcaattgtgcattaaatttgaattttattcgaaccattattttctatttgaaatgtacaacaaaacgagcccaatattgattatattcggacattatgtgatatttgaatttttctagacccacacgtcacagagacacgcctcacatgtattcagtaaaattgggctataaataatattctcatataaaattaaatgcccaataatttattatttcttctatgaattttagcacaaaaattcatcaaacaattggcgagtagtagccaacgttctccccaagtcaacctccccacaccgaactctcaccaatctcgaggcgcatccgaccctcccgcgccccaccacataagcaccccccgctcacctcgccccgccacgcgcacaccgacacttctcccccgcattctctcacccacccacaccgcgcgccacagatctcgccgcagccatggccgccg

SEQ ID NO: 54192 - DNA, 357 bp, Oryza sativa
gatccccctgtttttttatgcaccctcatgcacaaagccattcagctagcctaaattagtaccatcattctctttctcgagttattttaattctacataagagctccaattgaatatctgcttgatttggattgtgcaaagatgcagataatcttgtattagtttgcagggatgatttcacaaattgagtccatttcatactaattgaatacttatggtgttttgctgaaatatgtgatttacctggtatattcgatagctatacgtgtacatgttttcctcgaatgtcaaccattgaccttagcgtatttctataatataatctggtaatgttcgtgcctttctttgcttggcagg

SEQ ID NO: 54193 - DNA, 1501 bp, Oryza sativa
aggtggtggatctggtgcgccgcggcgcggtggtcgcgggaggagagcgtgaggtacccccaggcggcgaggaacgcggcgtagcaggcggcgaagaagccgtagatcgccggcacgggcgcctggccgacggggaggtagtcgacggagccgtcggcgtttccgttgtacatctcggtgcgcaccctcatggtgacgagcgactccggcgcgcagttggcgaagtagaggctgtactcgtcggggtgggtgaccgggaacgtcttgttgtagtggccgcgcttgaggtcgtggaaggtgaagagcgtcttgacgtaggggctcgtgaggatgcagcgggagacgtcgggctcgtcggcgccgccgcccgccacctcctcccgcttctccggcggccgccgcgctgcgcctcgtagatggcctggaacatcgactcgtcggagaggaggaagaacccgagctgcttggggtccgggcgggcgaacgtcgaggagatgccggcgccggtgatgacgatcctgaccgcgcccgtcttggagaacccgaacttctcgaacaggatggtgggcctcgggtcctcacggaaggcctccgtcctgatttccgccgcggcgcggggcgcgagggacaccgccgcgacggcgatggcgaggaggaggaggcggcgcgcggcggcggccatggctgcggcgagatctgtggcgcgcggtgtgggtgggtgagagaatgcgggggagaagtgtcggtgtgcgcgtggcggggcgaggtgagcggggggtgcttatgtggtggggcgcgggagggtcggatgcgcctcgagattggtgagagttcggtgtggggaggttgacttggggagaacgttggctactactcgccaattgtttgatgaatttttgtgctaaaattcatagaagaaataataaattattgggcatttaattttatatgagaatattatttatagcccaattttactgaatacatgtgaggcgtgtctctgtgacgtgtgggtctagaaaaattcaaatatcacataatgtccgaatataatcaatattgggctcgttttgttgtacatttcaaatagaaaataatggttcgaataaaattcaaatttaatgcacaattgaagagatataagcttgaaaagagaagagatccactagtactagcagtatacccattaatcggtttgttacttcaccggtgggtaattatcactggtaacaaattcaaataagacgtggggcccaccgtcatcagccatgttaatctcagtgattatctccgacaccagcaactctatccgcatgcatcaggtggccggcatctgcatgcgtcgcacttatctgcagtagcagatcgatgaggccaaaacagattaaacgcgttatcacgctcgattcacggagaattagcgaggccgttgtggtcatcgctgcctacataaagcagtcgacccctcgtcgcggctgggggaacacacggcacaagcgct

SEQ ID NO: 54194 - DNA, 1501 bp, Oryza sativa
ttacttaaaaataactgaatatattttaaaaagaacctaaataattagggtgtagctatatatatggcgccatatttttcatcaaaaaaaagtcagcatgtatttacattgtaagtccctaaattacatatgtaattttagtgtatttacaatgtaagtctcaaaattaaattacatatgtaagtactaaaattacatatgtaaattcgaaaattacataccaattacatacgtaagtggggtgtaaatgaggtgtaactactctgtaagtggctgaaaaaaaatcgactgtagtatatggcgccatatttctagcaaatccgaataattaagctacgttttattcacagcaacgttgtatttcgttatactagtatactaatgctccaaaaggcagtttacaaaaataaaaaaacaacattatcttgtcagtactaaagtttttacacgtggacaccccatcgcacaaatcttgtggggcgcacgatgccaggctcacgtgacccgaatttttttaagcctactttggttaatctgtcccatcaccagaacattttggcgtgttatacgtcgccagaaatctctacggccacctatagcatcacgagccccagtctatggcacgtggtcccggaggacatcgtggcccacgtgccagtgacacgagcgtgcggtgcaggcggttcgcgagggtgtggatcgcatgtgtgccccacgcgatgcctcccatccaacggccacctgtccatccccaattccaacctcgacatggaaggttccagaagcttccggaaacgaccttccccatgttcgcgtcgcgtggcttctcgtcgaaggaaattttgccagaattttcgcggatatttccttcacgaaaccttggtgggagaagggagatggaattcccaatggcgtgtagaatttcaatttcgaattatgttttaaaaacggcgagaaaatgtggaatgacgcaaatgcccttctgcctcctcgcttctcttcttctcctcctccctcctctctctccgtcgtcgctgcctcccctctcgttgctttgcttcccccgatctgcagagccggaggcgctccgccggcggcgaggcaggcacggcgtggacggcctcccccatctcccgtcgccaccgcgccctagccttctcactccctcccggcccccgcgcgcgcgcgcgcggccgaccagccggtggtcggcttccgtctccactcgaatcgaattcgaggtatcatccattcccctcccgtatcccgccctcgtctccctccgccgcttcacgtgcccggcgtggcgtggactggagacccctccggcttggattggattggattggtttggttttccttgttctggaattttttaaaaatttttgatgcgtggtgcgctgctgattttttgcagtttgtttggagagaaatcgggggttctaggtgaacccccatgcccgacgttggcgcggtgatcgaaggatcctcgcggcggaga

SEQ ID NO: 54195 - DNA, 1501 bp, Oryza sativa
agtcagataggatccatcgatttttttgccatctattacacggcttttatttcgtcatatattctcctatattggaaaaaaagcaaaaaaagaacattaaaaaacaagcaaaaaacgcgtgagaaaagaaaagcaaaaaaggggagaaaaatatggttttcgtcgtcagtaaaaaaaataaaaaaaaacatgctaggaagaaacggttagaaagaaatgcgccatttctgaaaaatggtttgagaaaatcgcacaagaaaaaatacaccgtttataaaaaaaataagtcggtcattaaaatacaaacattatcattgacatgattatgcatgaaaaacgtatattattattagaatttatttacccgttgcaacgcacggggatttttgctagtatatatacctaataaaaaataggtaaggcttccgtattttgtttcgtccgtaaaaaaaatttgcccgagattaaaagtaattgtccgtctctgattttttatctgttgtcctcgcgcgaaaaaaaaatcatccgttcacgcacgcacgcacgcgctggctcggagttgggcccgcgttacacgtttcctctgcacccagcgtcgctgctgatcttttctttgggccagctgggccatctgcccacagcccccaactgcatgtctatcacacgtcctcaaccggcaccaacctgagccaaactgccctagccatcacaaagcttgtacaggacgcgattatcagtgcatgcacttgcgtgaacacggtgaaatgatattcattaaatgatttcaaaagtaaaattcttctatactctttctatttttatttttttataatttaatataaatattttcacctaatatctcggactatatgaaaattggctcttctctgagcatatgctgattctccctatcatcaaggttgactctaaattctcttgttcattcttagtcaccaggccatcggatccaaccacctagcgccggtaagccacgaggcgagtaacaaggcaaggtgagcggctcagcgaagtggtatgagaagctagccaaggcgatgctacgttgtttgtttttacttttctttcttttctatactctggttttactgatttatcatggaaaaaataaatttaatgatatattcttacatgatgtataagtagattttataaaatttatcgatccgtgcattttttatataacttttgtgttgtgctttcttttcatgaagcacttttagctattaattgattgtttttcactaattcactggttgtgtatgtaatagattttattaaaatttagataataaaataatacacatctttttattaaaaccaacaagggtgggtttgattcaccatcccaggcttatcaggtccatggagtgatttcacaattccttgtggtgaatacgaatcattagacctagcaacaatacgtaaattgaccttcagatctctatcatatgtttcatcaatcatgtgtacccacgacaaa

SEQ ID NO: 54196 - DNA, 1132 bp, Oryza sativa
gggattcttggggggctccgctgctggtggtggtgggggagggatcgagaggatggccgtggagtcgccattcagggcggatgtgttgaggggcaaggcggcgctggtcaccggcggcggctccggcatcgggttcgagatcgccgcccagctcgcccgccacggcgcgcacgtcgccatcatgggccgccgccgcgaggtcctcgacaaggccgtcgccgccctccgctcccacggcctccgggtgagccctaagcccctctcccttcccgcctacgctacctaccacttcttctctatttaggattaaaaattgtttgttttttttttcatctcccagtcagtctcgtggtgctgctggtgagtcaaaatctcgatagagagattgatgttttcttgtctgagtccatcaatagatccgagtattcgtgggggaaggctaaaaccttgtgagagttgctagcgttaacgcgtctatatacgaggagcatactgaaaatttttctgaagcgtgctcgcgctgcatataaggattcctcatgactcatgcagatgtgatttatgcttcatgttcatgtgcctgactagtgaaataaatatagagttcatcatgcttccctctgatttcagtgctgatctttgggggtaagctagtcctaatctgtaagtgtaaccctgtagtaattctggcttgctgtcacgttcacaggctgttggttttgagggagatgtgcgcaagcaggaagatgccgcgagagtggttgccgcaacagttcaacattttggtaagctagacattcttgtcaatggggcagctggcaatttccttgcttccccggaggatttgacgcccaaagggttcaggacaggtacttcgattgaatcaatcctcgcacattagcagcattagttatgattttcttttgttccatttagatgttatgtgatttttctagtttgtgcagttctgctagtctggtatctttcaacaacactcgtgctattaacttgtctaagtatctaacagcagtctacttgagttcttgatgtttttctcttttacagagaagttagtattgactgggttttctctctgcagtcgttgacattgacacagtgggtacatacacta

SEQ ID NO: 54197 - DNA, 1501 bp, Oryza sativa
tcatacttttgatacatgataaaatgctatgttgaagatttgaactactgccttgtcttccatgtttcatagagtcatgaacctatttaaatgttgaatttgggaagagtatgtcaaaatggactgcctgaagtggtaacctgtaactactgcaacattcaggcaagtggcacacaatttgttttgacaaagaatttgtatgcataaaacactaacacagcacataactactatattccttactaggtgtgaacatggctgaagtctcttagaaaaacaaaaacagataatgacacaccaggcaaatatgtatgagccttggcctcctatgcctcaactgcctcctgataaggagagcataatctccttaccatataagtcactatgatggttcccgaactccattggaagtactccatttaagagaagttctgttttcaccttgttctgctggctcctcatcatgacttatgaatataaattcacaagtgtccttctgatttttttttttttgaaacttaagaaacaccttgagactttttttttcttgtgaattgcaatgaatgagcaccaaaaatctgaaaaaaacctatccagagaaaactctgattgttcatcacttattattttctttgagaccagaactggtaagctctgggacttacattggtacaaagtgaagatatgtacatgtggcatagtatgtcatatatattgactatgacatccagcaggttaggtgtgtagggtggaccagaagctgccttactgaaaacattattgcttctagttattctctgtcttggtcaattctagcttggccttcttataggagaaacctggctgcaagcctgcaagctcatcacttgctatgctcaggggcagttacctgtccacagcaaggctgtttcaagcctccagcattatcttctccagttttttggtgccatctcaaaatacacacaaacccacacataaactccatcagcatgtatataagtgctaatttaaggacatactgttgtatgcactagttcacatgatagatatctggaacgtataaggtagtttaaagtctgtgtgcaaatacattttgttaaattgcataagttttataggaagttaatttagctaaatggctttatttgcgagttcgatcatattatggtgtgttatgttccttgctgcaatatatagtgggacaacctgacaagagatcatcactggtactggtcttttaagactgacataagaatttagcaggcatataaaggtgccctgagcccctgaaaactctctctctctctctctctctctctctctctctctcgtttcctgaatctgaggccatttgtttggtacatttctcatcatgcatttgaaatcatttctttgattttggtcttgcttgagcttttgtttcatgatccatgactagtacattttgaagaacactttctttgcaggctgaacaggaggaaagaagcaccaacctgatcaa

SEQ ID NO: 54198 - DNA, 1501 bp, Oryza sativa
gcggcggttgtggtgggaggagaggaaggagtcgttgccgccacccgcggcggccgcatcgaagagctccttctgcctccgcctccgccaccggttgcccgagcgagctcctccgctgccggccgcctgctccgcctccgcctcagccgcccggggaactctgcctccgccgcctgccgcccactccgcctccgtcccagccgcccgccatcgccgccagcgcccgagcagctctgcctgcccccgtccacgcccgcacgctgcctgtgaggggagggagaagagagagaggggggagagattgggatagagatagagtatggagagagagggatggggactggcaggtggggcccaccattttttattaaccaattggcactcatgtctaacaactcaggggtaaatatgtcttttcacgttcaagttagcagtcaacacacggttagctcacgggagtggcatgagagggtgcgcaaatttgagccaatggcatataagagaatagccaattttgtgtggcatatcagggattagaccaaatttcaatatcatataagggattctctcgaaattatatgaaggaacgttatctagcgtgttggagaaacgcctcatcagctaatgtccaatctcaggaatgaattgaagtttctaggcttctagcttgcagtctagtgcaatgcttgcgcaccatgagatggtttctcaggatcgatggtggtttctttgaaacacaaatggtatagtagtgcaggtcatgctgctactgctgctgcaagtatcccccagctaccgatgatgcgattgatgatacaagtaggcaagctgctgctcagagttttccagcttatctgtgatgatcatggtggtggtggatggtcaaattattcagacaacaggatgatgagtcctggctgcctcctcttgcatgagacagtaattgccaaattggcagacaatttatctttcttcctatccataaatctaggacggagtgaataagtgtaaatattaatcaaaactagcaaatatgctcgtgccttgcaacgggatatccaaattacatgtatattattcatatttattacacgatttgtgcttttctttacttatacgatagtggtgagacagatgattgacatgggaatcggggatatttgtttttaaaatgtttgtcgtgggtacacatgattgatgaaacatatgatagagatctgaaggtcaatttacgtattgttgctaggtctaatgattcgtattcaccacaaggaattgtgaaatcactccatggacctgataagcctgggatggtgaatcaaacccacccttgttggttttaataaaaagatgtgtattattttattatctaaattttaataaaatctattacatacacaaccagtgaattagtgaaaaacaatcaattaatagctaaaagtgcttcatgaaaagaaagcacaacacaaaagttatataaaaaatgcacggatcgataaat

SEQ ID NO: 54199 - DNA, 1281 bp, Oryza sativa
tcctataatattgacatttcataatataacggatctaaacatcatcctgtactatgttgctatattatgggacggatagagtatttaatttgaatgttctgtttaagaaaaaaaaaagtaaatagctattccctccatcccaacatataagcatttttagaataatgtcaagtcaaactttttaaattttgactattaatagcaaatatatataaaaaaaatcaatcaatgtaaatttgatgctactggatttatcattaaataaactatcgtaatatacaacttttttatttaaaatatattacttttataaatattattggtcaaaatagcatatcgaagactatgtcgaaattaaaaaatacttatattttgagacgaggggagtaagaaattgtcggacagtctcaagtctgaattggacagtgtgaggctttctcgtttgtttgcatgttcttccttatcaggagtaatatgttttaccaggcacatccctgtcataattcaatccaaaatatatatactaaccatttgatgatgatttctagttttcagatatttcctttggaagatattttcagatttcatggtgactaaatattgagttttgctctgggcttgtgccagcaggaaggtctatcagaaatctcagaacgaactagtcaactcattttctgctaatcaccaccaggtcatggttttgggcgatggaatgaaacggtggtcgatgccaaagatgtgctaaacacgttgagatggcaaattaattacaagggcttgctccacagtctacgctgcagttgcataaactgcatcaagcttagagatggcaatggtacccataacccgagacccgacgggtttttactctattagaagacaatcgtgttctaactcttatacccataggtctattaacggacgaaaactcttacccattgggtacatgggtatgggtctgttctttacccacccgtacccaccaacccgtgggtagaaaaaacccgttgattgagtctaaaactatgagcattataactctcaatgactactaaatcatagcataaaacatttttcacatcttaaagcatcgcttagtctagttatatgaaattattatttgatttcttgattatgtaatgtggttgtataatttttttactcgcctttgaacactgatattaatagcattgttgctagagaaaatattgatggtttacaactctaatatagctaattatagtacaaaactataaatattacaagtcaattatatgatta

SEQ ID NO: 54200 - DNA, 1501 bp, Oryza sativa
ggctccacctcctctagaagctgccaccaccacctcctccggaagccgccgatggtgagccctgaggccgaagcctctttgccgatctcagccgtccgatcccctagatccaatctccactgtcggatttccataactctttccattgccacgttagccctagatccatccacattatctccattttatccatcttagtccacatggcagcagtccatcatacatcgagtccaccatactcaaagccgctgaccatgggtcccacatatatttttctgttacaaaataattcaattcccgatattaaatacccatagaatattcttgtgtcggtgacatgggatcaggagtatcatgactagaggtttgaggcagacacaatcgcccacgtggcctggcaccctcggggaacgtcgggcctgagggtgatgtgttcgccctcctcttagtccccccgagggggtcgggccgcacccgcctcagccccgagggccgaggcgccccgacccctcgtgggttttcgctccgcgtgtatgggttaggtgagcacagtggggctcacctaaccacatttattgcgatttggctgagcgtgtcacgccgcatgtaacgcagtgcagtgcactcatttatccggtctgtgaccagtcacagaccggtcagattgcgggttaggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaccattacaggcaagatgttatgtgaagaagggcgaacatgtagattgctaagctgacacgtggtggacaagaatgaccgacgtgactggtctgactccggtcatgtcgacagcagacagccacgattccacgtcgcatctgctcccggcgaaagtggaggtagttgtgggccgtcccatcagaaggtgactcggacggcaactatacaaatctccgtccatttatgaaaaggtaggggaagtccccacaaaaaagagggaaatggtgcatgtggtatccccttaagatataaaaggaggaccttgcccacttagagaagggggggactggacttttccagattaggaacccagaacaagggagaggctggctcatactttgtagcttcttcatatgcgaatccaccaaaacacaggagtagggtattacgcttctcagcggcctgaacctgtatacattgccggcgtcttgtgtgcttcctgtctcgcgaaccttccacagattgggagcttagagtctcacccagggtccccggccgaaccggcaaaggggggccagcgcggtctcccggtgaggagccccacgctccgtcatctggcgcgccaggtaggggactctgcgagtgatcttctgagctctcgcactccttcgtgtgcgccaagcttttcctgttcagcccaa

SEQ ID NO: 54201 - DNA, 595 bp, Oryza sativa
ccatgtcacgaccagtagcccccggcgttatgccagggcgatcgccctctttaagggaagcggtcgggcgtgatgccactcctaaggcctggtgacaggtgggaccggtctccacaattgggcagaaacccatcggtcacaaatcacgcacatctgcagtggtaactcggctgtcaataatgagcggtctcttcaagactgccacattactcgagtagcacacgaatctggacatggcgatttgtttcgtctggagatatggtaacgtcgcttcggtcggcgagcgtaattaccgtgcgaacgatatgatatatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 54202 - DNA, 1501 bp, Oryza sativa
accacttgccggttgggcgctccctgctgggagcgccggcctccttctttttgtctcccgcaggcctcccctttcgggtggcccgcggtgcgccctcgacggcgaggacatgaccctcgtcgtcggtatgggctgacctcttcttcctcctcctgtcacgccgccctgtctgagcggcggatccgggggcggccgaagctgccacaccggaaccggaggggttccaggtccatgcctcctccttacgagccactcgatccgcgagctgaaaaagctccgcggtagtctggggctctttggaggcgatcttttcgagcatgcggttgtgccgcacacctcccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatacgtgccttgaaagttcatggtgaactgttggcacaaatcctcccaagagtggacagatgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggtgatggtgggccggaaccttgggggccaacggacattccgaaggctcgccacaaaggctctacagccgacaccaccaaccgggggcacggagggctgatccccgcgtccgtggtgaggtgacactccggacgaggaggtgccctccgttgcgtggggagcacgtcggccattacgccggcgctcgatactgacgcgggcatccggttccccacgcagatcatcccgggtcggaggcgttgacgaaggaatggcggccgaatggcgaacagcggctgccgctcgccgcgccctccgtctcgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcatcaccgctcatactcggggagaggtcgtgcgcctttgctggctcggccattgggctgaacaggaaaagcttggcgcacacgaaggagtgcgagagctcagaagatcactcgcagagtcccctacctgg

SEQ ID NO: 54203 - DNA, 1450 bp, Oryza sativa
aggttgctacatatcggaacggagggagtagttgggtaatgggtggagcactctcacagaatacattagagaggtggatttaggtttagactactccacaactctactccacactcaactcctggagctaaatttaggagttggagttctaccaaataagtaggtctttaaaaacccaaatgaaaaggctgcttatttatttaggcttagacttttttatttgtaagctagattataatcctaagagtaaatttcataatggaccagtttttattacctttgttacatgatggactaggtggtagcacaacttttcactttgggctaggtattattaccaaaagttcacttaacactagtggcccacatgtcagtcagtgtcggtatctcttatctctctcgaacactggtggccaacagttaacagatatccacgaaggagctcagccaacgcttactcaacctaatcgtagctgcttaccatcaacttctcccctgcagcagcagcttgttggatggaggtttagtttgagagattgcagggccaggagggtgagcttgatgcaggggcgggtgcgggcgagatcgaccgagtggcctgagctgacgaaggtcgagctcaaacttgagctccagtgcacaggcagggattggaggtggtaaagctagattggtggcgtgatcttgatggtctgctcaccgccgatggtgagctcgagcgcggggcaatgctcaatgcagatccagtgcaaggtggtgtcagtgaaggtcgagctcggtgcagcgtagggcggtgcagcgtagggcaggggcttgatcaccggccggcggcagctcactcaaggtcttggtctcccgaagccttgctcatctgtggtagcgagcttgagctagatggcaggtgcagagacttctacaaatcgggtacaatacaacttaatggagaagggagttggagaagaacaccggttcaatgtgcaactattgtagagttagcaggcccaatgtgaaaaagatatatttacctttagtccaataagcaaccaaggcaaatattagcggtccaatatgcaattcactctaattctagataaaaagggactaaattttgaatcgtttgaataaattttacaaaaaagcatccacatttcaacgaggttttttttttaaaaaaaagaaccgctagcccgctctcacgtggtcagcacgtgtgccacctcagcatcgccccccgcgaacgaaaccgctcagttcaacccactcgcctctctctctccggctcgcggttttgtcgctctctctctctctctctctctctctctctctctctctcctgatctctcctcctcctcctcctccatccgcgcctccacatctccacacgcaacacacggagacgaatttttctcctggtcccttctcgcctcgcctcgcctcgcctctcgatccg

SEQ ID NO: 54204 - DNA, 175 bp, Oryza sativa
tcctgcacccctatccaatgtactttaagcacaacttttcgttttttatatttgcacaattttttttaataagacgagtgatcaaatattacaagtaaaaacttaaaatctattatattatgggacggatggagtagtattaaagactttctgctgcccccacccaaaccacagg

SEQ ID NO: 54205 - DNA, 313 bp, Oryza sativa
tagatagaaattactctatgattgctggtttactaactgaagttgcagcttccattatgggctaaagatgcttcctgatacaatatgatcccaatatccccatgctatctcatgataagatgcaacttttaacagaataatgccctaatccacatctctaagctaccttaagctcaccagcaggcatattctctgggcatgtccagtggagactttcttgctaatcaactaggcattatttgttacttctggttcagatgtcaattttttcatggtacatttttttcttactctttgcgtattttgtactagc

SEQ ID NO: 54206 - DNA, 1501 bp, Oryza sativa
gataacaaaggatggcataataggttttcatttccaaaagcagcatttagcaaacatttgagaatttaataaaacagttgagtaataattaaacaatattaatccaacactatacaacgtaccctgttgtataggcccaaccattctgaacaaccatacccggctgtacagatctatctccaaaccaggaatataccattccaaaccaggagctaatcaaattattaccagttatagcatcatttattatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacattacctctcgtacaacacaatctaccacagtgcaccactcccggatcatagtcacccccttataaacaaggtatggactccccagcgaacccccgtgggcttatctccgccacttctcagtctggtgctccgcaatgaaccacgctatacaaaaggtaaagccgttgcccaccctagcttgtggttggcacggtaaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgagctatcagtaaaccatcatgaaataatagtgagtcataagttattccaatagtgtgctaatgtttctaagcatggctaagcaatcacatctaatatctagctgaaccaataaataaagctcaactagtcaagttataataacccaaggtatcaaggaataaagtaatcaagaacaaaagggctataacaaagaataggttaattccacccaatgacattcgaaaataaatgcaatagttgaatagaaacaatagctttaaataggatcaacatgctcaaagggttctttgggatctgtgtgacttgccttgctggccttggaactcttcaaactcttctccgacgaaaacggactctccggaaacgacggaatctaaacagaaagaagcaaaatcaccaaaacaacacataagcaagcatgaacagtacatgtcgatctcaattttagaaaaatttagagacttgaaccaactaaatcggagctaagatgaattaattatgaatttttgaagatttaatcggattaaaacacttatatagattttaattgaattatgacgcaataatgaattatttttgaaaaggaaaagaatgtttattgcgtcagcggctagggtttcggtggaccgggcgcacgggcgacggttcacgcgaacggacggccgagatcgacttgatccaaaacggacggccgagatcgaacggtccacgaccggctcacgggagacggggacga

SEQ ID NO: 54207 - DNA, 1501 bp, Oryza sativa
gccgttcattctaaaatataagtgtcttttgatgaatttgacatatcttacaaaatctggacatgcttttctagacccgatcttctagttagggaataactcttgttttaatcaaatgcgatgtttgcggcatggctatcaaacagaacaagtctaggactgtcacgccttgattttttttgggattaacaatcattaaataatgcatttctagaaattatattaaaagttaaaacaagttctcaagtggaattaatgtgggaaattaaatttcctttaaaaataatggccaaaaatattttttaatattctccgtgccctaaaatattctctgaaatttcctgtgaatttttggagctaaataagtaattttaataatacaaagtttatttgatcaattaaataaaatgaaaaacaaattaaactccccgccttccctttgggacgttccagcccaaagttcgctttacctccaacctcccccagccccctctcccttgaagtctactttacctcccccaaccagtctcccctcctcctcccttcgacaggtgggaccggcggccgcacttgtcatccccagcctccggcctcctatcccagccagccacacgtcgttgcccactccgcgtgcacgggaaccctccgccccactccactcatgttggtatttcttaacgatattactagaaatataattccagcaatagtgtagaactactcctggtatattatggttacagagtttatccgcaagcgcacggatataccataatagcatttcacccgagagtattccaagggtattgtatttgtttaatcctgtgggaatattataatagagagaaccatacaaataatttatatattacttgtaataatcaaagtctaagtagggggtaatataattcaaatgggtagagtgacactaagtagaagcattcatcctcttgctcatgatatctaaactaagtggaaagaatatagaaagatcctatttctacacttctagtatacatacatattatatatacatcctagttatattattacttagctaatacactctatctgatgctctcctggtgctttgagaagccacccctaattacggaggagtacccctaatccgtgctgagttccttacgacaatctgtcctgaccatacaatcgggctaaatacggaggagtaccctccccaggaaattaacttaggactatatacatgtgcggaggaatacctgtactgagctgtcaccatcagcggcctacctcgcttccgcagcatataaccccaaataatgatatccagtaatctaaacaccacacttaaattaccgaatactactctaatatcatcgtcatgacatagagtcatcgtaaatacaattattatacccacaccattgtatctcccaaataagctagtatcataataaatataactcaaacatatagtaaagttggtattcatatactcggaaagtaatacaataccata

SEQ ID NO: 54208 - DNA, 1501 bp, Oryza sativa
aactcggggagcggtatttatccgagttacttcggatgaaagctctgcctctcttagacattcatcactcattatagaagtcagctcccgtacagtttctattaggaacccaagttccataggatcgggaggtggcaaggggacgagtggtttctttttactgaagtagttcagggtgttaccatagtcttcgtcaaaaccatccctgaacatgatagcggcatgatccggagtctgaatttcttcattctcaacggctggtggctcgggaactttttcaacaatcgagtaggtagaggtggaaggttcagattgtgactcgattgttgaaggttcctctatcttggacacggatgcttccaataggggttcattgcatggcgtcacgaaggaagtattttctagaatgtggtctagaattacttttccttctgacggcattttgtgcatgaatgatcatccggcagttatgtccagatagaatgcagactccttatttagacccatatgaaaatgttgcaaaagcacatagtcaggtaaggataagggttgtccggactgcactaaattagtgaatctggaccaggctgcaccgatgggttcattttcaatctgccagaaactgagaatttctacttgaagggcagtaatacgagtaactgggaagaaggcaagacataatctgtcttgcaacttttcccaactaccgtttacacatccaacggtagatgtgtaccattgcttcgctctctcatgaagggagaacgaaaacaatttccaccatacagtttcttgcttcatgccatgaatcttaaggcatgagcagacttgctcaaagtcccacagatgatggtagggattttctagatcaatgacagaaaaagagttttccctaaccatactaattagttcagggccaatttcatagccagttgtataaattggctccgatgaaggaggtggctcatagaattcgcacctaggagcagacagctcgaagagaggttgctccatagtcgagaagagtttgatgggaatacttctacaggtagtaggggtaaaggtagaataaaaaatgaaaagagatacaaggatgaactgggtttggaaatgatcagcaactggtccccggcaatggcgccagaaatgcttgttgataatttttacggtcacagtcaaaatccgcaagcgcatggatataccgaagtagcacttcccctacggagtattccaagggtatcgaatcctaacgcaatactttaggcactggcaacccgctgttcccagatgtcgctctactacgtacccggactgggaggatgcggggatggagagtgggatgctcaccgagtgcacccggtgggagaggcgacgtgggaggaggccgatggcgtgtcacaccctgaaaaatcaaaatatataaattgttgtttaaatggaatttttagaaataatttttaaaagcctagaagagaagatctaatttttaattaataaattc

SEQ ID NO: 54209 - DNA, 1501 bp, Oryza sativa
gattactggatatcattatttggggttatatgctgcggaagcgaggtaggccgctgatggtgacagctcagtacaggtattcctccgcacatgtatatagtcctaagttaatttcctggggagggtactcctccgtatttagcccgattgtatggtcaggacagattgtcgtaaggaactcagcacggattaggggtactcctccgtaattaggggtggcttctcaaagcaccaggagagcatcagatagagtgtattagctaagtaataatataactaggatgtatatataatatgtatgtatactagaagtgtagaaataggatctttctatattctttccacttagtttagatatcatgagcaagaggatgaatgcttctacttagtgtcactctacccatttgaattatattaccccctacttagactttgattattacaagtaatatataaattatttgtatggttctctctattataatattcccacaggattaaacaaatacaatacccttggaatactctcgggtgaaatgctattatggtatatccgtgcgcttgcggataaactctgtaaccataatataccaggagtagttctacactattgctggaattatatttctagtaatatcgttaagaaataccaacatgagtggagtggggcggagggttcccgtgcacgcggagtgggcaacgacgtgtggctggctgggataggaggccggaggctggggatgacaagtgcggccgccggtcccacctgtcgaagggaggaggaggggagactggttgggggaggtaaagtagacttcaagggagagggggctgggggaggttggaggtaaagcgaactttgggctggaacgtcccaaagggaaggcggggagtttaatttgtttttcattttatttaattgatcaaataaactttgtattattaaaattacttatttagctccaaaaattcacaggaaatttcagagaatattttagggcacggagaatattaaaaaatatttttggccattatttttaaaggaaatttaatttcccacattaattccacttgagaacttgttttaacttttaatataatttctagaaatgcattatttaatgattgttaatcccaaaaaaaatcaaggcgtgacagtcctagacttgttctgtttgatagccatgccgcaaacatcgcatttgattaaaacaagagttattccctaactagaagatcgggtctagaaaagcatgtccagattttgtaagatatgtcaaattcatcaaaagacacttatattttagaatgaacggcctcattaattctgcaatacgtggacaagactatcactgcaggcgagccaatggaggagactagcttaccaatgcctttcctaagtcaagcctacgctgcgtgtttgtttcccctttccagggttacgctccaccactcccgcaagtccacagtacgtaacgcgcgccatacacccttgaccctt

SEQ ID NO: 54210 - DNA, 1501 bp, Oryza sativa
ggcgaggagcgagcggcaactctcccgccccttcctctcctcgtcggcgccggaatgcgccggcgcaaccctccccctaccctcctcggcagcgatggatgctcgatgatgacgaacttggtccctctcggcagcgacggatgctcgacggtggcgggcatggagctcagtcggaggcggacttggacctcctcttcttgtgcgccgccgccgcttccatcttcttcgtggagttcgcccgcgacctcatcttcctcgtggacgacgagcggcggcgcggtcatcctcgcaaaggtcgccgccgaccggagccccgtcgccgtcttcgtctttcttgcggagctgggatgagcggcggcccgagcggtgacggggcagccagatctgccctgggcgtcggtgtcgggcgtcgcgcggaacggccgtgttgggagtgggggatggcgagctcggcgggggcgtcccaagcggcgaaggcaacatctcaatgccggcgccacctcaccatctctcctctcaacgcaacaccgtgcatcacctcagtcctctctcctcggccctttctcccttctctgtggtgcaggacacgaaaatgtgggcccagagttgccgattctgacgaggtacctgtggcaaaacttggctatgcattcttcctgaagcaagggaatagtccgacctggaatgaaatctttgagctggccggcttgggctgagtgtcacatcactgcattgtgaatgacctaagacaacatgctggtggtccccaatctgccatcccaccaactttattctataccactttcatcctaaaatatatttcctccgtctctcaaaatataagtatttttagactttgacacagtcttcgagatgttaatttgaccaataatatctataaaataagatgttttaaataaaaagagttgcatagtataatactttgtttaatgataaatcaagtaacatcaattttacatgattgatcttttttatttttttctattaatatttaaagataaaaaatgtttgacttgatactattctaaaaatccttatattttgggacggagtagtagcaattattagttatgtatcttttcagataaataaccaataattgttataatttggatggtggaatattatttgtataatagaatatgtatgtgatatttggcatattttataattttgaacccaaatgagacctatggaatgtaaatatcttaaataaaaaaagattcatcgataggatttatttctttgacaaatagataaaatatagtattaagcaaatatctttgaatttgtttaataatttaattggacataagaaagaattgattatgggtttattttcattatctttattcaggttgatttatgttttagtttgtaaggcgtataaatgtatcttagttcaatttgggaaaataatatttatttgaaagaatataacattttatttgtaaaataatttattttagttttcgttcaa

SEQ ID NO: 54211 - DNA, 1183 bp, Oryza sativa
atttgcttttatgcatgaattgaatgttgtacgaaaggactgtcaacaatgttaccatgtctggttggacacgtcatgatgcaagtgattctgacaaaaccctttgcataaccctgcgctaaccatccacaccacgccgatgtttcacctacacccctaaaccagggtgggcaacccccgtatgccgcccttaaaccaaggccaacccaactcaatcacgcccatccttgcctagatgtctatgatagggttgaattatactacaggtccagttgttgtccactcttgcttgttgttgatagtcgtgaagtaccaattttgaccaccaaatatcataataaataacaggagaattaacatttcttacacgtatatcagtaatgaataatgtagttgtactagacctggagaattaacacgaattaacatggatgcgtaattcatccaatgggacacgcttagatcgagggattgggatagatcagtggctgcaccgagacagtataaatcactctatatctaaatgcgccctgaagcagggattacgcatgctgacagcgtagatgatggagcaaaccaaacctgcatcagctaatactccgatactacctcatgctaagataccagcacagataaaatatataaaactgaaaccaatctagcaagcacaatgaactagcagatcgataggaagcttaacatactttaaaaggatgggatcttggtatgaggggcagatttagacgatccatgaccaaatatggaagtaaaatgactaaatcaagtaagatcggctgaaactctgatactatctctattagtagtcaaagaaataactagataaaatgtttcaaaacagtacttaacagatcgaacctaaccgatgcagcattaagcgtggggagaaacataagacctaattaaatcaatgaaaactcattcaagatggtggatataccgtgtaatctatcctaatatcaaagcctaagcctatcggccttctccgatgatggaggctagctaatgaagcttagataacgagatcaatctagattacgtgatatatatgataactcggcggtttgcgtggacaagattagagtgtcacgaagatgtaagcactaatcccgagaacgtaagccgtcatgacaagatttacctcttcgtcggagatcgaacttga

SEQ ID NO: 54212 - DNA, 583 bp, Oryza sativa
agccctgcaagtagtcatttgttgtattaaaattaattgatatgtataattaatttgttagttaaacatatggattatgcagtgaaataaactttgaggcagcaattgttatacgagcaagatggttaaaaaggagtaggcggaatctgataaacgcaggtaaatattttgtcatatttatgtacgatatggtttggttgtattgttttaagtattacatactcttttacttaaattaattgccatagttatgtttaattacgtgttttaattaattaatatgtattaattttattgtcatgtgtttatttttttggtcaaagttgtagtaaaattataaataataaattgcgttgtcatgtattcataagtaaataatttatgtttacataattatttatttataaatttttttattacaagtacatgaattttttataaataatatggaaatataaataattagttattgataaagatttttttatcaaaaaaacagtatgcgtgtaaactaatttttgtcgtgaataggacacgtttgttctgtaagacttccttacggagtagtccgtgttgactgcaa

SEQ ID NO: 54213 - DNA, 1279 bp, Oryza sativa
aatttattgtgattgtgtggacgttgaagcgttttccggtgattcctgaatttcttcaagtcgcactatgctcccactatcctttcttgagataaactctttctccaagaaaacactgtcgggcgacaaacactttcgtttccttaggataccccacaaagaagcatttatcttatttaagtgtgagtttgaccgattgcaaacgttttacaaaagcctcacagccccaaatctttaggaaagacatactgggacggttccctgtccatatctcatatggtatcttatccacggattttgatggaaccctatttagtgtgaacacaactgtctctagagtgtaacaccagaagcttaacgggagatcagtttggctcatcattgatcgcaccatgtccaacaatgtacgattcctccgttcagacactccattccattgaggcattcctggcggagtgagttgtggaacaattccaccctcctttagatgattgccaaattcaagggtcaagtattctccaccacgatcagatcgtagatacttgattgtcttgtccaaatgattttgtacctcattatgaaattccttgaacttttcaaagtattcagacttatgcctcattaagtagacataaccatatctactaaagtcatcggtaaaggtaataaagtacctaaaaccacctctggcagttgagctcattggtccacatacatcagtatgtactagtgccaatagctcattggtgccaaacaatccggtgagtagagcggcgtggagtctgcataagttatgcgtgacttatctagttcatttacgcggagtggagaattggcggctggtaaatgccaattttattccgccaatacttgcataaatcagaaaatatgaaacacccaacatagtggtagggtttaattctaacaatttccacgagtgttggtctatatgtgtatgcaggtgacaaactaccaaagttgagacgaaatacatatagaaaatgaaggataatttcacccattgagtcttgggctcacaaactcatcgaataccaaaaattgtgcccaatcaatacaccactgggccaaggagtattttgccaaggcctaggagaaaggccacagccaggggagctagccagggatcggccgaccccggcctagccacaaccgcctatcccgtctcgccttgccctataccactgcctcctctactctacctatcctcactctccttttgcgacctcacactagcacatcttagcggccgacgtcatcg

SEQ ID NO: 54214 - DNA, 281 bp, Oryza sativa
tctcgttaaacgaactgcgtttttgctagaaagtcgccgcgtgtggagaaaatgttgggtgacccgacgacctcacgctccgtccgatccgagaggctgagatctggacggcgaggggctcccccaccgtcggatcgcgggtgaacgggcaccgttgaaggtctaaagcccccagccagaggcggtttcgtcgtcgcgtgtgcggtggaattttttgcggtggcggagtggcgaggccaagaaacggggagaaatcgcacaaaaccacggcgttttccgca

SEQ ID NO: 54215 - DNA, 182 bp, Oryza sativa
ttatatctagggttttgtgcaacttcgaccataaaatatggggttttctgaaatttactctattttaaatgttatcattctgagaaagatttttgtcaactgcaagactatatgttacaatctctttttttttgtacttgatctaataatatatctagctattatattatctcgaaatatgc

SEQ ID NO: 54216 - DNA, 610 bp, Oryza sativa
aggctatattgtgcacatgctctgggatataccgcgttcaacaattaagcatgtgatccatggcttagagtgttttatttccttggctccatgcaaaatcttgtagtagagtatttgaaccccataaaaaaaattggtgggtggatctaccatgatcagggttttagaaactgcaacaacagtcaaaactggatcccgtctttccagagagcaaccggtccaggacaaaattagattggttgctggttgatggaatgaatgcttcctccttggttctgtccatgaggcagcgccaggatttgagctttgcgatgctagtcatctgaatggatgttgaatttgagtggctgattctggttgaggtgctttacatagcagcttaagaaatagttcttgttgcatagttgtatgtactgacaaatgatctagaaaacaatgttcagattatacaccatacacaaaaagttggaaaaggttccttgagatctgtaattgttctttaatgaaaatggagctgaggttaaaaatcttttgggtgatcttgattaagcaataaacttttggtcatggttatgctatctagtgaattgcttttctaatatacctggct

SEQ ID NO: 54217 - DNA, 1501 bp, Oryza sativa
gcgatgccggtatatttccacaaatcccgccctaatcagcttattcttgcaattccattcaagaaaacgattactttcaaaaaattttctgtgtgggaagttgtcagctagggactaatgtcagctcatgcccagagtttttccatttaggccctgtttatatccactgagaaaatttaacaccttgtcatgttgaatgtttggacatatgcatgaagtattaaatatagatgaaaaaatagctatttacatagattgcgtgtaaattgcgagacgaatcttttaagcctaattgcgccataatttgacaatgtggtgctacagtaaacatttgctaatgacggataaattaagcttaataaattcatctcgcggtttacaggaggattctgtattttgttttgttattagactacgtttgatacttcaaatgtgtgtccatatatccgatatgacatgccaaacttcacacccctggatctgaacacagcaacaaaaagctataaatcgaatgtctgatattttgcaaaacatcgaacaatgttgcattgtattgtttaaaatgtttcacatgttgcactcctcaatgaaaaatgtttcagatgtttcatcaatcagggaaaatgtttcaggtgtttcatcaatcagggaaaaatgtttcatcatttcaacaaaagtgtttcaatcaaatgcaatcgaaacatatcatttgcaagatgaagaatcaatatatgcaacatcgaatcaaaacaaaatgaaacaccttaatacaaaaaagtgcaacacaaagctaaacccacctctatcttatttttcaactccggtcgccgcccccggacgattagttgcacaaagtgggcgacctcagctaggactagccgcaacagcatcaaccccccatcggtggccatgtccagtgccatcgctaccgtgtcgctgggatgacgctaagtttttgtgtgggcaccagctgcaaggctgttggtatttcttaacgacattactagaaatataattcccagcaatggcgcataaatactcctggtatattatggttacagagttcatccgcaagcgcatagatataccattataacatttcacccgagagtactccaagggtatcgtatttatttaatcctgtgggaagatcatagtagagagaaccgtactaacaatttatatgttacttgtaataatcagtctaagcaggggttaagataaatcaaagggtagagtgacacacaagcatggagctactcgttctcatactaaaatatctaagctaagtggaaagaaaatagaaagagaatctactcctatacttctagtatacatattatacacacactctagttatatgattatctagctaataccctctatccgatgccctcctggtacttcaagaagccacccctggttgccgagttccttacaacagcccgtcatgaccatacaaccggggctaaatacggaggagtaccctccccaggaaatt

SEQ ID NO: 54218 - DNA, 1501 bp, Oryza sativa
gaactactccatcggcttgtcagtcgatcgtctgttttgatctactatttgcatatcttgtcagttgcaggatcaaactgactggcacgctcgtatctcaccaatttttggacctgcacaggagttaagcagatctcccaggccggtgtattcgattttttcgtcaacacgcttggaacaggctgccgccctaccagttttccgcgaccaccacagtcccctgcctcttcgtcgacatcgcctccgccatcttcaacctttccgtccactgggctgctcgtcggcaacaagcacccgtcgccggcatcctctccatctgccgattggaggtcgtgtggcgccggtagtcaacgcgcacagcgacgcgcgggggctggcacaggtcgagcggtggcggtggtcgtcacgcacggtgacgtgcagggccgacgatgggcggtggcgcgcaaagcagaggcaggacgtcagctaccacagtcacggccgaggcggaggtggagaaggccgaggtgtagggggcagtattggcggcggtgaggctccccaccggttcgccctccccgtcacgctcgccatagctcgtcgccggccactcgctacccagctccgacctccacctccgcgtcttgcgcttccgcccacggccgtccgctgctactcgctgcagcaagaggagggaggacagagagggcgtgccgccgtcgtgccttgccggctggtcggcaccgctcgccgcagcaaggggagggagaagagaaagggcgtgccgccatcgtgccttgttggccggccgccgccgctcgctgcagcaagggaggaaggagagagagagaggggggatgggatttaggaagagcgagtagagagggattgagaggaaagagagagaggagagtcttacaggtggggcccacactattttttaaaataaaaaattgctgactggactgccacgtaggactgaaaccaccccagattgagctaggggggttatttgtcaggtttgtgtagttaagggtgtaaaatatccggtatttgagtttagggggtaattcgatcgcccatgatagttcagggtggtaattcgaactttttcctaagaataaaagaatagtcaatattacactagtacatattcttacatgtgtaacaggtcatttgtgacgggtccaataaaactgttacagattatgtcatctgtaatggctgatatagacaaccgttaccgatgaccaaaacaaccttgagccattactgaagcccccgtatctgtaactgctcctaaccgagggcagttacagatgtaagctccattatctcactaggagccgttgcagatgacccactcatctataatggttctccattaagagccgttacaaatatcggtcccttagctataatggctctcaacttaaaactgttatagatatgtcactcatttgtaacagctccacatttagagccgttacagataatttctaggtctactaacttaaat

SEQ ID NO: 54219 - DNA, 1501 bp, Oryza sativa
  unsure (1)..(1501): unsure at all n locations
atcaattctataagtgtttgtatatatcaaatgtgcaatatttatccgttgatcctctcttcttatatcactacgtttcgaagttgatcctaatgtcccattacattagtctgacaagcttcggggtctcattgaccttggccggggacgcttggcactgataaagcttgtcgggccacgcatggtcaaacgtccatgtcagattggtcatgtcagaggcctaccattaacatcctcgatttttaatgtaaaaattgaatgcatcatgctgagttttattcataatcttttatttaataaaaaaatccttttaaaagcttttaccttaaaaagagaaaagagggtttgaattgaattatatagttcaagtatctccctttcaatcgtattaccaaacctgcctggtggtattgcaaaaatatcaattctattcatccatctcaaaggtnttttttccttcttggggggaaatctaaatttcctttataaaatccaaactccttctaatttaggtgttattctaaatcctttgcaaattcaaatattttctgaactagttctatgagtgcactcttaagtacctcaaataggtttagaaacctttttctacccttaacctatccaatcttggatataaccactattttcccaactagtttttgtcaaaaacgagaaagagtacctgagtggcccaaattttgatccaaaacctttttttaactaaatttaatctctagagacctaaatcagcttgttcaagtcctcctttgctccctaaaccggcgaaggattttgtgggccacggtgcgccgtgtcgtgcccacaccacgccaacgcgcatcgacaccctcctccatcacgcgcgtgcaaccacaatggcgcaacatccatctatccaccgcgccttggataccctactttctaagcactaatcttcccgcgatggaaccggcaagccaatcgcggagcgatctcatgtgcgtgccgtgcccgccactcctcctccgctggccgccatccttcgacatggagacatcccagcgagaagcccaaccaaaccatcacctttcagagctcaaagaaacataacttttccctctcacatccccaaacatggcgccgatgagccggccgttttcctcaatgccgccattgcacgtcacactaggagagcgccacctcgccgccgccttctaggccgtgatttaaatcccttccgccaccacttaaaatagatcattcgtcatccaatttcaccttctcctccctctctcagccctctgttcctaatggcactaaactcatccacggcactaatggcagccgagtgccgttatccaccaaccatcaccacaccatcacaccaaagctctacatctccatacattgctaaggttgctgtggagcactggtcttagtgtgcgatcacgctgccgccgctccaatcctttcccagccccgagaacaagttgaacatcgcttacatgctctgttttgatcc

SEQ ID NO: 54220 - DNA, 1501 bp, Oryza sativa
gtcgggtgtcaagttctgccgaaatgtaaaaaacaaaagtagaagtaaaaagggtggcgatgcgccgaattgtattgatcgtagcgatagattacatagacctcgggtgtacatatttatacccatgggttgatacaagtccttgtcggccaagaaagaaactttcctaaagataaaaggaaaagttaaagtccttataggacactaaacacactttcctaaagataaaaggaaactaacaaactattcctaattaatagataaactgccatgccgtatcctctttgaactcggtcgtttatgggtaagcttcctttagtagattgatttccttaaccgaatatagcaggaatccgactattggcgacttgataactcccatcggctgattccgagatgccatagccgatagtgactctaagccgatgatgactttggccttaccaaatttcactgtcaacaaggcggtagtctgccagatcggcgaggaatttgggcggtggcgacgagcaagctccggcggatggtggaggtcgatggcgtccatggaggagtccctggaggggacgagcgacggggtggagctccagtgtcaccacgcatccccctgtgccactgcccaccgcacgtcctcgacggcgccgctcgtcctctgccggcgcgccgccgctcatcacccacagccgcacgccgccgtccaccggtcgcccccgcgtgccgccgtgcacgccttgccagccggccgccgccgctcgctgcaacaggggagggaggagagagagagaggggatggggatttaggaatagagagtagtgtgagatttagaggaaagagaatgaggagtcttacaggtgggacccacactattttttttaaaaaaattgctgactggactaccacgtaggactgaaaccaccccggattgagccggagggttatttgtccagtttgtatagttaagggtgtaaaatatccggtattcgagtttaggggtaattcgatcgtctatgatagttcagggggtaattcgtactttttccttattcttaagctaccactccctcgtttcaggttataagatgttttgactttagttaaagtcaaagtgcttcaagtttgactaagtttacagagaaatataataatatttacattaccaaattagttttattaaatttgtaactaaatatgtttttataataaatttatcttaggtcgaaaatatttcttttttttataaacttggtcaaacttgaaaaagtcaaaacatcttataacttgaaatggaggaagtatattttttctgaaaaataatcaacacgttttaaaaaaacattacttattgattatatatgtagtacagggttagtgactagtatccttgatctttgcgggtactgttgcctatttatatgaccatactgtttgctagatatctggtccctctgtgtcatcaaacaaattaaccagcccactcaggccaagccctgggcaagtaga

SEQ ID NO: 54221 - DNA, 352 bp, Oryza sativa
tgatgacccctcgtcgatgacgagctaattttgcggtctatcaatacaagtcatctatgatcatcaaataacaccaaacatttttgatatcattgtcaagaaagaaactggttaacattgattgttttcccttcatttgaaaacgatatgtatgactggtttcaacctgccagaaaattttaccgataatccagaataacttgcgagaagagtccagcctcgtgttgttcctttgcaaatgaagctctcgacacctaatccggtcaaatttgcagcgtcaagccccaagccaatggctcaggcggtcctccgtgattacttggctccatatgttgccaacgtgcccatcaga

SEQ ID NO: 54222 - DNA, 763 bp, Oryza sativa
gttcattattttgttggattgatgtagcattccctgtacatagatcaaatcaaggcactaaatcttctattagatttttccaaattcggtgcttatttctttttgcttcaaataaatttccaatacggctacttgtactatgacagttcaggcacaatcagctgaatacatgaaaaggaaagcttcaggggttgatgaaaagtgtaatttgcacttgggaaaaacaaagctacctggaagtttgatgtttaggctaggtatcaaaacaaggaacatacagaaactacgctgcagccgagagagtaatctggaagatgtttgaagcagtattagtgtgacatcttccattaggctgataagagcgatatgatctttcacacaatctgttgtcgatgtaacaaaaggtgaatctcatgccttggggtttactcatttgtttactgagaacttctcagtttattattttggtaactagtggaacatctgcagctgcacatatgtccagtatagattttatcaatctcttatggtttctttgctgactacctctttgttagctcaacatatttccatcctgctatccactcgttttcttccttaaatacatccatactgccgtatgtacgtgtctccttatcagattgctatgataaatgttctttgattggaacagaataggaccactttgaacttcctctttgtaagatagcaatgtaggttatgtagaatttatatgtgagggttgtgttggtacttggcagca

SEQ ID NO: 54223 - DNA, 1501 bp, Oryza sativa
gcgagaactcttacacgaccagatcttacatggtctttcgtctctgaaggatccgacaaggccttatcggctctgggcgtccccagccgaagatcccttaggttcctcggaggccttgccaagacggcgtaaagggacagtaggataggtttcaacgctaggtgtcgtcgtggtaagggatctctgggtaaaacacttggcgatattgtgtacctgataccaactttgttggagtaaaggtagtaggagagtcgctacaccgctggtcgaggaccaggcagtagttgtaactcgaccacttaaagtggaaatagtcggaggaacactacatcgctggtcgaggaccgggcagtagccgtaacgcgaccactgaaagtggaagtagtcggaggaacactacatcgctggtcgaggacaatacagtagccgtaactcgaccactgaaagtggaagtagtcgaaggaacgatacatcgctggtcgaggaccaggtagtagccgtaccttgaccacttaaagtggaagtagtcggaggaacgctacatcgctggtcgaggaccaggcagtagccgtaactcgaccactaaaagtggaagtagccgtaactcgaccactgaaagtggaagtagtcggaggaacgctacatcgctggtcgaggaccaggcagtagccgtaacgcgaccactgaaagtggaagtagtcggaggaatactacatcgctggtcgaggaccaggcagtagccgtaactcgaccactaaaagtggaagtagccgtaactcgaccactgaaagtggaagtagtcggaggaacgctacatcgctggtcgaggaccaggcagtagccgtaacgcgaccactgaaagtggaagtagtcggaggaatactacatcgctggtcgaggaccaggcagtagccgtaactcgaccacttgaagcaaatgtacgagagatcactacgatcaactggttgagaaccggtgagtaggtgtccctcgatcacttggagtcgtggtacgaggaccgctacgctgccgtagtcgtaccttgaccatctgaagtaaaggtgcgagagattgctacgtactggtgcgagaaccagtgagcgagcagaattatctctcgaacaccaatggaaggtgcggtgcgagagattgatgcgtgctggtgcgagaaccagtgagcgagcagaattatctctcgaacaccgatggaaggtgcggtgcgagagattgttgcgtgctggtgcgagaaccagtgagcgagcagaattatccctcgtacaccgatggaaggtgcggtgtgagagattgctgcgtactggtgcgagaaccagtaagcaagcagaattattcctcgaacaccaatggaagtgctagagttggtttattgcaagtgtacctcatgtggccagcatgactcatgtacccaacttaaagcatatccggatgtccgttcgcaatcatgtcgggtgatcaagccgacgacgttcgcgaggaattatcc

SEQ ID NO: 54224 - DNA, 1501 bp, Oryza sativa
cccggctgtacagatctaactccaaaccaggagctaaacaaattattaccagttatagcatcaataattattgtgagaggtgtgagactaatcacgaaaaacattgctcaactcgcccataaccgcgggcacggctattcgaatagttttactctggccagaggtgtaccactgtacccacaagacacagccccacaacatgtcaccatgtgcctcaataccaccacggtatctcggaaaggagctgtgacaataccccttgcataacacaatccaccgcagcgcaccattcctggatcataatcaccccctcaaaaaccagaggcatggactccccagcgacccccgtgggcttatctccgccacttctcagtctggtgctccgcaatgaaccatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattgattaaccaatcacgattaaccatcatgaactatcattaagccatcattaaataataatgagtcataagttatcccaatagtgtgctaatgtttctaagcatggctaagcaatcatatctaatatctagctgaaccaatatataaagcccaactagtcaagttataataacccaaggtatcaaggaatagggtaatcaatgcaaactggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaggaaaaaaactaataaaaacaaaataaacaatacataaaaagtaaacaaacaagtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttacaaagaattagttatgaattttcaaagattaaatcggtttaaaacacttatatggattttaattgaattatgacgcaataatgaattatatttgaaaagaaaaagaggatttattgcgtcaacggctagggtttcggtggaccgggcgcacgggcgacggctcacgggatcggacggccgagatcgatccattcaaaacgaacggccgagatcgaacggtccacgaccggctcacgggagagggcgacga

SEQ ID NO: 54225 - DNA, 353 bp, Oryza sativa
  unsure (1)..(353): unsure at all n locations
ccaccgcctgaaccttcggaccagtagcccaggcaccggcgggtgcaatgcaatggaatgtgcacgtacgggcgcacggcgcagtttacatgcgacgaccgagcgagccctgtgcgtgcatatgatcagacagcatcgctcccggcgacgtccggtttggtggtggccgcggccgggagaagcgagctcctgcacagagggcagctcggccgcgagcggagccacgcgtccacgcactccgggtggaacccgtgcccgcacagcggcagcgccttcaccttctcgccctcttcgaactccccgaggcatatcgagcactgcgcggcgccgacgtcgtngccatcacctgcagt

SEQ ID NO: 54226 - DNA, 1501 bp, Oryza sativa
ctcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcaaggagggcgatcgccctggcataacgccgggggctactgtcggtgacatgggaccgggagtatcatgactagaggcttgggcaggagcaatcacccacgaagcctgaccccctcgggggggtcgggcccgagggtgatgtggccgcccccccctctctctttgtctccccgaggggtcggactgctcccgtttcggccccgagggctgaggcgccctgaccccttgtaggttttgcgccgcgtgtatgggttaggtgagcacagcggggctcacctaaccgcatttattgcggtttggacgagcgcgtcacgccgcatgtaacgcagtgcagcgcgctcgtttatccggtctgtgaccagtctcagaccggtcagatcgtggattaggtggcgacaggcggtctgacacacgcctcgccccatcccgtcaagatgagtgcctccaagcactcgtccctagccggagccggcgtgttacctcctggagatggcacgttggtcccggtcagatatatgccaggcttcatcctaaccattacaggcaagatattgtatgaagaagggcgaacatgcagattgtgaaactgacacgtggtggacaagaatgaccggtttatgaccggtctgacactggtcatgtcatcagcagacatccatgttcccacgtcgcgcctgcctccggcggaagtggaggtaggtatgggccgtcccatcagaaggtcattcggagggcaaccaaacaaatctccgtccattaatgaagagaagtgaagttagagggaagagaggagaagtcccgacacaaaaaagagagatggtgcatgtggtatccccttgagatataaaaggaggaccttgcccacctagagaagaggaggattcggatccagaacgaggaggggctggcttgcactttgtagcttcttcatacacagatccatcaaaacacaggagtagggtattacgcttctcagcggcccgaacctgtatacatcgcccgtgtcttgtgtgtttccactctcgcgaactttccacagattaggagcttagaatctcacccagggtccccggccgaaccggcaaaggggggacagcgcagtctcccggtgaggagctccacgctccgtcagttgttaacggataattcctcgcgaacgtcgtcggcttgatcacccgacatgattgcgaacggacatccggatatgctttaagttgggtacatgagtcatgctggccacatgaggtacacttgcaataaaccaactctagcacttccattggtgttcgaggaataattctgcttgcttactggttctcgcaccagtacgcagcaatc

SEQ ID NO: 54227 - DNA, 1501 bp, Oryza sativa
attgggataacttatgactcattattatttaatgatggcttaatgatagttcatgatggttaatcgtgattggttaatcaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgcctctggtttttgagggggtgattatgatccaggaatggtgcgctgcggtggattgtgttatgcaaggggtattgtcacagctcctttccgagataccgtggtggtattgaggcacatggtgacatgttgtggggctgtgtcttgtgggtacagtggtacacctctggccagagtaaaactattcgaatagccgtgcccgcggttatgggcgagttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttaattaaaatttctgattaattactccactgttttacttctcttaaatgttttgctaaatgctgcttttgcaaatgagccaatattatgccatcctttggtatcctcgtgcacttgcatatttgctgtgtggcttgttgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacacctaactacaaaactagaaatgtttacccctaaactcacttaaaccgtttaaagaaggtcccatgacagtatttttacccgattttactatcatggcatcccagtaagaaaaaaaactaaagaaattatatagggcccacatgtcacattttttccttctcttttattccccttctcttctctgttctctcctctcttcgccggcggcaggcaaaacggcaatgggcgagcacggatgcgggcggcgggctgtgtaaaatcaaaggtgtttttgattattattttgtgatgaacaattgggcattgaagattattggttttgttatttggaatttattcacgaagtggttttggaga

SEQ ID NO: 54228 - DNA, 1501 bp, Oryza sativa
gggaatcatatatatgtacatggatcgatcgagtaggatgcagaggtcgtcaaaagagtgggacagaccgagaaaatagacagtgctctgtcggcaattaaactagctataataatctttattaatttcatatgatctgtaggttactcactttaggtagctaatggttcaaaatcaatcaatcaagcttcattactattatttgttagtagctagcatcatatatttaataatacaaagtcgtttgcaactaatgcgtgccttcgcagctagcacagatcgaaaggaatatataccactcctcacatgacaagaacacagggacctgcagacatgcatcccaagttgaaacgccctctaattggacttgtgcatgaagcaatccatatttcattcgattcaattcatgcggagcattaggtacaattcatcccaactgctgctactctgcacatcgatctcaatcttactaaccttctaaggctcactagctcaccagctgatgtaccaccaagcagtaataattgtaccattctccacacttgcagatatgttcatcatttttttagagggtgtttagatctaggggtgtaaagttttagcgtgtcacgtatgttattatatagggtgtcgtatgggatgttcgagtattaataaaaaattaattacagaatccgttagtaaaccgcgagatgaatttattaagcataattaatccgtcattagcaaatatttactgtagcaccacattgtcaaatcatggagcaattaggtttaaaaaattcgtctcgtaaattagtcgcaatctgtaattagttattttttagcctatatatatttaatacttcatacgggtattcaacgttcgatatgatagggtgtaaaattttaggatggaacaaaacagagccttactcaaagcatgcagccgatcatatacctgtcagaaacagttttttttaataaagaaaatggaaacatgctatccgattagcaccatggatgaccgtactgtacatgcatatatattttctcaagttttcagcagccaagcattcctattagaccccacttatatattaggacaggataccaaacaataaagcaaatcacaccacatactttttcacctaacccttttatattttggtctttggaggtactcatttcatgctatgtgtggaaagaagagaatgcaaagggagtctactatttaatactgagtagggacatatttcaatatccaccaccataccaaattgatgctagaatgttttgatttatcatgtgccatttacctctaggcacctgcatgcatggtgttaaacaaaaattaatactagtatgtcctatccattccattattgatccggccgtacttttgccagaaaagaaagattggaaggcgaattaagacggtctggaccattattaattgtccgtttctaagtaaatccaagcgcatgcatgctggctggtggcttagttatatatttcactc

SEQ ID NO: 54229 - DNA, 1501 bp, Oryza sativa
ggccgaggaagagagagaggggcgcgggccgcgggagagaaagggggattgggccgggagcggcccaaaagggagagaggaggtttttaattcgtttttcattttatttaattgattcaatgaactttgtgccattaaaattacttcttgagctccgaaaattcacggaaaaatccggagagtgttttagggcataaagaatattacaaaatattctcggccaatgatttttaaggaaaaattttaattctcccaataattcacttgattaaattgattaacttttaaataatttctagaaaatgcattatttaatgatttttaatcccgaacgaaaatcggggcgttacacaaaaccattcaaaaggatcccttcttgtgttttgatcccaactagcatggtggcccgcgcagattgcccagctagcatcattatattttctctcatataatagcatatatgttttctcattatattattcaaatatattaaaatgacaatataattttaaattttgcaataactttacaaaactactaatgtgtaatattcatattatattttctaattgtatttctatgtggactctaaactcatcttttaatattctttaatttttaatttcgaatttcagttacttctaaattgtattcctatattgaccctaaactcttcttcccatgtttttcttaatttcgagttttagttatttgtaaattgtattcttatacagactctaaactctacttttaattttattatgtttattccaaattttagttagttttaaattcctatatggactctatactctacttctaatattccttattttttaaatccgaatttctattttttttcttaattgtatttctatatggactatatactctacttctaatattccttatttttaattctaaatttatattatttcctaattgtatttctatatggactctatactctacttctaatattccttatttttaattccgaatttcagttatttcctaattttatttctatatggactctatactctacttctaatattccttatttttaattccgaatttcagtaattttcctaattatatttatatatggactctatactccacttctaatattacttatttttaattccgaatttcagttatttcctaattgtatttctttatggactctatactccacttctaatattccttattttttaattccgaatttcagttatttcttaattgtatttctgtaaggactctagtcttctcttctaatattccttattctttaattccgaattttaactacttctaaattgtatttctatatggactatagtcttatcttctaatatttcttattttttaattccgaattttaactatttctaaattgtatttctatatggattctgccttttctttttctccgattaatgtgagaatttctacaccatgagagcgaacgtggaggctcatttttctatttctt

SEQ ID NO: 54230 - DNA, 1501 bp, Oryza sativa
aaggaggaggcggagggagagcttaccgagggctgcggcggcgagacaaccatagggaggcgaccggcggcggaaaggatggcggtggctggcgcgggaggcggcgggaacggcgttccgacgacgcccgaccacaacgaagccacggccgagggccgacaagaccttgactttggaaaagcggctcccgtggggttctggacggagtggagcggcagctagggtgcggtggagcgcggcaacgctgcgcggcgacggctagagcggcgagaggtggcggctggaggcggtatagttgaggcggctcgggtggacagtggaggtggaatttcggtgcgagattggggaaaagaggtgtaggacggggtggagctcggcgcggcgatgccgacggtggcgacggcacggcacggcggtggctgaagcggcgagaagcggcggctggagccggtggcggcggcggagagaggtggtgcgcgtggctgcggcgcttcgaaggtggagaggggaaatggagcggtggacggggcgcgcacggcggctgcggtgtcggggagggtgacggcccagtccggggtgaacggcagcggtggcgcagcgtggctggagttcggcggggagcggcggcgcgtgggctccggggaggatgtggtttcgggcacggggaagctcggggaggagggggaaacggaataggagagcacgagggtgctttatattgggctcggggatggagatcgtggccgggagaggcgggaacggccggcaaagtggggaggcatcgtgggaagatggggcatgaaacggcgccgaaaattggggaaaagtgggggaagaggtggaggaggtggtggggaaccgattttactcggtttgggcgcgagggcgcgagcgggagggcgccggatttggcaggacgtgggcggcaaccgccggccatggcggcttcggcctgggaagccgaaggtaggaggagggcctgacgggtggggtcgccgggcccacctgtcggggagggagagagggaggagaacccagggggttatttagactttgcgcgaggggaaggggaaacgggccgacggcccaagagaggagaggggaggccggccgaggaagagagagaggggcgcgggccgcgggagagaaagggggattgggccgggagcggcccaaaagggagagaggaggtttttaattcgtttttcattttatttaattgattcaatgaactttgtgccattaaaattacttcttgagctccgaaaattcacggaaaaatccggagagtgttttagggcataaagaatattacaaaatattctcggccaatgatttttaaggaaaaattttaattctcccaataattcacttgattaaattgattaacttttaaataatttctagaaaatgcattatttaatgatttttaatcccgaacgaaaatcggggcgttacacaaaaccattcaaaaggatcccttcttgtgttttgatcccaa

SEQ ID NO: 54231 - DNA, 799 bp, Oryza sativa
cctttctctacattgttcatttagtatttttttcttttcatttggaacatatgcaatgccataattgtctttcggggggaaagcttgatggccaacctttgttgatcagacagggatagaaatagagaaatgcacactaatggaatagtggcaaaagatagaagcgtgatttttttatggaaaagaaagaatagagttgtgaagagtggcacaagattaaaaaaaaaagtctcttagaacaaaatgcagcaagctcactgaggctaacacctaaagcacctagcagccaaggcagtccgcactgctgcacagggcaagctcattgcctatatacctcattttatgtttttttttatcttcagtgattattggattcttcttagctgctacatacgcactgctatgcactaatcacccggaggcattgaattcttatggtgacattgctaccttgcttgtgtcatattttacatttttctgcagacaactgaattttgttatgttaccttgtaacaaggtagagcatttcgacacagaaggctcagaaacttgaatagtttcttgtttgtttgtggaacccctgtgagttgaactccttagtatgtttcatgaaaattatggtacctaagaatcatgaggaaatgagagagaattgaatatgaagtcaatccttgtcaataatggcattttcctgttttataatgttgtggactcacagtgcttgtacaacagttgatcgttgttctttgtatacagacaaaactcctagttccatccagtccttatgtgattgttatgt

SEQ ID NO: 54232 - DNA, 247 bp, Oryza sativa
gcgattttcatggggtgtccacttttggtcatgttgtggtcgtacgagctcttctcgttcggacgtccatacatgagtgtggccgtggcccacaaggacgattacactgacgcagttgatgatcgtcctaccttcggtactcgctggtgctacggaccggtacgtatgcttgcattaaaggaatatttctatcatttcaatgatactgcattactaaatctacaatctctgatcgtgcagccatagt

SEQ ID NO: 54233 - DNA, 266 bp, Oryza sativa
ggatccccctgcatacatattggatttagccgatcgcaataagatttaattgtttaatataatcttgtggattttatgacatcggacctgcagccgatgtatgctttaactttcggatcgatgcttatttatcatatcattgatagccgattggtttatattggattgtattgttattttattacatcatcatcagccgtttgcctttatatcattatctacattggacatatagccgattgcttaaactctatcgctatcggctg

SEQ ID NO: 54234 - DNA, 459 bp, Oryza sativa
ccttcgaggacaaccggctgtggctgcgccacctgcagaccctcgtcgtgcaggtgatgggtgcttcgtatgttctctacaagtacatgcccggcaaggagaccctggtcatggcggccgccgtgctcatcttcgtggtgggcattctgaagtatggcgagaggatatgggccctccgggaagccaccttcgacaatatagccaggtgtttggaccagcaggaggattatgccagcgctcgcgaacgcgaaagcgacgatcttctccagcatgttctacaaggaaggagctctatggacgaggagaacgttctgattggagcacatggcctgctcgacatttgccgagggctgttcatcgggtcacgcggtgggaggcgcggctacctcaggcatgtcctgctgtccttccaaatgtatggccgtcttgataagctgatggagttggagctgtccctca

SEQ ID NO: 54235 - DNA, 1501 bp, Oryza sativa
ctgggatgccatcaagacgatgcgcgtcggcgtcaaccgtgtccgcaagtcaaaagcgcaggagctgcgcaagcagttcgatgcgatcgagttcaaggaaggggagtccgtggaggaattctccatccggctgagctggctcgtcaacaaccttgccgtactcgggatccagcttgaggaatcaaaggtctgtgaaaattttcatcttgttgttcctgaacatcttgagcagattgccttgtccattgagactctgctcgatctcgataccctgtcgcttgagcagctgacggggtgtctgaggaatgccaaggagcgccgtcccaagaagaagtccggcgatgagagcgacaaactgtatctcacggaagaacagtgggccactcgtgccgaggaacggcagtccggcgagggatcgtcgggcaagaaggcgggcaacaaccgccgccgccgcggtgggcagaaaaaaaccgagggcgctgccaatggcgagcggggcgcgcgcgatcaagggcgcgacaagtgcaaaaactgtggtcgtctcggtcattgggagaaagactgtcgccagcccaagaaacaagccgaggcacacgccgtccagggtgaggaggaagatgacgagccggttttgctaatggctcacgctgttgagctggcgcaacctccaccatcgccaccaccaactgaaccgttcgacctcgttgagcccaaggtgttcacactgttatgaaaatagatgcacaacggagacacgaattttacgtggaaaacccttgcgggaaaaaaccacgggcgccgaccggcaatgatcactatagaggagttgattacaaacgtagcggaatcacaatgggaacgtcaccccttcccatacagcttacaagagtatatataggggataaaagaaagacacctaataggaactcctactaggaaactaaaccgaatatattgtggggcccaaaattcggatcacatatttaacaatctccaccttgagacgaatttcctcttgtagcatgaaaaacatcaaacaccaaaaatacctcatgtaggtaaaatcaccgtgcgccaaatagtctctaggactatactgtaacaccaaccaagcttgagcaaatctcaaacttagtagcaggattcatatcagctgggttatcatgagtacttatcttgcataccttaacatcaccttcagcaatcacacctcgaataaagtgatatctcatatcaatgtgctttgttctctcatggaacatctgattctttgtaaggcatattgcactttgactatcacaaaatatatttatgcaagacgtaactccacaaagttcagtgtacaaacctttaagccaaatagattctttacaaactttagaaatagccatatagtctgcttcagtggtagataaggcaacagttgcttgcagacttgccttccaactaacagcacatcctccaatagtgaaaacataacttgtgagcgatcttctcctat

SEQ ID NO: 54236 - DNA, 471 bp, Oryza sativa
agggtggtggccggcgacgctcccctccctcgcttcctgtaacgccccgattttcgtttgggattaaaaatcaattaataatgcattttctagaaattaaataaaagttaaagcaatttaatcaagtgaattattgggagaattaaaattttcccttaaaaatcattggccgggaatattttgcaatattctttgtgccctaaaatactctctaaaatttcccgtgaattttcggagatcaagaaataattacaataatacaaagttcattttatcaattaaaataaaaagaaaacaatttaaattccccttctttcccttgggccggtttcggcccaagtctcctttgcctcctcgcggcctgggcgcgcctcctccctctctcaggctggccgccccctccttccttctctcctcgggccgccggcccagcgtgcctcccctccccaagtctgctttgcgtccttgcgc

SEQ ID NO: 54237 - DNA, 1501 bp, Oryza sativa
atgctttgaaggagataagggagccgttgtaaacgcgcatcttgcggccatcagggatgaagtgctccaccatgcacaccatcgacacccattgatttctgtttactgaatcgcccacaaaaactagtctcttgttcctaagcttttcaagaaactttgtggcattgaatctgttttgacagggtaaagattgcgacaccatatatcagaaaaaaaaaacaattgatccatagtaagcattagtgaatagtgattggtttgtgtttcataacggatctttcactgttaatatttcagtcctgagaactaacaatttttttaagaataactcaaaactaatcaatagtttgtctgtacgttttctagttggccattggcttacagaagcaaccatgcatatattataaatttagcaatctggacacattataaacgacgtttttttttccactaggtaccttgtactgttttaattggatattaattaggggaggaacatattaactgactctttggatcaaaggaattgagaaacacaggaaaacacaagaataataaaagcacagaaattggagtgacgtgtcaatgtaatcataaggaatatgaacaatataggaattactcaattgtgttgtttggatgcttcacaaaacagtacaggaatttgaagagaggatgacacaaaggaaattatccaagagcttggagctcatgttatatttcctcaaaacttccaatggatttgaccattacttcatataggtatttgaaaggtccattcttatgagtgcgacaccatgtcagaagaaaaaaaaaagaacttctgaagttctttagctagtaagcattggcgattggttctctcataactgatctttcactaactgtatcttcggttatctaaaagaacaaccgatcttttgctgtccaataatttattcctcaaaactaaccgttgtttaaagaactcaaaaccaaccgatttttctctatatgttttccagttggcacctgggactctgggtcaggtttcgacatttcagattgaaattttccaaattttggacccctccaatacgatattattttggccgaaattatttttttaaaaaaaatcatgaattttggtaatatttgttcaaatttgactaaattttgtcccaaatttcagaaatttcgccatattggcaccgtccgatacaaacaccgaaaacgaaaagttgaaccctgctctgagttacaagatcaatctggaaaaaaaaagttgatttttttttttgcaggactaggagagaacattttcccctgctttcacaaaactaaaaacgtttttgttaccatgagtagctcaagttggaagtttggtaagaaacactgagacagctcgtacgaatggagtgtagtactaagtagtagtgcagtttcagatccttgcagcagtagtgagtgtagtgtcaaaattgatgtggattagaatggagatgagtcgtgttgatacctt

SEQ ID NO: 54238 - DNA, 610 bp, Oryza sativa
catgcatgtcgggtactccagagtttactatttaaaatctataacccacactgtggatagcataaccaagaaacacacaatcaacagtttttggtccaagtttccgctttttgactataggtacatttaccttggccatacagcaccatgttcgtaggtatgagagatttaatttcttcctttcccattcctcgaatggtgttacttccttatgcttcattggaattttattcaagacatgacatgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattagaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagt

SEQ ID NO: 54239 - DNA, 1501 bp, Oryza sativa
ttgaaacaatgatcatggcataagcagtgtagggtgatcttaacataaccagtagcatactatgcgcatcatgaatgtcagaaacaggaacataccagtaacgcgataacatgctagaggcatcatgtagaacaggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagctcctgtcggcggcggcgcaccagctcctgtcggcggcggcgcaccacctccgccggtagcggcggcagcaactccagacatggcgatgagcagtcgtgcaggaggcactccccaaaaacctgatcacccgcctacccggtgcagatctcaagcaaaggtgtggtttcggaggcactgcttcttccaatctctcgtgcgcgcaagagatcagaagcggggaagcgagagcaactcaggcgcggagagggagaaactaacaccgggaaagttgcggagggaatcgtgggaacgtgggttagtggctgcaaaaggatagcgacgcgacgcgacgtgatgcacgcccgccgccgccagcctcgcccacgcccacggcccggcccggcccggcgcgcgcgcgcgtgtggcattccgacccccacctcaactggtcaacagggagcctctaataactccctatttaggttgagatatttctcgcttaaatcctgaggtggtattattatcctcaacatttattatggacctttgagatttaatattataaattgggcctagcccaattattctaacactcttcagtctcagtagcagaatgcaagaagggatctggtttgtagcaggtgcattgataccgaaaacaactctcacctgccaatattcttctgctttacacgtgtgccggcatagtgctgccataccactgttctactgtgtaagatctgttctaattttcttctggtgttatactatagtgtcgtcaagtaatgtgccatttgttccagacaaaaagtataagttgggcaatttggttgttttttcatctagccaagagatgttattgacaaggccctagtgggctctttggtgttgtcttgtttgcggtgagcaaggatggcaaataaatccaagcttgtaatagtagagttgtttgactatggcaggtcggcagcatgccaaatcaatgacttactgattcaactattgaccacttagtatttgtttaaatgtagtgcttaaaacaccattgttgactttcagttgtgctgtactatttgtcttgagagatgatgttattgaaggctgttatgtgtcttgcaaccaccaccacctgcaagtgtagatatctgaattctctttttggaataatgcccttgaacattttgtaatgatatgttttaacaa

SEQ ID NO: 54240 - DNA, 1287 bp, Oryza sativa
aagtcaatggttgtgaactaaggtcttgctgggtgaggattggatcaaggtaatacattcaaaggttaaccaatggattttggaataccgacgggctacctggggtaaggctatcatgatacttgagatggacaaaaggttttgcagcaacgtgaatgttattacagagaagctgagccgttttaacaactttgtagaagcaatttgccaagtgcagtcacggtgggtcttggtggataagcagcaaggagtggattttagcattttagtggaggagctggtaattccagcctacagggatatggctgagatgttgaaggcaacaggatctgcaggagagtcatatatgcgacttgaggatgtgagatcacgaattcagcagttgttcaaagcaatgaccaggtgaagtgcttcttctgggtgcgttgtgctaatctgtgttataatgtttctcagggagaccagcctaaggtgtgtagcatccttgttttagccacttgtattattttcacagtatgtgctgtagtggttgatgctttactaattgggatcatgtgaactctggagtcctagagcaactaatgctaatatactactgcactgttttacccaggatttatcttcttctccctctgctccatattgtaagacattttagttttctaagtcagacttcttaaactttgaccaagtttatagaaaaacacactatcaagacatatttcctggtagattttaatgaaactaatttgatgttttagatgttgatgtgtttttctataatctaagacattttttattcaacactgaatctatcccatttataaaacagaggcataaaaaatgcacaatatgtgccagttcgttctggatccatatggtagcttagtttgtttgtttattttgatggaatttgcagacctctcgaccttttatttagcggaacccttgcttcaaccaaaatgttgatttcacagtatggaagatttatagaaaactcctttcatcactcttacaaagggataaccctgtagtcgttttgtctctatagtcatctcatttttttcttatccagtcaaagttttatgttcttcattctatatttcaccttgtaaacagtttaaacccattattgggactgccaaggattacagtgtgtcatacataagcataacacgattaatggtaaatgttcaaagggttctttcttgttatatggacttagtgcacactgcacagcaaaaagaacgggcagaatgcatcaacataaggaatgaaatattattt

SEQ ID NO: 54241 - DNA, 1501 bp, Oryza sativa
agtgtgttaactttacactttgcaatccatgcactttggtgatatgaccttcagttaagcattggtcggcactttctgctaatctgaaaagctaatgccagcacgcggctatgcattgtccaggatatacataacatattcagaaacacacacacacagagtagatcagcaaggaaggcattgtggtatttgtaattgatattctgatagagtgattcagttctgttgcaaataataatatttgcctatataataagcttcaaaaacaacatagacgaataatgtctaccacttactaatactactaccactaagctttcaaataaatcaaacaattcataaatgaaatataagagtatctctgtttctactctctggctgctctgtttctgaaatgtctagataggccgcttctcagtctccgcacaagttaaaattttacattactgcagacttccaactagcaacaacatatgtgcctgcctgacatagacaaaaaaaaaagattaattggatccatgccactgcaactttgcaaaatttttaaaaaatgctactactatttgtcatattggctatgtgccactggaaatttctaaaattgaaaccataccactgaaaatttctaaaattgaaaccatgccactcccatccctttttccgtctcctctctcacgccgtctccgttcccgtcctcatcccccttccgcgaggaggcggaggccgccctgcactcttgtccatcagtgccggtgataacgatggcgacgacggcgatgcaacggagcgccacccagtagcccgagtagtagcggcgagctcggagaagaagatggtgggcagaggagggagaggagggagcgggtcgacggcgccgagtgaggctaacgtaccttacccgcgactaccaccggagggctcgggagccaccgccaccgtcctcaacgccagctgcagtgagaggtctatggagctgtcgctaccgccgtcctcgacaccatccacacgggagggctcgggagtcatccacattggagggctcgggagccgccgccgccgtactcgacgccatctacgacgggagggctcgagagccgccgtcgccgcctctgtcctcgatccatgatgggaggtctcaggagctaccgccaccgccatcctcgacgccatctgcggcgggaggtctctggagctgtcaccgtcgccatcctcgatgccatccgtgcggtagggctcgggagccgccgccgctgtcctcgatccgcgacgggaggtctcgggagctgccgcctctgccgtcctcgatgccatccacggcaggagtgctcgggagccgccgccactgtcctctttgcagtcgcgccggatggaggaaaagatggggagatgaaactgacatatgggatgggaacggagacggcgtgagagaggagacggaaaaagggaggggagtggcatagttccaattttagaaatttccagtggcatatagccaatatga

SEQ ID NO: 54242 - DNA, 1501 bp, Oryza sativa
accgccaccgccatcctcgacgccatctgcggcgggaggtctctggagctgtcaccgtcgccatcctcgatgccatccgtgcggtagggctcgggagccgccgccgctgtcctcgatccgcgacgggaggtctcgggagctgccgcctctgccgtcctcgatgccatccacggcaggagtgctcgggagccgccgccactgtcctctttgcagtcgcgccggatggaggaaaagatggggagatgaaactgacatatgggatgggaacggagacggcgtgagagaggagacggaaaaagggaggggagtggcatagttccaattttagaaatttccagtggcatatagccaatatgacgaataatattggcatttttttaatttcacaaagttgcagtggcatggatccaattaaaaaaaaagtctttctactacacttacaagtggtagtagtgggcaattttaacatgatagataacacattgatttcacaatctctcttgatgaacacgttggcagcattttcataatacaaatttatgtttttgaaaaacaaaaacaaaaaaaaaagataaaaagcacaaacgggcgtgttttcaatgagaatcaatgtttgaataaaaccgaaaccgtatttgattaggctagataagcgaaaaaaagaaataaaaggcaaccgaaccgatcccctttggagcggcaaacaaaccctagctgagtcgagtcgttcgaatcgaggagggatcgatggagggcggaagcggcggcgattcccagcagttcgggaagatggttgtcgaatccaaatccaggaggaagagacggcggggagggacgactatccttgcaggcacaatggacacggaaggaatgatggatcaagaagaagagaaggaggacgacgaacaacctgctgatgttcttgaggataggaagcatcgagatggatccatctacaggggtaccgattactggagtatctattatcgtatcgccgataccaacgaaagtaagagacctcctccattcccaccgaatccaatctcctttcttagttctattatcattcgaatccccttgattcctccctatgtttttttgtatgtatataagtatattgattgattgtgtgtatttggctggctcagctcactgagccgatatactaatttggatgctgtaacaccctaaaaattcgaccgacaaaatcaaaactctaaaaatacggatcttcaaaaaaaaaaactttttaaataaattgcatcatgccaattttattggattttgatttcggaattcatcgatcacaaataggggaaaattaattagaaattaaccctgcaattagatttggttaaagaaataaataaattataatttaaaataaagattaggtgggatagaaataaataaaatattatcgcgaccatatttggatcaattaaatttaaatacgatggaataagaattaaccctaaataaaactcaaataaattacata

SEQ ID NO: 54243 - DNA, 342 bp, Oryza sativa
tcctttgatatatctacaaatgtaaattcaattgatatgacatgtaagtgtattataatattaataaaaatattgggtaagtaaatatgtatttattattttctttaaaatataaaattacaattctatataactaaaattgcatttataaattcagttgatatgacatgtaagtacactataattttgataaaaataatatgtaagtaaatatatatttttattttttttcgtagttcgttggatgtaaatcttaatgtaggaaaactctgagtgattttatcactgataaatggataggcaaaaaaagaaaaaaagggataaaaggctttgtgggaggca

SEQ ID NO: 54244 - DNA, 1501 bp, Oryza sativa
attgatgtaagtagcttctaagatcgcttgtcatgcacaggccagaggtttgacatcgatgacttctacattggctgtgtcgatgtcagagatgtggcacagtccgcggtagtgatctatgagaacacatcggcacagggacgccacttatgcatcgagtccatagagcgtctgattgatttccatgataaacttgctgagctttaccctgaattcccgatccacaggtgatgcatctatgggcatcaacatctcttaaatcagatgcagtgttcttctcttgctaatttctttctttttcttttctgcatcagaatccaggaggataaacaagggtgggtggtgagatcaaaggctgcctcgaagaagctaattgatcttggtgtgcatttcattccgttcgaaaaaaccatcagggactctgtggattgcttgagaagcaaaggttatatataagcctgtgaacatatatttcgtactcaggttcagaaactgctgtatttcaggtttcacggttgaataaactgtcggaatgcgtaggcatttcctccccatcaataatacactttttttaacttcagaaatggatatgttttaaattgcatcatttggtggttctggacttaaaactgatcaaaaagcgaaagaagaataagggagcaaacatcataaagtagaaagtggaaaaaggctaagaaatgaagtggatagaagagaaacaaaatcattcaaaataaaaaaggaacagagtaaagaacaggaaaaggaaagcagaagaaatctagctctgagatctcttccaggtccctccctttacttgttctcttttacctgcagcaataagataaccaactaggtcatcctacaactcaaaaatctttgtcattttatttttcgaaccgactccagcttacagttaaaaatctttgtcattttatttagatgacatgtaataaacgggtgagtccactcgagccgttaaaacagtttccctcatatgtgcagtcatcggagtttctagtgacgtagcccatgccccatagccccataggaacctgatcgtcgatatctgcggcatccagcataaagtcactcggtgctcttgtgtggagttcgaacatgtaatcgtacgttgaaccccacagccacaggtcgccacaccatcgaaagcaaaggctacagtagcaagcggcaaagctggttcttctcactcgattcgattcgccggcctgacatgaagccacgctcgcttcttgaaaacctgtctcccgcgcaacctgacctgggaaaaggctgccttccaggagaggagatgatccaagagcatctcctcctccgtctccttcctttcgcctccaaaaggagctaaagcatatcgatctcgcgatcgatcgattcgatcgacgacgcgtacattggctagccccctgcaccaaaaaaaaaaaaaggcggcgcctttagctctcttttcctctccccgcttgccccatggcttgttgtt

SEQ ID NO: 54245 - DNA, 1501 bp, Oryza sativa
accgccgcctccaccgcggcgcggcgcgtgcggcagcagccccggatctccacatcgtgcacccggatccggacctcctccgcggtgaggcggcgcaggacggactggaggcgagcctcgtcggacggggacggggagggttcttggtcatcatcgtcctcctcgtcttcgtcatcgaggtcgtcgtcgtcttggaagtcgtcgtcatcatcctcttgcaggtcggggtaatcttggacggaagcgggagaggatgcggtggccattggatgatcggaaggggatctcaactgaattgggagacgaagaagacgactctactcactcaaactcaaggatgccttcacaagcaacgaataacactatcaacttccttttttggggtaaaattaaatttatgcagagattgatgcaattcaggagtttcacaagtttctttttttaaagaacaacaaatgcatgatagaatatgtgaaaaattgctacgatttatatggtatagaggtaatgcctttgatacttttttttttgccaatatgcaaaagatttgagtatcattatattaaactgaagggaaatgtttaccacaaacatgagaagaaaagaaacacaattaagaaatatatatctagccgcatgagttggtgagcacaatagaacggcaacaacttttttttaaaagaaacacaacaggggaaggccccccgttgttagataaactttattaaagaaataaaaaaagattacaacatcctaatccagttaagaattactacatctttatcactttcattaagaaactagggaaggagacttattctaaaaaaatatagccattcctttgcttctaaatattccaagctcccaatagaaaaatttccatgaagcaacaattctgaaaagtgcacttagtctgcaatagcatatgatcagaggacaaagaagtgtcccaaattatgcccaaagagttccagtagctcaccgaaaaagagcaaagaaagaacatatgcaagagatcctctactgattgagaagaataaagaatacacagtaggtcgcagtttggaggagtatagtgcttatgatccagcatatacttcgtattcaatctattcattaaaagcagccatccaaaaacaacaacttactaagctcgtatttcggttgatcttcgtagcgttgccttaaatgctaggatacatcgtctaccactgaaataataattagttgtaaatgcaaatactcatgtcaaatctagaatttaaatccaggtggttggttccaacataaccagttgagttacgctcactttctcgttgccttgatatatgagagaacacaagcaataggtatcttattataaaaaccatgccttacattgtcgtatgcatgctctaaattataatccaaaattacgtttacattgtgtcattatctacttaaataacttcactaacatgcttattggtactaataagttactccctctagttttttttta

SEQ ID NO: 54246 - DNA, 1501 bp, Oryza sativa
ttttggcaacacaaccaacaaccatgttaaaagagaaatgctctcctatagtttttgttcgtcacagtatagaatgagcggtctcctgcagttttcttcaaacgtggagagattgttcttaccttaatttaacacctgttcagctgttatagcttgattcatgattggtttgtatagcagcggtaacgggctcgtttgtttagccttaattgtacagttggcagtcacaaagaatgttgcttggcactgcactgttggaccccttatcttttttttttctttatgttcttgaatgcttttcctggtactaatcatttctgtaactacatgacaccccgtgttgcggcggaacttgtagaaaacaatcaggatgaggtgctttttaaaacaaattaacaagaataattgcacacaacatgttaaggttgtggcttcacgcatgttaaggtattggtttggttgcacaaaacaataagtccctaggggagggagggacttatgtttttgagagaggggctctcccaaacaccccctagagagagaggatttgtacctggaaatgacgaatcaatgcgtccatgtcctctcctgaagagtatttacactggagcagaccaatgtggcataatttgtttacgcacttctcttcctaatttacgctttccccaacacaaagcgtattttcctagctttactcttttcccaggctggtgtgttttcgaacctcctagttcggatctcgtccctcatcaagaaaagaggtaacccgtacatgattaattaattattagcttgataaactagaaaaatagattaatataattttttaagaaactttttataaaatttctaataaaaaatataccatttaacagtttcaaaattgtgcgcgtgaaaaataaaaaaataaaagttataaagggagagtatataacccagccacctacccaaacacacatgcttctatgcatgtttggtgaggcagaatcatcctacgagagagaatttttcccatccaaagttgcaaacagctggtaggtacttaagctggtaagtcacagttaagtgaacgtttgtttccaacttaggccctgtttagttgcggaaaacttttgggtttggttatcaaatcggatatatagacacagtctaataacaaaacaaattatagattccgtcaggaaactgcaaggcgaatttattatgcctaactaatccgtcattagcaaatgtttaatgtagcaccacattgtcaaatcatggcgtaattaggcttaaaagattcgtctcgcaatttacaagcaatatatgtaattggttttttcctacatttaatagtccatgcatgtgtccaaatattcgatgtgacagcgtgaaaatttttattttgtgaactaaacagggccttagcatgctaatggacagcggtgaggtgcatggggctgcctatctaccacttgtgacttgtgtgcgaattagtaggagacttgaccacaataat

SEQ ID NO: 54247 - DNA, 356 bp, Oryza sativa
tggaattattgtttatttttttacttactttattatccaaagtactttaagcacaacttttcattttttatatttgcacaaattttttgaataagacgagtggtcaaacagtgcaagcaaaaactcaaaatcccttatattatgggacggatggagtaataagcatatgtggatgtgtatatgttttgaattcctgtgttttaccttttttatagtgtgggtttgtgaagggaagtgtagaggtggccatccaaggtagcctcctgcttgtttgttagccgatggtgggacattggtcggtggctgtacgtcaaaagggtttggagggtggggctagctgctgctatatccacaga

SEQ ID NO: 54248 - DNA, 522 bp, Oryza sativa
tcctccaaatcaaaggggccctcaacttcttggtaactttcctttgagtctatctatctcatccaattcttaggtttttcctacgattcaatcaaacggttattcatgtgtttttcatgcgttttgcaatcaactattttacacttacattcctatcaaaattctacgtttttcatgttttctcaatcctacgattcaaaggtacccttaaactgaaacaatcaggacctaaatctactctctatctctcagctctcatagcaagaggtaagtgtatttgaatttttcacaaaaaaaaaggggcaggagtggtagtggcaaccgccaccagtaccaagtatataaatattattgttgaatttatacggagcatttttttaaagaaatttctccactatttttccattagaatatagcgattatttctaacaaataataccttgactttattaatttgaccggataaagtctaaggtaatagttagaggcaaaaatttgcttttctgtccacatgattaacca

SEQ ID NO: 54249 - DNA, 1501 bp, Oryza sativa
ttgaaaaacgtgtgcgtagaaaacgcgggaagtgggttgggaaagatgggataagaccacagcctatatgttctagtagtctgtactatgtagtcgttttgttacatagagctactactaccaactccaccccaaaataagtgcagccttgaatattcgtgtccaacgtttgatattcgttttattttaaaaatttataattttcttttttaaaaaatagtcacacataaaataatgttcatatcttatcatatgataataacaaaaatactaatcacaattttttaagacgagcagttaaatattgaatataaatagtgtaaaaccgtgctttattttaggacggggagtaatatacagtcacgcttaactgttttgaccgatccagctcggtcaatccaatccggctggtaattaaacaacacgagcgcagtaattgaactagcagcaaactgtggctgacgctgacctgctcgctctgccaaatttgacaatgttgcctttctttcgtcaactatttgcattgcatgcatatatatttgttgatcagttccatggttttgatttcgagcttgctcctgctacgtactcgatctgctgcagctagctactactaccagattttctgcaactccttcactccacaagaaaaaactacaaatcgatcaacatggaaccacaagaacagcatcaagaaccagtgaacgatgggctgcagaagcaggagcagcacaagaagcacaaggagaagaagaaggagaggctcctcgacttcctccgggcagcgccgtccaaggcgccatggttctccttctccggcgccgccttcctcacccgcctcgcctccctccgcaccacaaacaatcctgctgcttcccgccgcttgccggcgttcgtccgctccgtcgactggcgcgccctccgcgccaagtgcctcgcgtgggccaagcacccaatgaacgcggctctgctcatctggctcgccttcgtcgccggcggcgtcgccttcgtcttcctcctcatgaccggcgcgctcaactccgccgtgcccgccgcctcgcgccgccgccgatggaccgaggtggccaaccagatgctcaacgcgctcttcaccatcatgtgcgtctaccagcatcccaagctctgccaccacctcgcgctactcctccgatggcgcgccgccgacgtcgccgagctccgtgccctctactgcaagaacggcgccgccggcctgcgccgcgagcgcctccacgtggccgccgtcgtgctgctgttccacgccacgtgcttcgcgcagtacggctactgcgcgctcttctggttcttcggaagagacaaccgcccggacttggccgtcaacctctgcatggcgctcggcctcggcttccccatcgtcgccgccttgtacatggtgtacggcccgctcggccggaagatcgtgctgatcccggcgtccaccgacgacgaggagaacttgaactcgcaggtcgacgaggcgaac

SEQ ID NO: 54250 - DNA, 1501 bp, Oryza sativa
ggaaggcttcgagcgcaagcgagatgctccttccggcctcggcgcaccgtgccgccagcttcctcacgacctcgagctcgagcaccctgtcgtcgcggtcgggcacgagctcggcctcgccgaggtacaccacccgcgcggccatcagcttctcccacaccctccgccgcgcgtccttccccacggcctgcggctccccgatgaccgtcgcgtcgtacaccctcgacagcgcctccgcctcgggctctcccgcggaggttggagccggagccgctgcagggcccggcgcgggcgacgcggcctgcttctcatcgtccgcggcggaggcggatagcgggagggactggagcacggtggaggccgcggcgatggaggggactaggaggaggaaatcgcggcgggatgcggcggcgacgcagaggccaccgcgggaggaggcggcggcggcggcgggagagagaagcggttttggtgggaggaggggtatgaacctgcaggctcccgggtttcgggtgggcgcggggggcagcattctcctcagccggaggcgcggcgccgacgcgccggcggcgagaggaaatggggcgagtccagagagggagcacggagcagcttgtggtcgttggggtagagtaaaacagacgcgaagacgcccgtttcccctcgcggagcctctctgtctcggtgcacaattttgcaattctgataaacctatcccagaaattacccaggaaaattttttcacaggaaaagaatagaaggaacaggttgagtggaacagaaatggctgcacttgcttgacaccaccatgcagctgcagatgcagcagaagttgtacagagaattgaacttaaaatctagattttttagggaatttctcgtggtggagaacgggtctaattttcgatttttcatggcagagatggagtggtatctgtcgctcccattttccccttgtggtacggttttgaactactacagtgcaaactagtgtacctgtcattgtagagagcaatatgtagtttctgtacacacaataatgacacaaggacatatccgctcatcgatatcctctcctggaacgttcgtggtttgaacagaccggctagaagagcgacagtaagagagacgctctaagaggctaaaccccacatcacatgtcttcaagaaacaaaaatgagcaacatagacgctaggctggtaaactcccttggcgggggatgcttatggtcttttcaattcaagccggcgacaggaccactaggaacaaggggcggtatcctaatcctttggaatgaggattttgttgatatcaaagacttcgtgcagagaacctactcactttcggccacagtctccctaaaagaatgtcagactaccttcctcatcacggttgtttacgggccaaccagggagagtgcaaagcaaaccttcttgagagaactatgaggcatcaagccatctgacaattcaaaatggctggtgctcggagactttcaca

SEQ ID NO: 54251 - DNA, 1501 bp, Oryza sativa
atctgattggagtcatattgtattgaccttagtactggggagttggaactggtagctagcctataatatcaagtgtcaatatttgttccaacaatcctccaaatcaatcttctgataataacacattggcaccaaatctgattgcagcccattttctagacggcgggtgtgcatgcatggcttgcaaatgagcttggaagctaagacttaacactttacatgcatccatcaatcgtcgtaaaacgaatttccatttcttcatatgaactgctcgtaaaacgaatttccatttcttcatatgaactgctccaacatattggcatcgattccagatataaatcgcattagcgtcacctaaacaatgaagttcttgctgatgcaatattgaattgagggggaaatgataatgaaatgtctcttgtttctgcagttgacatcaacaccttgttctgaaagtctgaacaatgacactagaaaagcaccaagctccaactttagaaaaacgtttgcatttttgccgtcgtggacggaccaaggggggtagtaggttgttaacttggcgcgccggcgtgttgccgtcgtccacgacgaccagtcgaccaccctgcaaagcgtcagcgtatctatcttggtgagtcatcttcttctctgagttaggagggggcaggtgagaacaacaaaaatgttcaagcaaagcaaccaaactccgatccactctcaaagcctccaaggctccaaccaatctgagaagaatttcggacatgccgtttgacttcaatcattagtgagatcatcacttgatgatagtggcgttgtctctggccatgccagggggatttcttttttgttttgacagagcagctttggactttgcaggttggagagaaaaatgccatggctgaattctgcgccttattataatcggggttggatgaggcgtccgcgtcctcttgtcatccgggtacgactgaatatacaatgtgattagtattttggatcaatgacgaggtggatgcagtgacaaagcagttgttgatgagaagtactactacattatctggaaactctgcaacatgtagttagtcaaaaaaaaaaaaactctgcaacatgttatgcagcattttcgatcgctagttttgtaacaaaatttaatcaatggctgcagcaaaatattcacatcttccgtagtactcccccgttacacaatataagtcattctagcatttctcacatttatattgatgttaatgaatcaagatagatatatatgtttagattcattaacatcaatatgaatgtgaaaaatgttagaatgacttatattgtgaaacggaagaagtacctatcctctgtccgcagggtatgaccctgaacttctttagttatgatcgttttgctatgtggattgatcgtttgctgtgttcgttggagctgggaacatattctctccacacagaaaatggagcgacgcattttcttataattaattaagtatttgcta

SEQ ID NO: 54252 - DNA, 1501 bp, Oryza sativa
gcttgcctccgccgacttcgcggccaaggtctctatcctcgtcgtccagcagcaggccgccaccaggaacgacgccgattactgacttaattggctagtcatgctgatatactaccacattccctctgctcttctcttctctgctctgctgcaatattagtgttcttctccaagtaatcttgtgttttaggatttttggcgagcttctgtattttactgtacctaggattgcataatcttgctttgattctggacacagtctagatttctatcgctaggaatatgtacaagtatgcatatgatattgacatatatcatgttcgtgtagagtcaagtgtttctgaactgaacatctcattttggagttcagactgttatctcaacaatcaaaaaagaaagagcaattttatagtctttgagtaggtactatgaggtaccactttttctattgtaaatttggtacctcttggtatctaagtactacgaggtacttaaaaaattagtgtaaaatttagtatctcataatacctcctcaagaactgtaaaattgctcaaaaagaaatccttcttttgtaatggactagtgtggcagtgtttggtactctctacaatatggagtattattgtgctggactgctggcgcaaaaaaaaaatgtcggtaatgcactaaacatctctaacctgactaatcccccaagtcgtaatcctgatcaagtacatgacgtaggtgctacaaacacaaatgacgatggcatttggagccatcgacaacttgcgcctttaatcacgggggaaaggagaacatcaagtacagtgccgacctactagtacagagagtggctatttcaactgaagctcatgctcatcggccggagctgaaggacaatggtgaaggtgtatggatattttttttactgaaatttggaaataccaataactgttatagatactggagtagtatattctgatatgtcaatattactgcgtatgattgattgtctttcttttttttttttttgactacatgagaacaccaacacggtaattattgagtccatcaggcaaaccatcatagatggtcaatgttgtatattatggataagctatctgaatcaaagcctagagagtgtagtgtactagtgtagtctcctcctttccttcccacttgtagcaggctggtgggacccacaagtcacctcctttctctttgcttttcttcactccgaaatttccccgagtccgagtagagtagagttcccaagctcctctgtcacagactcaagtaggcaagtcaagcagcagccataggccatagctgcaggcctgcaactcccggggaagagtggagtgctgatacgatagaggtagagcaagaagaaagcatccatggggaacatcctccggtgcttcaagggagacgacgatggcggtgatcactatccctactacaagccaacctccaggccacactaccagcctcctcactaccatggtcaacctg

SEQ ID NO: 54253 - DNA, 1501 bp, Oryza sativa
gccttctgcgagctctttcaacgatcgctaggcctatcaccctatctttgaggtttcttcttagcgcgagttcagcttggctgagttgccttgactcttgagctatatcgaattggagaataatctcgagcgccatatggaggtgcagtctcccgtgcgatattagtttcttactccacgctcttagtcttattgccgtatttcctagcttgtggaagagtatgtgatgtgcttcatggtgtggttggggggctgaccaggcttctgtcaccacctcctggaaacctgggagctggatccagaagttttcgaagcggaaagttttcacgcgtggggcctctccttgttcagttagcatcagcgggcaatggtctgagagcgaggtggagagggcatgcagtaggtgcttctcaaaggttgtgtcccaactagcgttgcaaaagaaacgatttagtttgacaagggtcaggctgtcttgctcgttactccaggtgtaacgcctgttttgaagtgcaatctccttgagctcgcaagcgttgagagtttctttgaaaatgcgcatttgtctgcggttgaggtttgcgttatttttgtctgaagctttgtaaattatgtgaaagtctccgagcaccagccattttgaattgtcagatggcttgatgcctcatagttctctcaagaaggtttgctttgcactctccctggttggcccgtaaacaaccgtgatgaggaaggtagtctgacattcttttagggagactgtggccgaaagtgagtaggttctctgcacgaagtctttgatatcaacaaaatcctcattccaaaggattaggataccgccccttgttcctagtggtcctgtcgccggcttgaattgaaaagaccataagcatcccccgccaagggagtttaccagcctagcgtctatgttgctcatttttgtttcttgaagacatgtgatgtggggtttagcctcttagagcgtctctcttactgtcgctcttctagccggtctgttcaaaccacgaacgttccaggagaggatatcgatgagcggatatgtccttgtgtcattattgtgtgtacagaaactacatattgctctctacaatgacaggtacactagtttgcactgtagtagttcaaaaccgtaccacaaggggaaaatgggagcgacagataccactccatctctgccatgaaaaatcgaaaattagacccgttctccaccacgagaaattccctaaaaaatctagattttaagttcaattctctgtacaacttctgctgcatctgcagctgcatggtggtgtcaagcaagtgcagccatttctgttccactcaacctgttccttctattcttttcctgtgaaaaaattttcctgggtaatttctgggataggtttatcagaattgcaaaattgtgcaccgagacagagaggctccgcgaggggaaacgggcgtcttcgcgtctgttttactctaccccaacgaccacaag

SEQ ID NO: 54254 - DNA, 1501 bp, Oryza sativa
ttaccagccggattggattgaccgagctggatcggtcaaaacagttaagcgtgactgtatattactccccgtcctaaaataaagcacggttttacactatttatattcaatatttaactgctcgtcttaaaaaattgtgattagtatttttgttattatcatatgataagatatgaacattattttatgtgtgactattttttaaaaaagaaaattataaatttttaaaataaaacgaatatcaaacgttggacacgaatattcaaggctgcacttattttggggtggagttggtagtagtagctctatgtaacaaaacgactacatagtacagactactagaacatataggctgtggtcttatcccatctttcccaacccacttcccgcgttttctacgcacacgtttttcaaactgctaaacggtgcatattttacaaaaagttttttatatgaaaattacttaaaaaatcatattaatctatttttaagttttttttggctaatacttaattaatctcactataatcgtgtgttttgtttttcgtgtcgggaggcatggttgggcgaacacacccatagtacatactgtatcttctaaaatgactagtattactccagaagacttccaagaatatgtatgggcgtccattgtcttctatacacgctcactcatgttcaggaatcaatgttggcttgccatgactttctattgcttgttttgttggccctataactgaagcacaaccttgatcgggaataagtcatcttttgttgccttaaataagttcagcacaacaaaacagaacagctgaacagatcacctgtcggcgtgctctgttcaacattttcatccctattttgatccgctaagttataggccaaagctggatttcataaacttttacttccactgctctagttctgtaccgctactccctaagattaatgaaattcaggtggggaatctctcccccctttgaccagtctaaaaaaacttttacttcttaaaattggcttgatttatttttgatactgagcttctttttcaggttatggctgcaaagcagccaaaagtctctttcaagttatttttttagacaggtctctttcaagttatttcaagtccatatagtcaggcaggtgtacagtctcaagcatgctgcaattataaatactttcagtttacagatggccaataacgacgtttccctattcacagttggcgctctacaacattagaggaacaattggttcatcatatgatagttgatcatgttatcacacataataacttacgcaacaatggacaaaactgaaacaaaccttctaagatttccaaactacgattgctaacaattgtacaattcagttccttctgaaacttcagaagctatactgaaggttttagaaggattctaagttctaactgaaactacaatatctttgtagaaccaccccaagtgagtttcctgaaacacaagccacactgggcaaactg

SEQ ID NO: 54255 - DNA, 723 bp, Oryza sativa
ctcactggggtgtcgccgtgtcgccgtgcttaatcgccagcgttggttccagaacttaccgcgccgtcgggccggtaaatcccggcgggcggtggatgtgagccgtagcttgtcgtatggacggtcagatgaggcccgtggagatgggggcaagataaagtaaaaggcgcggtgaccacggcagacttgcggtggatggggcggtggggaaagcataaatgcggatagcggtgggttagacgagggttttaattactcactgacatgtagggtcacggggttttgagtgtcacgtcgtggcggaaaggcgccggtgggctagcgtgattgacgcggaacccgaggtggacggactatggaaatcgcacttgggctgccttcccgcaacatccgcttgggcttggcaaagtacatcgaggcataaaactacatgggctgccaaaaagggacggtccattaagggcccaagattccaaaagagttaggtctcggcccactcaggaagatattgttaatcgtggtagggtgagattcaaatcacgggttaaacaacggaaagaaaaggctgacgcgtgggtcccaagtttgccccgagtccactgtgaaacgaggttggttcatgggagagtggaggcggcacagatccacccatcgacgggcataaatttgggctaatcccgaatctattcgctcccagaacaaacgccatggcctccgccgccg

SEQ ID NO: 54256 - DNA, 1501 bp, Oryza sativa
ccacgtcgtggatgtggagcgccgacacgcccatcacccacagcggcgcgaagcacagaagcacgaacgtggcggtgtgcacgaacatgctgccgaatccgagccgctccatgttccacccgaaggcgcagaaggtgcacgacagggagagccaccacgccgtcgcgtcgccgccgcagtcgaacatgccgccggcccactccggctcgaccacggcgtgtcccgtgcatttgtgttggctcaccgagtcgaaggcgttggggcacgcgagctcgccgtagttgtcttttccgagcgggctgcacacggtgtacacgacggcgacgaccggcgcgacgacgccgagcacgaagaacccattctccacgagctccggccgcgtcttcttggtgtacccccagtacaggccgcagagcacgtactggcaggcgacggtgaggtggagcagcgcgaccacgacggccatgtgggcgcgctcgccgtggcgcgggccggcgccgtccttgaagtaggcggcgcggaggtcggcggcgtcggcggggcgccagcggcagagcaggaagaggtggtggcagaggacggggtgctggtagaggctcatgagcgtgaagagcgcgttgagaacctggttattgatctcgatccagtggttcctcgccgccggcgtggggaacgccccgtcgagcaggccgaggaggagcaggacgagcatggcgccggagacggcgacgcagagaagccagaggagcatggcgatgttcatggggttggtgatccagtccttggtcgccgaacgcacagagctccagttgatggcgattccggcggagaggtggtcgtcggcggcattgcggcgccacggtttgagctgcctgagccagtgcgcgcgctgtggcttgtcgaggaggaggggctcggcgagcggtggcgcaggctgggcgcggtagttgctgagcatcggggcgttgccattctctgcggtttgtgcatcgtcgtcacaatcacaagcaagaagcattgcaaaattgcaattcgcaaagcccccttctcgtccacctgcatttcaggagaaaaagaaaacagatgaaatttcaggaaaaatctacaatggacacaagaatctggacatgggaaaagaaaagaggggattttgtcgaaaagcagcaaggaagaaggggaggagagagtttggagagctaagtcttaccagaaaggagacaaggctgcaacttgcaactttctgtttgatccactcttattggatccacaactgaatataatttgtttttcagttgaaaagaggggttcttgtacaagcaagcaaagcaatggctctcccaaaattttggagcttgtagagtttttgcagtccggtgtcatcgtgggttgacttgagacggtcaagtcagttcaggtcagacttgggtggcgctgcttatatgttgcagtaattaggaaggcaacagagacatcttcttccaagttccaagtgaagtggaca

SEQ ID NO: 54257 - DNA, 1501 bp, Oryza sativa
gatccttaccgacatggccaacgaaggcggtgtcgacgagagccgtgatggggttggcggcgagggcgagcacagcaggcaaggcgatggtgaggatgtccataccaatctcatcaaccatgaaccatccgcgcccgcgcacctcctcctcttcgccatccggcgaagtctccttctcggctacaacttccgtgacaccgggcttcccgcggcaccgcgtgggcctccaccgaggaggaggagcagcactacggcagtgacgacgggagaagggaaaggatatacggttgagagctggagaaggggttaggacaagcgcggcggcggcgacagacgtcatcggcggcgaggtcgccgccatgccgcccgggtgtgtggtgcgagcagtgatattttctgtgttgggtctgggtcgggctgggccggcgctgggccttctctcacaaaaaaaaaaactccaggggatgatctggaccgtcggtttatctgtgtattacgccaatatgcgtgcctcctcttcgcgttctctctctctctcccccgtctgacctcggctccatctgccgccgccgccgcctcgcgcggtggatctctctctctctccggccaagctacctttgacggaggaaagttacagcgcgggccgaggagggagccgacgacctgtacacagggcagagtccacaccggaaggtcatagagccatagaggtgaaataaattcccatttcttgctcttcttcgtattcatttctatattcattactgatgaatcatggaatgtggcgtgtccttatgtcaactatagatttcatagcttcgaaaaataatactcctatatgaagaattagtctagatttggaatcacttgttgttaactcttctcgtagcaaccgctaatgtctagaatattttattcaatgagtttggttatctctcggtagaatgaaataagcaaagggatagcacgggtatcagtttttttttttaatgagcacaaagttaaactgagttttctgtaaaactatttcgcatttgttaaaaaaaaaaagatagatagaccttcctgctacgaactagtatttgttttcctactgatgcaactattaacatttcactcgtcatcgaacaagtcttgatcacctcccagcacagatagttttgcctcacaatgtctagtagtagattgggggaacaaatttctcacatgttgtaatatgtaggaccccttttgcttcccctcaacccctgtacccttcacaatctgtatgtaaatattacaattttgatcaatactaaaatgttcaggctggccgcatgccttccacagttttccttcaaaaaaaattgtggtaactctgaatgcccatcccaaaaatgccacgcccttcatggtttgttcatttgattgactgccctttttctttggcagctagcaagagctgagtggggtgcgagagtaaaaaaatatctgtgcattcgattgcatcacggacatacgg

SEQ ID NO: 54258 - DNA, 790 bp, Oryza sativa
tacttggctggtccatactgtctcacctaagagcatctttccaccagaaacctcaattctacatttgagcaatgaacgtcagtcaacctttagatcatgcttcaatgtatccaccacaatcattcatgatcttatttcaaccgtgttaataaaaaatactctaggtcaacaaaactcattgttgaaatagaacacaattatcaacaactttaacatgagagctaatttcacaatggcatttaatatcagtataaaggcaataaaggaatacataaagatttatgtttgaaccacttcatcaggaaaacaaacccaaaagaggaaaaggctaattagcttgccatgcttattatgaaagagttcttaccactctaaccatcataaaagccgggcaatataaattggctaaaatctagtggatctgaatgatataggtgcttatcacttgaatgcagtaagcatttgaaataaacaaaccatcacacttcatttgtgaaaacttaaggagcaaataagccaaaaaaggaaatatcaataacatcataaattagattgcattaccaattgataattaaacagacacctaggataatttacaaagtttaagaaacccataattttctcatctaagatgaaaagtaaaccttatggaacaatgccaccaaacacataatggcatcaccagtgttcagatatccaccatagcagcaacaatgacaccaaaatcacagctatagaagcatagtgactataatgaactaataatcacttggacactccttcaaacagg

SEQ ID NO: 54259 - DNA, 1469 bp, Oryza sativa
gtgaaacggatgaagtataacttttcgtgcttctgtggatcgtttggttcctccaaacggtcaccctttgccgataggaataagttcactttgtgactctcaaaagtgatcgaaatctaatccgtaaccctaaaccacaaaaccggatatctcgacccctcaactcttaaaaccggtacaatttgactccctcggtggttttgaagggcggtttcgctgatgtggcgtctacgtggcatcccaatcatcaaataaattaaaaataaagcggggcccacctgtcagtgagtcctctcctacattctctctttcttcattgccggcagcggcgggaggacagggtgagcagcggcggctggcggcatcggggcgcagcgcggtcggcggctaggacggcggcggctctgctgcggaggctcacgatagtgggaggacgaggggaacagcggcggcggtggctcgcggcagtgggaggacgaggggaacggcggcggcggcccaagatgctgctcgtcgtcctcgccctcgcggttaccggcgcggtctccgacggctcgcgagtcgctggaccacatctccatcaactgcatcggcgtcgggggacatgtccggctgccgctccgtccactcgcgccgttcagcaccgacgagggcggcgaggctcctcgtccccgctcagccgcggctcttcttggatagtcccgactggaggcagtcggcggctgggagggagtgggaatgggagcgggacgatgacgacgacataagaggaagctggctcgcgtcgggatcttggtggttcgtcggcgatgatgccgcgtgcgctgatggatattttgtaatcttgagctttttaatttctgttttgcatgcacgtagtggctggctcaagtgtaacgaactgctgatggaaatgaataaatagagaagaaaacagaaaagctgcggtgactggtgagacttaagcagcacaaaaaccactctgttcagaactctgttcttcggtttttcagtttactgttcacaatcttacaatcttcagagtttcagagattcagtgaggttgagcgtgtgagctgtgagcgaattgcaagtttcctgacatgcgctgactccctctccgccggcaaccacgtggaggaagtcgaccggcggggtggtttcggggaggagtggttcttggtcgccgtagaacttcgtctctgctacgttgcagagctcggagaaggcgtccgccgtgtggtccgcctccgcgtcgtggcctttgctcggggagcggccgtgggtgaaggcgacggcgacgacgtagacgacgtagagggaggtgaaggcgagggcgccccagattgtcacctcgccggcggcgaggacgacggccacagcgacgagggagacgaggaggaaagacgcgtcgcggtagaagttcaccctgtcaatggcgaccccgcgcgcgccgaggtggacgccga

SEQ ID NO: 54260 - DNA, 493 bp, Oryza sativa
attcctgcagcccttattgtgaccctatataatagcaagttccatgctggcttatattaagtagaataaaaaaaagactgtaaatttggtacctctgtataatgaaggggtgtgtactagaagggaaattacaaagtcttgttagaacgagtgaaagcttcagaggcttggcacactaagttcccaggcagttgagatagcatcacattttaagaatataaaaagtatcgtctcagttatgttgacatttttaacaatattggtgtgtaacacagtctgcagttaagaacatgaatttaacaaattcatatgatagtgttctcattatgcgtgtatgattacagaatatttcactgttgtttgacctgtgatgggtttatatatgttactacctgttacttttccttaaaggcacggatcaatatagtttacatatgattgtagggatcaatgtattcttgctaactggagtttgtgttccacttattgcagc

SEQ ID NO: 54261 - DNA, 1501 bp, Oryza sativa
tcagcttgggcgcggagaagacgaagaaacggcggtcagcgctacggcgacggcgacccgagctcggtggcggagtagacgaagagacgacggcggcggagtagacgaaggagacggtggccggagcatgggggcgaccagatccggtggtccctaaccacatagagaccggatctggtgcccaggagctcgggatggtggagatgaggcgaccggcgaccttggggcggagggtgaaggaggcagcgaccggagctccggggcttgtagatccggtggtagggcttgtagatccggcagtacttgagggcgccgacgcggagagaggaggcggcgtggcgaccggtggtggcggcggcgagcggcctgcggctgccaccggcggcggcggcgctgtagaggaggaagggcgaggcggcgtcgaggagggagggcgccatctggggctgcggtttcgaggagggtgagcgccatcaggcggcgacgagcagcctgcggctgcctcgctgctcaacactcatcgctcgatgccgccgccgtagaggaggaagggcgaggcggcgtcgaggagggagggcgccatctggggctgcggctgtgaggagggagggcgccatccggtggcgacgagcggcctgcggctgcctcgctgcccaacactcatcgctcggtctctcgttgctgtgggggaggcgcccggaagaagggagagagagaggggagggagaaagggagaaagaagaagaggataaggatggactcggcagtagggagaagaagaggataagggtgaggagagcgatttttttttttttgtgatctttgacgggcacacaaaatttgatccgtcactggtgactttagctcacctttgacgggttctatttttggaccgtcagaggtgactagttacctgtgacgggctaaatatttttggctcgtcagaggtgactttacctcacctttgacgggttctatttttggaccgtcacaggtgactagttacctgtgacgggtcgtcgccggatggctcaccgatgacggcaccccgtagaacccgtcaaaggtgaccctcattactgaccaacacttatgtccgtcacagatatgccgtcacaggtgtgaggatctggcgtagtgaaattacctactcctaagtaggagtagtaagtaaggtgcaccatttaaatgtaggtaataatagttgaagttaccattataagtatatattgctagaagtggatagtaaggtggggccatattacaatagaaaaatgagacaaatagggaatgaatggaagatagagattttaatatttgtttagttcttatgacctgacagtaatgctattacgagatgatactactacctgctttatttaccacctccacgatggtgaaccaggtataagaactcattactacctgcttttcctgtgctatactcccttagtcatgaataaattccctcaccactgaatacttgaaattcaacagaacc

SEQ ID NO: 54262 - DNA, 572 bp, Oryza sativa
taaacggattatcgcggccgcgcatgtttcagcagcgcaatttgttctgagaattaaagtgtctacaaattaacacgacctggagtatatatgcttcttaatttgtcggctagcagacatttctgaaacatctgattatggcatgcatgaccgtgtcagtagaaaagtgttgttattaagcctgtatagtaattaattgagttcaaattaaagcaccaggtacgaattaaaaaaatactacatctacgttctcaaatagtgcttgcagtcaaactttgataccttacataactttcattttgctaaatgatatcaattaaacggtgtatcaatttcataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgatattagaataacttcaaaataactgacataattttttatttttcctgatcagaaaaataca

SEQ ID NO: 54263 - DNA, 1501 bp, Oryza sativa
agtcacctactacgaaaagtgtttttgcagacaaccaaaattgttctatgcagttgatcagtgctccgcctatgatttaaggcctgtaaataaaatcaggcattatcgcaggaaaagaagacttacgcagacactaagagaacagtaaagaaggaatacttttgtcgtgtaaatcttaaatcatatcgatcgatcgaccaagcacgcgcaccggtaactgaatggcatcaaatcaagtgtctatctgcatcgagctcctgtggccacttagcgaaaatccggccgtttcgcagttcatcgtgcattcgcttcatgatcaaaaggcgcaggcggcgcgtacatatatatcgcgattgcacccggttaaatccatggatcgaacgaacctggggccgtgcaacaaattaagcgagcgaggaaacacgaggacgaggggctttacgcacgcgcgcgcgctcgggcatttgcatgattcgcagacgcgtacgcgccacttctccggctggtcctcgccacgagagcatatgcatgcgtgctggggctgcctgccgtcgtgtcgatcgatccatttcgtcgttgtacgggcaatgtaacgaacagtccagaatccagaacatttatagttcgttttatttaaaaagtttaatataaatatgtaaaaccataaataataagattaaattttatttaataattaaacaagtggcaatgaataaataatatttatttatatttttaataaggtaaatggtcaaaggttatatgaaaaataaataaaaaaatcaatgacgccatacactatgaaattaaaggagtatttatttatacttaactagcttatgagacgagcggtggaaggaacactactgaacactactggctcctgcttcgacagctggtgctgcatatcgatcttgtacctcgtacgtcgatcgactgatttcagtgctgttgttctgagatcgagaatatatatgtttttatttaaacaaccagaaccatacaaccactactatgtaaacgattttcatgtacgagatctatagaggttacaggtggaccataactggttgtgcacgtaaaaatcgaccttcattttagcatacattttcttaagagacccgcatgcaaaaatctattttcacaagcatacctcttaagacgccatatagaaaaataagcctattttcccgtaggagccttttaaacgaccgcatgggaaaatgtattttcacatatggatctcttaaaggtccgccaagaaggtcctcatattatttcaaactcatctctctctcatttttcaccttctctcctctctatcccttaacttccctcctgagcggcggtgacaggcgactggccagtggtgggctcgaggggaagtagccagcggcgggcgcacggcggacaaccctcctgagcggcggtgatgggcgactagccaatggtaggctcgagggggagtagccattggcaagctcgagggggagtagccagc

SEQ ID NO: 54264 - DNA, 1501 bp, Oryza sativa
taacttttttatgttaatataaagcttcactactaaaaaagcaattttttttccaaatcatcaaaacctatttttgcatgtggttgagctacccgtttgcccgaaagtgtcagcgaaaatcaccatttttccatgcgggtggcgcacccgcacgcaacaaatccgattttctcatgcggatgcttatgtcgttcgcacgaaaaatataaatccccaaaaataaaaaccctagctaggtgaggtctgccgtcaggctcctcctactagatctgcgccggggatggttgctgccgccggatccgggcgggaacagccgccaccactagatacgtgtggaagatagcccagccgctgccaacaccccttgcctcacgccggtctcgtcccgctgccgctgccaaatctgctcagatccatgtaggggacaggcgccgctgccagatccgcgtggattctggcgggggatgaccactattgccggatccaagtgggggaggccgtcgttgcaaatctgcgcggagaacggccttgcccctaccaccgtcgcccctcgtctcccatcgggctcctcccaccgcagccgcacgggggccggcctcccgccacttccacatgcgcacgcccgccgctggctactccccctcgagcttgccaatggctactccccctcgagcctaccattggctagtcgcccatcaccgccgctcaggagggttgtccgccgtgcgcccgccgctggctacttcccctcgagcccaccactggccagtcgcctgtcaccgccgctcaggagggaagttaagggatagagaggagagaaggtgaaaaatgagagagagatgagtttgaaataatatgaggaccttcttggcggacctttaagagatccatatgtgaaaatacattttcccatgcggtcgtttaaaaggctcctacgggaaaataggcttatttttctatatggcgtcttaagaggtatgcttgtgaaaatagatttttgcatgcgggtctcttaagaaaatgtatgctaaaatgaaggtcgatttttacgtgcacaaccagttatggtccacctgtaacctctatagatctcgtacatgaaaatcgtttacatagtagtggttgtatggttctggttgtttaaataaaaacatatatattctcgatctcagaacaacagcactgaaatcagtcgatcgacgtacgaggtacaagatcgatatgcagcaccagctgtcgaagcaggagccagtagtgttcagtagtgttccttccaccgctcgtctcataagctagttaagtataaataaatactcctttaatttcatagtgtatggcgtcattgatttttttatttatttttcatataacctttgaccatttaccttattaaaaatataaataaatattatttattcattgccacttgtttaattattaaataaaatttaatcttattatttatggttttacatatttatattaaactttttaaataaaa

SEQ ID NO: 54265 - DNA, 1313 bp, Oryza sativa
agtttggaccgctttttattaccaaagttttccttctgattatcaataattaatccttttagttttaattgctctgttgcactttggacttggaccagcataatcctcttctccagctgcatctagactctcctctggtaaaggacggccttcgtgtaagtgggaaagttcaccaatgtgctaaggtcattgatgagctcgactatgttgggtggttcaaactacaataatgataaatagttccgctaaagggtagaacatagtgaaacttcggatataaaagatgaccaaaacataattaacttctcttttcttatttatatatagaatttagatttgaattttttttctttcgaaatagtaaatgctaatatattatgcatgggcacattttctttagaatcttccaaacaaatttatattataattgacattagtggaatacgaggggatgcatcctatctacatataaacatctttgtatccatatagaaccgtactttcaatcactggagaatgaggaatttaattcaaaaaaatctacatattattttgagatttttgtcctgccataaacaaggactggattgaaaaatataaaattttgattcttgtgtgaaactcatacaaatataaaattactgaactaccgtgtctctcataagttttatcagcaatacaagtttacctttacaactttaattacaagaaaatagtaaaacatcacatgacagctagaacagacaagattatggtaatgtacctagttaattctaaaccgcttcctaaccacatagttaattgtatatatgccgcaggtggggggaaagagctgcacatcattagctgtgcttgcaaagttaggcgtaaatcagttacaagatcgagtagctgcatgcatacatgaaaaaaaaattaaccagataaagtagtcacacgaaggaattcccatttcttcccctctagcattgagaaagcttacatgtgataaacacaacgcaaattaattgaagaagcccttgcaatctcacgacagcgatgataacgacaaggcacaaattaatgccttttatttggtactttttcctgatggatctgaattggctggtgggcgtgaaagttacacggatcaacgacgaagaaaaggtggatcactagtgacatgctaacgttgccgatgaagcaaagggagcatcacacgcgtctaccgccagttggctctccatgtctataaatctcctagcctctccctgccatttctgcaacacacctaactaccacagcttgtgaactatcaagagtgagtagtagag

SEQ ID NO: 54266 - DNA, 1343 bp, Oryza sativa
tggcatatctcaaactttacaaaattaaaatggcatggttccaatttaccctgttttatataggttttaatagcactcgaaataagctttccatggagtccaagatcgttgaagtcatacttcaaagtaaaagttcttgccttttcacttgagcaacatcagactatccgacctcatattgaacattggagtgttaatttttttgaggaacttagttctatgtttcgaaccaaatttggtgtcgggatatccgatgtgatcgggatatccgatgcttagtcagactattggatgcctcagagagttggaagttttaccaaactttattctctatttggcttgtgatttaaagtcatattttctgatgttacgatcggagtattcggtccagtgttttccaaagaccttggatcgagttttttgactattggggacctgacactgagatcgaaatgtgcaacctagaagttagattatccgaggtgggcctggaatctccacccaacggacagatctaggggttgcttatttaaatccccacccaaaccctttacaaggttagcccttcatttccaatctttgtggatttgtgagtttggaactttccattcttgagctctcttgcttcctcttaaatgcactctaatctttgtgatttggcttttgggtgtgtagatttgagttgagtttcttgtatgggcacaaatattatttctcgagcactagagttcatttccaagcaagctttgggtgcatttttttttgttggtgattgcggtctcctagttgactaggagtcgcttgtgagaaccccaaggattgcggtgtgtcgcggtaaagtttgtgaaagttagatctcacctccacaaggaaagagatacccttagtggaataagtatgaggaataggtgtcacacctcaccctgatactaatggtgacaccagagagggtgcatcctaggaaattaggacgtaccggaaattaggacgtaccaactcctgtggaaccgtgtagccggtattcgtcccaagacacaattgcaggtacccgtggtcaactgagatatgcatcatggcaactaaatataaatatagatagattatacccttttatgaggttacatcttcgacaaaggcggccattttgcatcgcggctttcaaaaacaacttttattttgcaaactcgttgaaaccatgtgttgggttttcaaagttgtagaaaccagttttttcataacaacaaataaagggtgcttctgtgtttgtcggtacctatgcccgagggcattagtgccgacgtaccatgagtgtggagcgacaaggatcaggggtgatgtgacca

SEQ ID NO: 54267 - DNA, 1501 bp, Oryza sativa
aatggcataatatggtctcatttgcataaacatcatttaataaatatttcagaatttaataaaacggttaaataataattaaacaatattaatccaacgctatacaacaaaccctgttgcataggcccaacccttatgaacaaccaatcccggctgcacagttctatctccaaaccaggaattaaccattccaaaccaggagctaaacaagttattaacagcatcatttaatatagtgagagatgtgaaactaatcacgaaagacattgttagacccgcccataaccgcgggcacggctattcgaatagttttactctggccagagatgtaccactgtacccacaagacacaacctcaacatcatgtcaaccatgcgtcgcgatacttgacaagtacccgaatagagattgtgacaataccccctatataatacaattcaaagcagtacaccgttcccggatcataatcacccccttataaacaaggtatggactccccagtgacccccgtgggcttatctccgccacttcacagtctggtactctactatgaatcatactatacagaaagtaaagccgttgcccacgctggcttgtggttggcacggtaaatgtttcacaaccgaaaatcgtgaaccggtccttaattgtcatgagcacaaccatcaaaaccatatgctcacaacccaccattatcaggttttagttgacaaattaattaattatccaatcatgattaaccatcatgagctatcattaagccatcattaaataatagtgaagcataagttatcacaatagtgtgctaatgtttctaagcatggctaagcaattatgtctaatatctagctgaaccattatataaagctcaactagtctaattataataacccaagaaatcaaagaataaagtaatcaagaacaaaagggctataacaaacaataagtttattccacccaatgacattcgaaaataaatgcaatagttgaatagaaacaatagctttaaacgggatcaacatgctcaaagggttgtttgggatctgtgtaacttgccttgctggccttggaattcctcaaaatcttctcctgcaagatcggactctccgggaacgtcggaatctaaggagaaaagaacaaaatcaccaaaacagcacataaataagcatgaacagtatatgtggatatttttaacatgtagatctcaattttagaaaaatttagagacttgaaccaactaaatccgagctaagatgaattagttatgaattttcaaagattaaatcggattaaatcatttatagatattttaatggaattatgacgcaattatgaattatttttgaagaggaaaaagaggattattgcgtcagcatctagggttcacggtggaccgggtgcacggcggcggctcacggaaacgaacggtcgggatctatcgatccaaaatgaacggccgagatctatcggtccacggccggtctacggcggacggcaacga

SEQ ID NO: 54268 - DNA, 1501 bp, Oryza sativa
tccctaaaagattcaaatgaaaattttgtatattataacatacctgaaacaatccaaaggttctctacatgaattttccgttggaataatttttccataattctttgctccgaatagggccttaaggtaatggttagtgaagaaaagggcagaaaaacatcatactgaatatgtacaagagaaagcaaaatactaaatatttaaacaatcaaatgatttgatggtaaagtaggttttgatataaattacaagcagtcaacaaacataatattctatatatggaactccagatctttatttttacttaagaggtcaatttcgatagcttttgttggagctggttgcaaatatcaaatcttgggatctgttaattcacgaaccaaataccaataaaaaaaaactagaaatggaatgttttatgattaaattgttcttatgatgccatgtaggtacattcgcactacatagcatgcgctcatttaacaatctaaaaggacaccactgtgcagaggattaagcatgtatcaagtcctcttctgaaaacagaaaactgcaatgcgtgttgtaacagattctcaagtcatgctacaaatgtgatgagcttctagagatcctaaatcaaatgaccatatatgatgctagatgaatctagtgctggtttttagaagctacttaaaactggttcaatacctcagttacacgaaggaagagagctacttaaaacagtgtcaataattcattgtttatggtcaatttagtccataaaagtcattttggacagattacaggcagcttctgcctagaaaaactgttcccaaaccccccaaaactactaaattctccacagctctgagaatcagaatcagttaaagatgcagtaaagcagaagcaggtggcttgcagctgctggtggtatgcatggagcaaaggcacaattcacaaaccatagactctgttcaactaaaatggaatgatattcttgaattgcatttaaggatcaaagtatctagtagaaacaacacataatgacacagggcaacatttatagatgaacaagaccagcaaatggaaattgacgtacactattgcacatttgtagtcttcttcctctattcagggttaggggttgaaagatatagccgccggtgcactatcccacacctcaatggaccgcttatcatccctcgccaatgccatcctgctgcctccaaaggcccagctcacaatcttggtcttctccttcacactctcgtggccacttccgcctgcaatcacaaaggatggtccattccccacccaattcctcctcatcaacttcttcccaccagcttcttgagccaattccacctgtgtccacacctcaacctctccaccgcgcgccacaaatacccaattgagatagcactcaatcctgcaaccattcccctcctttctgcctgcagatgccgcagctgctgctctctgcccatctccaatgcacacccacggttcaatgctaatg

SEQ ID NO: 54269 - DNA, 1501 bp, Oryza sativa
gctcttgaggatcatagggagcccgtacttgggacgcagcgtgataacatcagtgggtgcatggacgtacttgggggacaaagtgaaggagaacctctgtaggatcatggcaatgacagccttggcctcgatcattgcaaagttctgcccaatgcatgacctcggtccgctggagaaggagagtagcgcgttggggtgcttcgctgccctcgtcaccccattctcgaacctctccggcctaaactcatccgcatcctccccccacacttccttgtcacggtgaattgttgcgatcgggatcatcaatagtgcaccctcaggcatcttgatgccgccgagctcaatatcagtgccaaccttcctccgtatgagtaagacagggctgtacagccttagggtctctaggaggaacatgttgaccatctttagcttgttgagcatgtcaccagtgggcatctcgtcaccacactccattgcaatctcctcccttagtttctcctaccaatctgggtgcgtgctcagtaggaacatggtctaggtgagcaagtgtgaggtggtgtcatgccctgcaaaaaagaaggtcttgcactcgtcgatgatctcatccatgcttagttgtgggtggctctccctgtgctccggcgcacacgcctccagcagcaacccaagtaggtcattcccatacccaactacatccttgttggcgtgcctggtcttgatgatgtccatgagcatgcccctcaccttcttgtcgagcgaccatgtcttgaagtttttcatggtcggaaggtagctgattcattttcaaaaaaaagcaccgatatattattttgtgttctttctaaatctatttgtatcgggataagttaataatgtgtgtacctaaaccctggaacttgaacagtgaggaaggtggagaaggcaagaaattggagctccctctgtgccaggaagacctgcttcccctctttgtagctgctaccaaacactgtgtgcgagatcacattggcagtgagctcctcgaaacgcctgcttagctcaatctcagcaagaccacccttcgcccctaactccgattcccactccgacatcatggaccgagagcagtcggacatggtcatcgtcatcatcttgagcttgtccatgttaaaggctgggtgaaccaccttgcggtggcgcttccactcatcgccgtcagtgagcacgagccccttgccaagtagacgcacagagtgagggttcgtcaggttcttggggtatatccccgttcgatctgacaatacgccatgtcacctaacaagaccaagtcaaactgccacgtaggcgctaaaccactctcaatactgccttaagaacaaatatgatctggttttgtaagttaagggacgtgctatatctggttctgcggttcaatgacgaatttctaacttggtgacaaattgagggatgtaaagtgcactttttatgcaaatgaaaccgccatcgttcttagcaggccgag

SEQ ID NO: 54270 - DNA, 1501 bp, Oryza sativa
tagagttaacttgtataataggctaactatgaggttggctctatttttcctctcatatctctttctttcaatatgagtttaatataaatatcttgaagaatgtgtagaactaactcttgtatgagagtaaacactcctcgcttttctttctctttctttcacataagcttataattagcttatagcccactattatccttgctttcacaggtcgatgaacctacaatgattccctttattgttgactcgctgagtgttattcgcataatttttatttttcagttatcgagtgtataagcgcatgaattttttagttctttaatattgcatccaatctactcataattgacatgattataagacgtatggacgctctactcctgttttttttttttggacttccatggttcatgcttttcatgcacgtccaaaatccaaacgtgcacacacagtgatcgcactcgttccaaaacatacacgcacagtgatcactgtccctgcctctcttgatttgtttgttttcgtgctctttgctacgagtatgagataatctttgttgtacataagcgggcagccatatgtgtttcttcttcttgagatgatttgcttcttccctctgttttgcttccgatgactgtcaacccttttagtgcctatcaaaaccaatagtcacattgtaaaatcgtaactcatgcgtgaccatatacaagcatctataaaagggtattattttattcaagaaaatgaaatatgtaagtttgataaaagagcaaaatgaaatataagtatgcttgcataatcagcattcacaccatacgcatgcccgggagcatatcacgtgcagttgtgcactaacaaatgtcataaaaagatcttaaaaaaactatatatgtgtacttctaatattaccccacctatatatgaaattccaacttcaaattcgtaacgcatagggaacagaaaagagagaaatctaacaaatatatttactcttgaaattatcagattttttattgctgaaataaaataaatttgaaattgggattttatatataggttaagtaagattagaagtatatgtacatatttttaagtttttttggcatttgttttttttaggggactgctaataactctattcaagccacgttaagattcttacaatcatcctcaagaaaagataaaatgaaaaccggagcgcaggttaacaactgcaccttcctttttggcatttgttagttggtgtgatttgtgcaacgagtgtatccaaaacttttttgcgcatagtatatgttcctcgcgtgccgacactggctgtagctaggtagcatgtaccacaagcatgtgctgttccccttccagccaggataggtaattaaggtaagaaattcagctggagcccaggatcatgcaaataaccagtagtggttcatgacaaccaaactcaccatttttttaaaaaaaaatcacttgttaagtcctaaaaattgatgtatcaaga

SEQ ID NO: 54271 - DNA, 1501 bp, Oryza sativa
atgagcctaggactatcatttctcttgttcatcatgcttcctccatggattcagagcttctctcatggcttgagcctctgggctgttctcccaagctcttttttctgattccaacacagttaccttctcatctgtagagcagaaccaaatagaaaaatagagattgacattagcacaaagcaatgaacacaagggaaaaaataactttttttagctggggttggagcagggacacacagaagccggtgtggatcatgaagagctccatgctggcacctatggcggcgccgcctaccgcgatcttgaggtaccaccccaggaacctcatatcctttcccgtatgtccgtgatgcaatcgaatgcacagatatttttttactctcgcaccccactcagctcttgctagctgccaaagaaaaagggcagtcaatcaaatgaacaaaccatgaagggcgtggcatttttgggatgggcattcagagttaccacaattttttttgaaggaaaactgtggaaggcatgcggccagcctgaacattttagtattgatcaaaattgtaatatttacatacagattgtgaagggtacaggggttgaggggaagcaaaaggggtcctacatattacaacatgtgagaaatttgttcccccaatctactactagacattgtgaggcaaaactatctgtgctgggaggtgatcaagacttgttcgatgacgagtgaaatgttaatagttgcatcagtaggaaaacaaatactagttcgtagcaggaaggtctatctatctttttttttttaacaaatgcgaaatagttttacagaaaactcagtttaactttgtgctcattaaaaaaaaaaactgatacccgtgctatccctttgcttatttcattctaccgagagataaccaaactcattgaataaaatattctagacattagcggttgctacgagaagagttaacaacaagtgattccaaatctagactaattcttcatataggagtattatttttcgaagctatgaaatctatagttgacataaggacacgccacattccatgattcatcagtaatgaatatagaaatgaatacgaagaagagcaagaaatgggaatttatttcacctctatggctctatgaccttccggtgtggactctgccctgtgtacaggtcgtcggctccctcctcggcccgcgctgtaactttcctccgtcaaaggtagcttggccggagagagagagagatccaccgcgcgaggcggcggcggcggcagatggagccgaggtcagacgggggagagagagagagaacgcgaagaggaggcacgcatattggcgtaatacacagataaaccgacggtccagatcatcccctggagtttttttttttgtgagagaaggcccagcgccggcccagcccgacccagacccaacacagaaaatatcactgctcgcaccacacacccgggcggcatggcggcgacctcgccgccgatga

SEQ ID NO: 54272 - DNA, 1501 bp, Oryza sativa
attgcaagaattcgcacaggcatgaagcgaagtaattttatagggccgcgagatggcatattttctatgtaaactgggccgtgtggtcacgagctcgcaccatgtctgcatgcactcgttcgggtcagtccgaggacatcatcgactttgcatcccatctgcttgaactcgtctggatgctggcgcatgatgtcgtcaatcaaatatgatcacaattatacagaaaggtaggtggatttaattacattattacactggtttattatgttggctcggcatttgccaactcaaatgcagcaaagtactccatccgtttcaggctataagatgttttgactattaaactacttcaagtttgactaagtttatagataaatataataatatttgtaacaccaaattagcttcattaaatcaataattaaatatattttcataataaatttttcttgagttgaaaatattcttttttctacaaacttaatcaaacttaaaataatttgactttgaccaaaattaaaacgtcttataacctgaaacggaggtagtagctcacaagtttgctgagttatatgatgccgtctttaaactgaccctcgcgttctcaagcaatagtccccgctatgctgaagacaacatggtatatttgtgcacgctaattagaagtcatatattaatgtaaattcagggaaaaaaggtatatttttaaatctttttgcatataacgtgtgcgtgcaagcagaaaaagaaaatgagaaggaaaacgttatgcaaacagaaagtagatgcagaacccacggattgagtgcaatggcgactcccttccttcacccaagccgagccgtccccggggtgcacgggaccagtcaacaactcccccaagtgcagcgcgtcctcttccacttccaacatctactatcttttctcacgctttttccgttacccgcgaagagctgaatacgaggagggcccatgcgtcggtgggtagggtgaaaagattccatgggtagaaggagtagttgtgtgatttcgtacgagtccgcactcacaagctgtacgatccgttccgttcgtcctttgatccttttctatctctcctcccccgcatcgccccctccccacttgactctctccactcgccttcgctttccacttctaccccaccctgtactctctccgtacattaccgtcccttccccacatttaccattccacccccacatgaccacgtatattaccgtcctttgccagccatgcttgtacttggacgaggggcaaatacggtaacccagctggtgacctctcctcacccagatcgaggcgccgccggggcactctcgtcatctcatctcccccttgtttcgtttcttcctcccttcttctccttctccacatgcgccgcgccaaacgcccaccattattactaccttcccttcccttcttcttgttgcagtcaacctcgccatggcctcgcctatgccaacgcctacccaccgcgtca

SEQ ID NO: 54273 - DNA, 521 bp, Oryza sativa
tgctccgcgctgacgcctatcaggctcagctccgccaggtcggtgcggtagccggcgagcgccatgtagaccgggaggaagagcgcgatgaagaaggagtcgaggcgctccgtgagggtggcgccgatgggcatgccgccggggagcgcgaggcccagcatcatggggccgatcataaacttgaagccgatgacgtcggtgacgagcgcggagagcagcgcggcgatgacgacgaggacgaaggagccctcggagaggaggtccccgggcggggtgcgcttgcgggcgatgtagcggccggcggggcgggcgacgaagaagacgaagaggacgaaggcggcgaaggaggcgaggaccttggcggtgaagagcggggacttagcctgggtgatgaggaaggcggcggcgaagcaggcgcggaggaccaggaggtgacgtcggtgatgagggaggcgttgagggcgacgcggccgagctcggagttgaggaggtcgagctcggcgagggcgtcggcgacgacg

SEQ ID NO: 54274 - DNA, 414 bp, Oryza sativa
actcacccttgctctatataaataatcccccccccagttgcgaaagaagatgaagtggatcctgctgatgaggagttcttccaggagcaagccggctacgatgagttttagggtttcggcctagttcccaagtcgcgcctgtgatgattggtccaagtcctggcttccgtttcgcttttgtaatgcagttgtgagctcgggatctgtccgtagcccaacatgactgtactcctactctataataaagagacctctgttgctatgatattctgtctccctgtgataccagcactgtttcctgggactggtatcgattaacaggttaatttggagcgtcacgggctagttccagccggaactggttcggggcgtgacactgctcggcctcaagcgagctccgcccaagctcccagg

SEQ ID NO: 54275 - DNA, 1501 bp, Oryza sativa
cgagtaaatttgcatcttaaaacgatacgcattgtatgtaaattaaaatggagtactcatttgctccctccatccacaaaggttattccctgatcggatggcaaatgctttggctgatcagctatttaagcaaaataagctaactaatttgcattgaagtttggctgaattggagacagctttggctgatcagccaaagtatttggccaaccgatgaggctgttagatatggtatatttcacatttaagttttttcaaataagttgtttatatttgttttttatacatttaaaacttataaatgaagagataaattaaatgtttgattagaacccaaggagtcatcttagagtaagtttaatagtatagccaactactagctccaaatcatctatagccaatgtaatagctaattcatacaatagttgcttactaaactattaatatctggtcccacctttcatacacacattacatcttagagtccgtgctgtatttggctgcagatctatagcccgctgctcttctctctcttctgttatctctttaaaatatgtttatagctagcttatagcctactattgtacctgctctaaatactcattggttgcatatttacattcactccttgattttgtaatatctaagatgatttaaatttctctttgatcttgatgacaaaagtaataggtataaattttgtggatagaggaagtaattaagaagaggaagtgatcagctggttaattaattggcacatgccaggatgtaaaaagaaagctagtggcttgcagcaaggagttaatagggcctcattttttcaagaataagttcaccggaggtccctcaacttaacagcgagatttctttgaggtcttttaactacgaaaccagaaatgtatatcccaaaactcacacaatccgtgcataaaaggtcccaaagcagtatatatgggtggttttgctgacgtggcatcctagtcagcaaaataaaatttaaaaaaagtacatgggcccacatgtcagctgcacatatatttcttttctcttttcttctcctctcttctctcttctcacttctcttcttcaggccagcggcgggcgagctcggcggcggcaaggaggctggcacgacgacgtcgcgcgtcaccgatatgcacacggttatggcgtcgacaagctcgtcggctggcgcggccttcccgtggcagaccgggcacgaggcgtgggacgagagccacatgtcgatgcactcctagtggaacacatgcccgcacgccaggagctgcctcacctcctcctcgtcgacgacgctgaggcagaccgcgcactcgaccgacgctgccgtgtccgagacctcgcttccccaaccaattgcttacgtacgactacttctccaaaattccccaatccccaatcccatctcaagctcatctcatctcgtttcgttagctacctaccaaattaataagctactgacagtgtagcggacgaggaatcc

SEQ ID NO: 54276 - DNA, 1501 bp, Oryza sativa
gttttagttatgcatatgctagacaatgatggaaaggaagggagtgattcatggattgattctattgtcaaaaagaagttgttaatcaagcacttaacctttgttgacatgggggccatagagacttggaaaagtctcatcctgttaacaacattttgtttcttggacttgaaaaaaatgttgtcttttgttctaaacaaaatgaggcaaaaactaaagttacttttttggccagtggagacttgtgggactggtggctccactggaaatgatacgttaattcattcctcatgattccctgaaacgggagaaaagctcagtataatttgaggtcagaatttcttgatatagagggctcaccatataattatagaaatggccggtcatgcacatgcaagatgcaacatgcatctctgtgatatttatgcatgtcataaaaatactgatcgaaagactatagctttaagcaccgtttttaagaactgaacttaagaaatggacgtgttaaatacttagtttacatttgttttttctcttgctgaaagtgaaggaagggttttgataggatgaaaaaaaatcttaagatcattatagatagtactaggtgaagttgatgcgtgttggttcactgattctttagtacttgtaggacagaagataaaatcaagaacttgcatggggttagcatgataccacattgactaaaataacacttgcagtgcaaatcaaggtcgcaggaatgactctacgttttaacactgcaatccatcatgcaacacagtaggatcatatctcgtttgtgtagttttaggacaaaatcttgaaatgtcacattcgttagtcttggagtgctcttatgattgtgtcatgttgtcctgggggaaaacataacttgtgatggacgcatcatatatcacacgagttacctgaagcgcaaatattccatcgcatgatcggtttgtaatcaaaactgtagcaaaattcactaagtactaatcttgcagaatgaattaaaatggaaggagttacattaactatgaattcattggcaagtacattgaacaattaattagccaatgcgcatggaccatggattgattgaggaggcagcttgaaatgaagaatgcaaatgcaagtgtgaaattaatgatggcatgtatatatgtagattaacgagagaatcaagtgctaaagacctacctattctttccaacaagaaagcatgcaaccggccggagtctactacctgtagcccctttcttttcatatatatactctgatctcatggatgtggtcgatcggccaggctgctcctatataaagggcgagctgtattgcaacagatataagctgcattgctgcacgcaatcaattcagtctcaggtcttgtaagcttgcatatagctatccagatatgtttggttgctgacaataagcatcttgattgatcgaccgatcgagttgcagtatatagttagtttcagactatcaagcagcatgc

SEQ ID NO: 54277 - DNA, 562 bp, Oryza sativa
agacggagctcgcacggccgcgcggcaggggcgagctgccgccatggccatcacaagctcgagcggctggcaacctcgagttgctttttccccttatttttttttcttctaattggattgcttcttattcctatccttcagagttcttgcttagttgctttgtctgtattcgtaaaagttcttgtttactgcttgattacctcggtcttacgcgaaggaaaagaaaaatgaggtcggagtggatgttatttttcctgtgtttttcctttgtaatcagcagcaaaggaatctttccttagatttttcctataacctgtttgtgccttccgaatgataggaaaggaaaaaaaatccctgtcaacagtattcctcaaaaaatcctttgaaaatactgtaatccgaagaggcccttagttttaaaatacaatgttggataatagattatgatgacaagtggaaatgtctaaagaaaaccatcaaataagtgaaaaatctgtaaaaaaaaaagggatctaaaagtttactaatttcatgaaaaaattactatacaaagatatcggca

SEQ ID NO: 54278 - DNA, 1501 bp, Oryza sativa
ttaagcactacatttaaacaaatactaagtggtcaatagttgaatcagtaagtcattgatttggcatgctgccgacctgccatagtcaaacaactctactattacaagcttggatttatttgccatccttgctcaccgcaaacaagacaacaccaaagagcccactagggccttgtcaataacatctcttggctagatgaaaaaacaaccaaattgcccaacttatactttttgtctggaacaaatggcacattacttgacgacactatagtataacaccagaagaaaattagaacagatcttacacagtagaacagtggtatggcagcactatgccggcacacgtgtaaagcagaagaatattggcaggtgagagttgttttcggtatcaatgcacctgctacaaaccagatcccttcttgcattctgctactgagactgaagagtgttagaataattgggctaggcccaatttataatattaaatctcaaaggtccataataaatgttgaggataataataccacctcaggatttaagcgagaaatatctcaacctaaatagggagttattagaggctccctgttgaccagttgaggtgggggtcggaatgccacacgcgcgcgcgcgccgggccgggccgggccgtgggcgtgggcgaggctggcggcggcgggcgtgcatcacgtcgcgtcgcgtcgctatccttttgcagccactaacccacgttcccacgattccctccgcaactttcccggtgttagtttctccctctccgcgcctgagttgctctcgcttccccgcttctgatctcttgcgcgcacgagagattggaagaagcagtgcctccgaaaccacacctttgcttgagatctgcaccgggtaggcgggtgatcaggtttttggggagtgcctcctgcacgactgctcatcgccatgtctggagttgctgccgccgctaccggcggaggtggtgcgccgccgccgacaggagctggtgcgccgccgccgacaggagctggatccggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 54279 - DNA, 252 bp, Oryza sativa
attcctgcagcccgtattaaggaaaacaagaaccaataaagaaaaggccacaccaaaaaggaaaattaaaaccaatttgacaaagactttttctccaccacatcgcaactatgatcactctatgttattccacatccacataaattctaacgcaagtgaaagagaggacaaacagagaactaagaaaaacctagatgaaccccaattgcatagtgaccttttaaaatcgcaatagacgtatgtcccgaaaga

SEQ ID NO: 54280 - DNA, 231 bp, Oryza sativa
tgaagagatggagatttgaggacagtattaaatgcaaaacactttctgattttacaagattttgtggataacaactgcaagatcttgaaacttcttgatgattcaatccaaatgagtagcagctcaaccctcttacatgatgaaaaaatgtgttttattttattttttgtcaggtttttgaaggcccccttgtgaattccctgttgtccatcagacaaggaggcctcaaga

SEQ ID NO: 54281 - DNA, 1501 bp, Oryza sativa
ggcgcgcatggcaggggaggggaaggggctagggagcctcgtcgaacacctagaggctaatgaatagtgtctttttcctatttttccaattttagtttatttcctatatgaatttgattctataatttctaaatcttgcataaatgaagtttactcaatatgtgtattatctcaactaatgaattcaccctagattaatattactcatattttatttttatgtaatttatttgagttttatttagggttaattcttattccatcgtatttaaatttaattgatccaaatatggtcgcgataatattttatttatttctatcccacctaatctttattttaaattataatttatttatttctttaaccaaatctaattgcagggttaatttctaattaattttcccctatttgtgatcgatgaattccgaaatcaaaatccaataaaattggcatgatgcaatttatttaaaaagtttttttttttgaagatccgtatttttagagttttgattttgtcggtcgaatttttagggtgttacagcatccaaattagtatatcggctcagtgagctgagccagccaaatacacacaatcaatcaatatacttatatacatacaaaaaaacatagggaggaatcaaggggattcgaatgataatagaactaagaaaggagattggattcggtgggaatggaggaggtctcttactttcgttggtatcggcgatacgataatagatactccagtaatcggtacccctgtagatggatccatctcgatgcttcctatcctcaagaacatcagcaggttgttcgtcgtcctccttctcttcttcttgatccatcattccttccgtgtccattgtgcctgcaaggatagtcgtccctccccgccgtctcttcctcctggatttggattcgacaaccatcttcccgaactgctgggaatcgccgccgcttccgccctccatcgatccctcctcgattcgaacgactcgactcagctagggtttgtttgccgctccaaaggggatcggttcggttgccttttatttctttttttcgcttatctagcctaatcaaatacggtttcggttttattcaaacattgattctcattgaaaacacgcccgtttgtgctttttatcttttttttttgtttttgtttttcaaaaacataaatttgtattatgaaaatgctgccaacgtgttcatcaagagagattgtgaaatcaatgtgttatctatcatgttaaaattgcccactactaccacttgtaagtgtagtagaaagactttttttttaattggatccatgccactgcaactttgtgaaattaaaaaaatgccaatattattcgtcatattggctatatgccactggaaatttctaaaattggaactatgccactcccctccctttttccgtctcctctctcacgccgtctccgttcccatcccatatgtcagtttcatctccccatcttttcctccatccgg

SEQ ID NO: 54282 - DNA, 1501 bp, Oryza sativa
ggattaggaatttgtcatgttcaacttggtgggatcaggaattggtgttgacgatgggggagagagagcgctcaagggaactaatgagaccttggtttggatacatctttagcccaagtctgttggcaaatgcattacacaaggggattgcctgaaatcttgtaatccattggtcatttttcggatggctcagattgcgaacccacgtcttccctcgcttcatgccacgcttagctctgcctccctctacctcgttgcatactagacgaaatctattcagcttatattcaggcctgtttacattattactgcctaaatgaactttatcgaaatttggcattgctatttttggaattaccgcgaaaggacctgtaacctattggttgcaagacctcagtagcaccttaggtcctgagttcgactccccatgtaagcgaattttctaggatttaatggacttcgtcaatcttaaggatttggcccagtcttggaagatgctcatagaggttggaagatgctcatagagatagggtttgcgtgtgtgtatctgcattgtactgtgtaattcaaagaggtaggtttgcgtgtgttcttgtactctaattaaaaaaaatagggtgacactcaaaaagtttatagtgacacgaacacataatgaatagtgtccaatgctgtttattactcgaggttggtttatgtccataataccttaatgttacatggcaaatcgtccaggtgggtttatgtcgtgaacatctgaaagttactccctccgtcccaaaataagtgtagttttgcactattcacgttcaacgtttgaccgttcgtcttatttgaaaattttttatgcttagtatttttattgctattagatgataaaacatgaatagtactttatgtgtaactaaatattttcaaatttttcacaaatttttcaaataagaaggacggtcaaacgttaggcacggatggaggtagtagtaatttggtggggcagaagcccctggactatttatgttctgtaaatccaacaagctggacaagatcggaatagtaggccaggcccaaagcaaaagaaatacctggtccaactaaaggacgggtccacagtccatcccacccgttgctttggcttctctccccaacattattaaacacaacaaaatctcctccttaaaaaacgacgacaaaagaaaaaaaaaagaagtagccgttagttggtagtgggggccatcgccgtcgccacatgacagcattcgtagtggtcagtactctcccgtgcactcctactagccgttgcgcctctcctctgctaatctcctcctctctctgctctggccacagcccacagacgcgcgcgcgcgctccagcttcatcttcttcctcctcgatcaccaactcacaaattccttccgctactcatctactctactctactcctccatcaaccaaatgcaaggaccacggaggcgaacaccacctgctcctgccgccaaacaac

SEQ ID NO: 54283 - DNA, 1501 bp, Oryza sativa
agcgtcggcggccattgcgatcagatcttgcatttcaagtattgtcagcacctatcaaagacaaattcttttaccacgagtttgacagcctagctctaatgcagacagtatcagctcataaaatctgattgcgagatacataagaggatcaattttggaattatcaagattagaaagaagataattttgaagcatgagttctcatagtccaaaattgggtggcatatgttagcgccaaaatttggtaagccccgaggtcatcatttgcttagaaaccatatcagcttcagagtcctggaattgaccgatgggaattgtcactcactagcagtcggattcttggttttggttaaggaaattaatcaattaaaggaagtttatttagaagagattgagtttaaggaggatacgacataacaatttatctattaattaagcagagttagttagttcccttttgtttttggaaagtgtgtttagtatccgatcaggacttgtgcttttccttttatctttagaaaagtttgagttgtgtccaataagggcttgtatttacccatgcgtataaatatatacacccggagtcattgtaatctatctctcgatcaatacaactttggcacatcgataccctttttattttcgtctttctcaacaagttcctgttttgagttaggctacatcggcttcgatctctgatgaggggtaaggcttattgtggctgtttgtatcggtgaggctagggcttcgacaccctaatcttgtcgatgtaaacatatatttatcatatatcttagttaatctaagtcgatgtctcaatttacctatatcggctagatcttttctagggttttttttatcagttaaattgtttcttagatctagattagctaaggtatccaccaccctgaaaatcagtaaaaggcttgattgtttagactttatgcttctttttcatactagcaaaatgcccatgcgttgcactgggtgaagacaaaaataaatagtaatgggtgtgtgggagcataatgccactaggttaattgagatccttatagttaaattgaatcttttcggtgcaagtaagacgctaacatgacataattatttgttgttctaaatccatttacatggattataagaaagctattaataccactttaaaatgaaattatgtattatacatactaaagtttgaaacccaaaaagtatttatttttttcatgtattattatgagtcggttgcaatgcatggttatatttttatacttgatattgataaaacacttttttttacatactgcaaagagtagcaatagtaaaagaaatgtttctcgctagctatcagatcaacctcactgcactctaattgcataattgctttcactcaaaaaatcaaaagaaatcgtgatgaatggaaagaaaaaaaaggtggtgtatcacataatagctctcactctaaaaaaacagaacaaaaacataccatgaatggaaaaaaaat

SEQ ID NO: 54284 - DNA, 263 bp, Oryza sativa
tgaaaatacaattggtcaaccagtcacatcgttcattggctgaggagttcagcacaacttttataaaccaaaggtcacaggttcatggcccggtcaaaattagggttttcagcggataatttgtgtaatttcgaccaccttgagtacactcatagttgatatataggatcaactatttccttctcaagaaaccataaaagattgagtgagtttttgggccacctataggacaaatcataactgttttcactttttcttttaga

SEQ ID NO: 54285 - DNA, 1501 bp, Oryza sativa
cagatcaagcggtcacctttgctccgccgctatcattttactatcggtagttgttaataaattagtcgatcactcgaaaacacgttattaatccgtttgggctcgctccttataaatctcacagcgcgagtacgtcatctcaaaataataaaaagaaaaaaaagaaaaagaaagaaaacacacacagcgcgactgcgcgaggtccagcagggaagccggccgcgtcggcagagactccagccaacgggcgccgccgcagcctccgccagtcggcagtgggagcaggcagaagctgcagcggggggcctcgagcaggtggcggcctcaagcggaggcgagcaatctcagggaaaccaagctcgccgccgtcgtacccattcttccgtcgcagatttcgctgtgactggttccttgtgattgaatccataggaacggaacccaaatcttggaattgtttttgcagtgcaagtctaatccttgggaggaaaaaaaaaagaaagcgtaataaggttggtttcttctccatcactcccatcacctacccacctgataactcctctcctcctgccgccgctgctgccacactccaccactatcgtcgtcttcttatcacccctacctcacctgcagtcctgcaccaagcaagcaatctccaaagtgcaagctttctcttcttcctgcgtctggatctcgctcaggtatgcgtccacatttgctttcttcttcctccattcccattcccccctactctcagatgcgtggataccccttcctctgatctacaggtttctcctctgcctgccactccccatggctctggattcaggtcgctcttcagcattcactaccgtattcacttcttgaaggccaatttctggttcctcaccaaaggttggttactctttctttctttcttgtcatccactccaagttgactgcctctgtaaatattctatctttccaactgttgcaatggtagcccatatttactagtattttttcccttggtaagatctagtggccaatttaacttacatcttcaaacgcctgtaatcatctatgtcaattaattatgtcaacctgtagctgttcgattctgaacaataagtgggaacggtagttgacaggtcagacctgcttcattgataattgatactgtccaaatggcgatgtgttgtcttgaactcatggtcattatctggttgctaccatgtagctttctcatgaccactagtgttgccgactcaacgagttgtagtgttcctgaccattctgttaaacattcatgccttgtctttgtggcaacactaagaacatttgatcggctagcaagcttatatgtacgtaactctttttgattatttctttctactttactgtcatggcatgtgttatatgctgttgcagaaatgcactccttttatgtttgagggaatggtgatttgcatttgtgagtgacatgttcttatcttccccatctaggtacttgatgatccgaaga

SEQ ID NO: 54286 - DNA, 1501 bp, Oryza sativa
atgtggatttgttggctgtttagtagcttcaagttctccactttcagatttgaacaggagtagaatgtcaaggcctgtcagatgaaaaagaagtcagactttgtttgagcaaaatagccaaagttttatgaattgtgatgtgctagaagattaggatttgggaagaaaactcaccgttggagcttcagtgcatggctgaaaagaagagaagaataatatccacattagagatatttccaaaataaaaatgaaaaagagtgtaatgattcataactaaataacttcagagcacttacaagttttgcattcgttttgcaggaattttgccaccaaatcttgccgttttcatcgacagtcccaccaccagcgacagtaaggccactcacaccattgaacataatccagtgcctaatagtttccttgctccaatctgacctctttggaggagccaccaacgtaccctctatctgaaaatgttcaggaacttaacatttttgagtaattgaatttcatatgaaagtaaatgcaagtgcacgagtgcatatttcttaccatgaacgtgatgcttgatttgcatggaccagatagtgtaatgtgcttggtgaggtatctcttgccctttgggatgagaacaatggaaggttgcgaagaggagcaagctgcagcccatgcctttgccaatgcctgcaacaacggtattagttaagttttgctatttgtcagtcgcctgaaaataaaacaaagacattatacggtgtcacattttaccttcgtgtcatcatgttgtccatctccgtaagcgccatgtttgcgcacatcgaacaccaccttctttgactcaagagacctgcctctgagactatcatctccactagttaaatggaatgatgcattcatgttgaccttggcatgaacactacacaagaagaacgacatgacgacgacatatgcagagaaaatgagcacattgcaagccatctttccaactgttaacatatgtcaacacagtttcggacgatgaacagtgcagaaattctagtgttgttgtgagttctggactttgtagaatgtgttgatggatgtggcgattgatggagaccaaggattcgatcagggggtctatttattcgcgccgaaaccggttggaaatctttggatgttctcaactcaaggttgcttgttgttgatcagctagataggttgggttcagatatttggatcctagtatcacaagattctgtcggcatgggaactgagataaatgtgcctgagtccctgactctttgttgcttcactacctagtctacttgtatggctaaattacttccagagaaactaatcctgctattgaaagaagttcagcactaaaagaaaaatcaaggagacctggatcacagttgagtacagacaatcatctaaaatcctatgcatttcatcagtgctgcactcttgagacccactctgaattaactttgacagatttacgagccacaggtctcct

SEQ ID NO: 54287 - DNA, 1501 bp, Oryza sativa
ttttcttttaatatattgacgtgcaattattttacacgtttgcgaaaaaaataccgtatttttaaccggagagaatatgattttactgattttaatttattgagaatcaaacatgtaatgagcctgctggtatagtgacattccttctgttaattgtaccaaactgccagagtaaacatggatttgcaacatggaaatccatggccttaattagcagtacagtagcaccaaaccattttgcttatcagacttgtagtgtatcaactattaaccattcaaccttcaactaatctttgtctttttcttgtgctcaagtgacccctgtaactaccaacatgttcttttgcttaaaaatacgaattcctcttattcaaccactaaaaatacaaaagggaatagctaaccctatacattgagccatgtcggctacaagctcacaacgacattctgaataaatggctgaattgtgcaatttttgattatgtggtttccccgaaagttctacttttgaggactgaggacgaaccttttcaaacaatgggacatatgctcctaagaacattttcttcacttttgacatgttcagactagtgtatgcatctctctacaaattgataacttttaatgcaaccttcttttgttaacaaataaaaagtatgtattgcaaccttgcattgcacattcattgagaatattttcttaattattagggagcaaaactttgagacaaacctcaaatgtactttgtaggagaaagatgatatcttagttcttaaggttcaggtacatgtaggagtataaaaatgtttgtaaaagtagctggctagctctgaggaatattgagcattgagcatgctttcagcatcaattttgcataggcagcatgtgcatgtttaagttttgcgccagaattcagattgatgagtaaagaaggatctgagaaacatgcacaatgatgaagtttttgatacataaacatgattggttagctagctttttcttgagatagatcatgtatggctctttggaaagctatgatacactgatgcttacttgtttggtaaccctgccctgactcatgcatgtgttttgactttgagctaagcagcttgtagtaagctggtaccaaccaacctaagggctagaaagctgttttttttttttctgatgaaaggaagatgtggttgataacaatgataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 54288 - DNA, 1501 bp, Oryza sativa
tgtatatctggtgaagttatgatactgattaggatgtagcaatggctgtatttggttctttgcattttaaaacatttgcttgccatgcagttggagccccttcaaagaaaaaccgagcttctaaaggtggaaggaagttgatatccgcatgtgatgcagctaattctgaaaatgaagtttctcaggtggtctctggtataccacacgatcagaaggtaaaatattttgactgaagtgaacttttttggctacttttctttttgaccactgtagagtaaatttcgtccaaaaagaatagagaaagggggaacagtacattaactacttaatgcctgttccggcacatgattattacacttttattattgagctaccaaattaacatctgaaaaatattgtactcttttggtttggttgttttagatcatctataatgtttagcctttttgtaacacctgataatcgtgcattggcatgtacggtgttgcttcactacaaagttttcacaacaaaatttggaacttatttttcctttattatttatattggtataattgctatgcgtacgtaactacttatgcatttatttttactacttgggcagcagtcagatgacaatgttgatgggaggccatgcaattccatattttcccctgcatatcaccttcagaaagaatgtggtgcgagtaacttcgccaaaggtatatataattgccatattttgaattcatcttttgatgccgtcattgttaagttttggactaggacgctttaaacatctgtgaaccataacatcgtataagtttcagggtataaagatttttctaactgctatcaacattcagcaatacatccttgcaaaaaaaaaaaacccaacaaaatgatcctgccctgatacatgctgcagtcaaattcttgaacgaaaaacttttactagttttgtgagtggaaaatatatcataacttttacactattgtgttgtcttgtttgcctgagaatgaaatggaatattcactcctgcattgtcttaggtgatgtccatgagaaattatgacttttaggggttattatataaatattatgagctccagcattagcactaggaattctgtactctgacagatttcaatgcaagttttgaatttaatttgctcacaggtggatatttcaatttaacgagatggtttatctgtcaacaaagggttcctttctgattatcaaaattagtttgttgtcatctattgttggaacctgtgccctagtaatagtacatgtctcatcgtgcatgctgtttctatgtgacttcattgtggctgtggtgctcattttgctctccataccatgttgctccagtagttgattcttgaagcgttaatcatgcaggcttagaacataaaggtgatacattgggttcggttagctcagtagaagaaaggacaacacatgctcaaggtagaaaagaagttaccaccagcagatctgaatccactagccatgcag

SEQ ID NO: 54289 - DNA, 1501 bp, Oryza sativa
atgcgtgaaaagcagctaaattatgacagcttgaccccacactatagcaatggtaccgaccgaccaatcgtggctctgagatcaatttaattccaataaattaatgtgctataactatcattagctcgcggcatgctattcctgatcatgaaaaaaaaatatagaggaagcataaaaatgcatcttctttttctttggctttataaatcttttgcatttcggccaggacataccttttgacctgtaagtgattggctgcgtgaaatttcagtgatgatggttgcacaattttttgtaggtttggtaatgtgtgtacactatccagctaggcaatagtggtgaaaaaaaaatgctctctccatttcataatactttgcaattttgagttggcatttttgtgtgtgaacatttatactttaaagataaaatcataggtattaacaaataaaccatattacttaagtactacattgcaaatgtataaacatatagatcgatatcatccataataaattcatgatcaaaatgtgttagaataaaccggtaggatttcagtgaggttaagaacatagaagcatgtgtgtgcgtgtagcggcgtgtatgcatctgctatgcgattgcaaaaagaaaaataccagaagtcaaattaactaaacaaattggcggccaaaatagtgagacagataataattaaaaagcatgtagcagaagaaacgtacgtaccgagcaggatgggggcgagctctctggtgggctggacgtcgaaggggtagctggtgccatcgcgggggcggatgaggagggcgccatagacggtggcgcggagccaggaggagtgggcgtgccaccagagggtgccctcctgcgccgccaccgtgaagcgataccggtagctctgcccgggcctcaccgggcactgcgtcacgtactccggcccgtccgaccaccccgtcctcatctgccgcaccccgtgccagtgcagcgtcatgttgtacctcccacggtttatcaggttgatgatcagcgagtccccttcgtttatctccagcgtcggccccgggaactgaccgttcaccgtcattatgttgtggctcttgcacagcctcttcactgttgtctccctgatctgcagcacagatgatgaaatggcaaccaaattaagctagctgctgcagatatatatgatgagattcagacgagctaagtaactgcatataaatgatcatgtatatatgtactgaccacaaactcatggtattgctccttggcagcagccagggagcagagcagtgccaggcttaagagccagcatgaacaccctctgcttggcatgctgcttgatagtctgaaactaactatatactgcaactcgatcggtcgatcaatcaagatgcttattgtcagcaaccaaacatatctggatagctatatgcaagcttacaagacctgagactgaattgattgcgtgcagcaatgcagcttatatctgttgcaatacagc

SEQ ID NO: 54290 - DNA, 1501 bp, Oryza sativa
agctaagcaaattattaccaggtataacatccatagttatggtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatatttcacaacagtagctcgcgaaccggtccttaattgtcatgagcacgactctcaaaaccatgtgctcacaacccaccatcatcaagttttagttggcaaataattaattaaccaatcacgattgaccatcgtgaactatcattaagccatcattaaataataatgagtcataaattatcccaatagtgtgctaatgtttctaagcatggctaagcaattatatctaatatctagttgaaccaatatatatataaagctcaactagtccaattataataacccaaggtaacaaggaataaagtaatcaagaacaaaagggccataacaaagaataggttaattccacccaatgacattcgaaaataaatgcacagttgaaataaatagagaatttaaatataggatcaacatgctcaaaggattgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacagtacataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattaaattatgacgcatttatatggattttaattaaattatgacgcaataatgaattatttttgaaaaggaaaagagaattattgcgtcagcggctagggtttcggtggaccgggcgcacgggcgacggttcacgcgaacggacggccgagatcaatccatccaaaacggacggccgagatcgatcggtccacgaccggctcacggggaacggcaacga

SEQ ID NO: 54291 - DNA, 561 bp, Oryza sativa
atgctctggtgctttttactgtagtataatacaactgttaatcagtaatttactaataatataatgattaggagtaactttattatttatttttttcccggctacatcgatcattcattgtactagcatcactcatatttcatcgaaaacactaaaacaagaaaaaaaggtttagtcactgataaataactattatacccctttgtattttttttataataataccccttcatattctactcccgctaactaaggtgatagtataaataaatttaaactctttaatcaaataagatatagggttcatattgatttctactaagagtagagagcgccgtagcgggctcatcatgaccacatccttgattatctctttacctttttcaggccaaaacatgaactagatgaggacaacatgccagggaaatgggggttagagtgagactagttcacatggacatgagcaattcgtccaattgagacttgagatgaaagatctagcctgaaatcctccccggagatcacaccccaggctctccgttccgcttcccggcgtcgaca

SEQ ID NO: 54292 - DNA, 1501 bp, Oryza sativa; identical to SEQ ID NO: 54239

SEQ ID NO: 54293 - DNA, 328 bp, Oryza sativa
tatgtttggataatggaaaatgaggggtaggattgggattgggaaatgtggcaaggtagagaggccaagttggtgtcgtcccgtgcgatggagaccgagaccgagccggtacaggagatgcgtgcggctgtagtttgagagaattacaatttaggtttggtaattgaggatagagtcctagtgtgactaggagttgttctcctactttgagtaggaggttttcggtataaatagagagggagaggtagcctcccggtatcgcttttcagagcgtggagttgatagtttagttagggtttcgagattagtcgagatttttgtaaggagt

SEQ ID NO: 54294 - DNA, 1501 bp, Oryza sativa
acgattttgtaactcgattacaagttgagggaccttcggtgtactttttcctttgcattttactctcttctgtttcggatcacacaaaaagttgtcccgcactcggcaccaattcattttatgttgtttcaaaaaaaaaatcattttatgtatgtccagtaaaaaatggtttccacgatctgtataattgccacttttgaagctccagaaacagttgctgagttacctagtcatgattttgttctaaagtgtgttaactttacactttgcaatccatgcactttggtgatatgaccttcagttaagcattggtcggcactttctgctaatctgaaaagctaatgccagcacgcggctatgcattgtccaggatatacataacatattcagaaacacacacacacagagtagatcagcaaggaaggcattgtggtatttgtaattgatattctgatagagtgattcagttctgttgcaaataataatatttgcctatataataagcttcaaaaacaacatagacgaataatgtctaccacttactaatactactaccactaagctttcaaataaatcaaacaattcataaatgaaatataagagtatctctgtttctactctctggctgctctgtttctgaaatgtctagataggccgcttctcagtctccgcacaagttaaaattttacattactgcagacttccaactagcaacaacatatgtgcctgcctgacatagacaaaaaaaaaagattaattggatccatgccactgcaactttgcaaaatttttaaaaaatgctactactatttgtcatattggctatgtgccactggaaatttctaaaattgaaaccataccactgaaaatttctaaaattgaaaccatgccactcccatccctttttccgtctcctctctcacgccgtctccgttcccgtcctcatcccccttccgcgaggaggcggaggccgccctgcactcttgtccatcagtgccggtgataacgatggcgacgacggcgatgcaacggagcgccacccagtagcccgagtagtagcggcgagctcggagaagaagatggtgggcagaggagggagaggagggagcgggtcgacggcgccgagtgaggctaacgtaccttacccgcgactaccaccggagggctcgggagccaccgccaccgtcctcaacgccagctgcagtgagaggtctatggagctgtcgctaccgccgtcctcgacaccatccacacgggagggctcgggagtcatccacattggagggctcgggagccgccgccgccgtactcgacgccatctacgacgggagggctcgagagccgccgtcgccgcctctgtcctcgatccatgatgggaggtctcaggagctaccgccaccgccatcctggacgccatctgcggcggcaggtctctggagctgtcaccgtcgccatcctcgatgccatccgtgcggtagggctcgggagccgccgccgctgt

SEQ ID NO: 54295 - DNA, 1501 bp, Oryza sativa
aataaccacgcttaggatcttgttactactatttgatattcgagaatcaattttatacacctaggtggatgtccacctacgccaatctccatccaatgttctttaagatctgtgccacccatatcccacgcccatcaccgaatacgaatctgcctgtgcacatatctcgggggatgcatcgacggcacaacagttgggtggacatccacctatgcgatcggaataatctttctttgatattctatatatcacaatacaagaataaggctaagttatagtgtttgcaaaaaaaaaaaatatacgaaagttgtgtaaaaaaacatattaattcattttaatttttacctaatacttaactaattatgcattaataaaccacctttccaagcacagcctaagtggtggtggatctaccatcggcacgtcacaactacttttacacgttttataaatcagtccatgaaaatttttaaatatttatttaaatcaagtgaatatatatatatatatatatatatatatatatatatatatatataaaagcatttgcaaaataaaacacggacattttttttacccatagccttctgttagtagatagaaaaaagaaagaaaaagaataaatgccgaactgcaagtgaccatcagtcctcaccacagttatccatggcaacacagagagaagaagagaaggggattgctttgatgaaattgtgtgtgagcgaagcgacacgtttcgtttcgttttcttggaggaaacaaaataaacaccctccgcgtgcagataaagtacatgtgaatatcgcacatgctcatcgctgcttctttcctccgacgactcgccgccgcctgaaatctctttcttgattcgtgcgctcctgagctaccccgatggccgcccaatcttccactccctcgccgcaaggtcaggtttttcttcccctctcttactgtctcatatcctccgaaaatcgtggcgctccccgtccaatcctttggatcaagatgacgcttttcttcagacttggaatcttggcgcttcttgctcgatgtttctatcccgccgattgttagccatataatttgggactgagtttatgagcaactcttctctttctgttgagagacgagggtttggtaattttgagggttagaacatgagaaccgccgaatcttgtaccgcgattgcctactggaataagcgtaagagtcctggctgctcatatcatcactaattctagcctcgttagcaagggcaactagcttttgaggcgattcagccaagacaagttcatgccctcttgtggttgtgggcacaagtccagtggctggctgcagtttttgctgcaaatatcgacaatttagaggtccatagcaccaaatgaatttggaaccaccggggagaaattggctattctgaaaccttgagttattatcttgttattttgttagttatagtcactcagattcccctgtcctgaaaatcgaactgcattcccat

SEQ ID NO: 54296 - DNA, 613 bp, Oryza sativa
ggggctaaagatcccggtgatctttagccccggttgggctaccaaccgggactaaagtcccacccctatatatatgtcttcttcctcctccagctgcccgagcaagcttcaaaattacttcaaaaaagaggggaggtcatgccaaaatttctatttaatttattttggtgattacatacaaatcggaggtgcctaaaaggtttgcaacttcatcctccaatgttttttttgtcatactacatttgcacctatgttttgcacacttttttttgtctacaaaatttagttgtaagttgatgagagagaaaatgtgtgtggggaagaaagaatatatagaaatttagttcatttgctaaacaatgttttataaaatagttgagaaggaaaactctagtgaaagttaatcttaaataatagaaaacaaactaaaatgaaaattaaaagaagtaaaacacattaaaattagtttaaaactttacaactagtttttaagaattatttggtgtaatattttatgatttttgtatgaataaagatatcttataattattgtatgactgtcattattgtaagaataattatttgtgtgcggttttttttgactcatgtagat

SEQ ID NO: 54297 - DNA, 1501 bp, Oryza sativa
cacccgggaccacgcgggatggacccggcccaccggctctctctctcccttccccgcccgcgcgcgctttgggccgccctcttgggccggttggcccattaagctcggccgagctgccccattctctcgggccgcgccctagccgtccgagggaagtctaatttccctccctctttcttttcttttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcgaggcaagccacctttgaacatcttgagcctatatttgaacttacttatgttgcttgaaaaatattatgcattgataggatcgcacttaatctgcttgtcccgtctgcaaggcagattggcggacctacctaatttgttgcatttgacccttccattgtaattgttataccatgttcccttgtacccacctagttgtgcctcggtaatcgtgcactctgcacgggtatcgacagtcgccttcaaacttaaaatctgagaaacatctttggtaaaacttgggttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccgaacataagacaagtacgaccacatgggtggaatgggacacccctggctgagtaactagcttatcgggggagccatgatgctaagagacatatggattcgccggggtggtgtcggggaggacccctgggcttcctggcacagtaaggtctgggacctatctggtgttggtttgggacccctctcgttggcatatggtgaacctgtgtcgtctttcgaaatgccttgtcatgaaagccttaaggtctctagtcgtggccgttctgtacgggctggatgatccgggttagtaatgtcgtgtgggtaaagtgtaccccctctgcagaggttattaaaactgttcgaacagccgtgcccacggtcatgggcggatgtgaggtgattcctagcatagttttgtttgactactgccttgtgaaatttgctgttgtggaatgggtttgatgtttggaaaatctgcggctgatgggatcagccaggcccgggcggccgtttgaaagctgttggccgggtgccaaccttgatcgattcaaaagactgatacattgcacatactccgaccggacgagacgcactgtctcatccgtgtcgtttgagaagcactcccttagttgtttc

SEQ ID NO: 54298 - DNA, 1501 bp, Oryza sativa
ttaatgcaggcttcaaggaaaggctattgtttttgcgattgattttatttaaactcttttcagaaacaactaagggagtgcttctcaaacgacacggatgagacagtgcgtctcgtccggtcggagtatgtgcaatgtatcagtcttttgaatcgatcaaggttggcacccggccaacagctttcaaacggccgcccgggcctggctgatcccatcagccgcagattttccaaacatcaaacccattccacaacagcaaatttcacaaggcagtagtcaaacaaaactatgctaggaatcacctcacatccgcccatgaccgtgggcacggctgttcgaacagttttaataacctctgcagagggggtacactttacccacacgacattactaacccggatcatccagcccgtacagaacggccacgactagagaccttaaggctttcatgacaaggcatttcgaaagacgacacaggttcaccatatgccaacgagaggggtcccaaaccaacaccagataggtcccagaccttactgtgccaggaagcccaggggtcctccccgacaccaccccggcgaatccatatgtctcttagcatcatggctcccccgataagctagttactcagccaggggtgtcccattccacccatgtggtcgtacttgtcttatgttcggatgaaattccaaggaaacggtccttatgtgcaagagcgggaaaccgtacacccggtacgttccccggtccgcggttttggaaattcatttagttcgcaagcaccgacccaggtgtcgggttttccaagtcttttgtaaaacccaagttttaccaaagatgtttctcagattttaagtttgaaggcgactgtcgatacccgtgcagagtgcacgattaccgaggcacaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataagtaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaagagggagggaaattagacttccctcggacggctagggcgcggcccgagagaatggggcagctcggccgagcttaatgggccaaccggcccaagagggcggcccaaagcgcg

SEQ ID NO: 54299 - DNA, 1501 bp, Oryza sativa
tagatttttctgggatttatttgagctaaggaagtatttttaataaatggaattgcatttcatgaataatttaaattgaaaaaggtttttaaaagtcttcttttggctttgggccgaaagccggcccaaaaccctctctctctctctttccctcggcccagtccggcccaatccgccgagccgccgctctcctctctctctcagccgctgacaggtggggcccgtctgtcaggcctgtcttcctcctcgcgccgccgccgccgcccgaaaccctagcgcaagccgccgccgtctccttccaaatccggccgctcctttccttctccggccgaatcgatagaggggaaacaatctcctcgatctcctcttccttttcccctttggaaacatcggctaaatcggcttggaaagtgttggattcgagatcgaatcggattcctctctctctcccgaacccgatctttccttctcgtcaccggtcgccgtgggccttcgccgccgccttcttgcacctataaaaggacccccgagctctcctctatccgccgccacctttgctttagcctgccgtcgcgtctagcgccgcctccgcgtagccctagtcgccgccgtcgttgccgttggttcagccgcgtcgcgccgccgttgcagccgccgtcgtcgatcgccgtcgccaccatcgggttcgcaaggtcgtcgccgtccccgtctgccgcttcaccgccgccgaagaccgccggagcgccgttgccgccgtcgacccgaaggttgccgccgcttcttcctcgtcgccggcgccgtccgttgctcttccgccgtggttttggtcaccggtgagttcgccgcgttgtcctctatccgttggtgccttccgttcgtgtcgaagcgccgccgttcgccggcgagcgtgcgccgtccgagccgccgagccgccgccgccggaggtgacgtcgtcgctgacgtcatcgttgccgttccccgtgagccggtcgtggaccgatcgatctcggccgtccgttttggatggattgatctcggccgtccgttcgcgtgaaccgtcgcccgtgcgcccggtccaccgaaaccctagccgctgacgcaataattctcttttccttttcaaaaataattcattattgcgtcataatttaattaaaatccatataaatgcgtcataatttaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtactgtttatttggtttttattagtctttt

SEQ ID NO: 54300 - DNA, 1501 bp, Oryza sativa
taactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacaatcctttgagcatgttgatcctatatttaaattctctatttatttcaactgtgcatttattttcgaatgtcattgggtggaattaacctattctttgttatggcccttttgttcttgattactttattccttgttaccttgggttattataattggactagttgagctttatatatatattggttcaactagatattagatataattgcttagccatgcttagaaacattagcacactattgggataatttatgactcattattatttaatgatggcttaatgatagttcacgatggtcaatcgtgattggttaattaattatttgccaactaaaacttgatgatggtgggttgtgagcacatggttttgagagtcgtgctcatgacaattaaggaccggttcgcgagctactgttgtgaaatattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataactatggatgttatacctggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgttatatgctcaccttgcaataatcaatcaacctcagt

SEQ ID NO: 54301 - DNA, 688 bp, Oryza sativa
agcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggt

SEQ ID NO: 54302 - DNA, 1501 bp, Oryza sativa
atgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataactatggatgttatacctggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgttatatgctcaccttgcaataatcaatcaacctcagttgaagaaaaaggatccagaaggagaagacgtttggcttataccccagttgagctgcctgtgggagtggagccggagcttcgctagattttattttttccgctgtagttttcttcatggtgaggactaagtgcctcataagtaagtatttatcgttttagttaatttgatgaatctgtatattaaattgtcagtttgtgtacctcggctgattcctggacgaggatttaatgcacaaataagttcggaaattactatagaatttccgggcgtgacattaccgaaagtgttatatttagctggctatttagcctgtgtgggaacaacagaacaagtaacgcatttcaagctgtaatgagcttgattggttttttagatcgtaaagagtctttcccacccaaaaagctagccaatgagatgaggggctcccccacttatatcttagatccttttttcttccacaaccaatgtgcgactattcaacaatctccccattcacacattggtgtcctttagcccttcaccgccccttcaccgtttctccacagtcccttaggtatacgggtcccgcaggcacccacgatccatcaagccagagatgttgaactagccaggctttgataccagttataggatcgtaagggcctttcccaccccaaaagctagccaataaagtgaggagctcccccacttatatcttaggtcatttgcccttccacaaccaatgtgggactattcaacagttttttgtttaaatttgggctcttacatactgctatgatttaaggatgtacacctcctgttagattcaggcactcagtaagttagcatgttctcaagcttggattacatacggtatgttcatctgttagagccgttgtttgcacccaaatttagcacctatggatgaaataggggaaaattgtcaaagtttggaaagc

SEQ ID NO: 54303 - DNA, 1136 bp, Oryza sativa
ttttttttctggaattaactcatcagtgacggttcggaagaaacatccgtcacaggtaacttcacctgtgacggactcgcaaacgtcggaccgtcacaggtgacccacctgtgacgggctgttactttcgggcccgtcacaggtgggtcaccctgtgacggctactatataccggggatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgtggagattaaatttattaattagcagctggctggtagatatatattgtttaattagtgctagtagtagctagcttgagtgaagttgaggtgctccctccgtaaaaaaaaaagacaaaccctggtttccgtgtccaacgtttgaccattcgtcttatttgaaaaaaatacgaaaaaaattaaaaagacaagtcacgcataaaatattaaccatgttttatcatctaacaacaatgaaaatacgaattataaaaaaaatttatataagacggatagtcaaagttggacacgtaaacttatggtttgcctttttttggatagagggagtagcatatacaagtacaaggatgaacaataatgcgaagtggtggctggggtggccattgagccattggtaaagttagcagaaaagaaaaaggctagctgagaggatagtgttaggagagatcgactttaatttctttgtgaaaagaaaggcaggcatggaggccatgatctttataccagctagcagatcgaggagattgccacccctatatagacctcatgtggtccgtcctatataattaaggtaggtagatagaggagagggtgggcgcgcaacagcaataagcattatatagagagggagtgagagagagagaggtggattgatttgaagcagagcgcagcaagcatatagtaggtagatatata

SEQ ID NO: 54304 - DNA, 1501 bp, Oryza sativa
ttatagaagttgaattttaatttgcatgtttgtggagcgatataggtacatattgatagatgtcgtgtttgagtatactttgaacatatttgatcgccatcccgttgacttgcagtaaatgggtggacgtacactcgagttattagaatccatctccgtaagtagattaattaatacatctccataagaccgatattataattaatcgatctatcagaaaaagtatgcctcttttcgatcatttccttttctttccttaattataatttatagtgcccatccggctagcttgtccatcgctagcagccatctttgatacgcaaaatgatatgatatgatgcaacatttatcaaattaattaattatctaaagcttaactattttcaactcaaaatttaattaagtcactaacagttaaactagtctgtctgatagctagctccaacatcaccttaataattaattagtaccttttgtgtcatgtcaccggcggaattgaaattagcaccgacacttttacaaagtgtagtcgtggtatctcaggcaaatctgaaacagattatcatcatgcatataatattctactgtatattaactatattgatgcaaaggtgacggacctagctgggctaataattaatttacacaagcttcaattccatctgccactagctttctagtaccttctaaatatattaaaaataattaaggtcatatatacttagcttattccacaggaaaaaaaagaggataaataaataaaaggccatatgtaaaagcgcgcgtccttaattactacctttatctctaaaagagtgtccttttataattatagtcaaaaaaaattatgaacagaggtagtgatggttgggtgttatatttgagatgaagagagtatagagcaaccacaaatttatgaattaatgcgtagatgatgcatgcgcgccacgacgcgttgatgcagatccaatcgagcatatatactagtatgagaggcaagagatctcgaattcacgatcgatatatattcaaaccgcggccagtcaaacatatcaagaaaggaatacccatcaattacaaatagtgagagagatatataatttttaaaacataaataagagctaactacgaatcgcgtgttcgatttttcgtcacaaaatagggtgcccatcctcctcgcggccatgcttctctccgactttatcctggtcagatgcatgctgtcctttgctacctcttcacatgcatggatgcacatcagccatgctcccgtaggggtgtagacacataggcctgtgcccatatacaatggtatataatcaaattataaatcagataagtagtttgagagaatattcgtcttgaaggttaatactctctctgtttctaaatatttgatgtcgttgactttttaaaatatgtttaatcgttcgccttattcaaaaaatttaagtaattattaattattttcctatcatttgattcattattaaatatactt

SEQ ID NO: 54305 - DNA, 666 bp, Oryza sativa
ataaacggcgcagacgactccatcccacaagcagcttgaccagggctacgcctaatcctctacaccatcaacatcactgtagcactcctcctctgatgaatgattgcaaggtgagtataggatatactcaacaagccacgcagcaaatatgcaaatgcaagatataacaaaggatggcataatatagtctcatttgcataaacggcatttaataaatatttcagaatttaataaaacagtaaggtattaattaaacaatattaatccaacactatacaacatacccgttgcataggtccaaccattctgaacaaccattcccgactgcacagttctatctccaaaccaggaatgtaacattccaaaccaggagctacacaaattattaccaattacagcatcatttattatggtgagaggtgtgaaactaatcacgaaagacattgttagacccacccataactgcgggcacgactattcgaatagttttactctagccagaggtgtaccactgtacccacaagacacaacctcaacatcatgtcaaccatgcgtcgcgatacttaacaagtacccgaatagagattgtgacaataccctctgcataacacaattcaaagcagtgcaccattcccggatcataatcacccccttgtaaacaaggca

SEQ ID NO: 54306 - DNA, 1501 bp, Oryza sativa
tctccctcggattcgtccgattttgtgcccgcgatcctcgccggcgcaatcaatggcggccgagatctccgcgccggtttccatctcctccggccgctttccctctctcccgacgctttttaattgttccccgtgcctctctcctccgtttgcgccgttcgccgctcgctctcaccgtcggaatcgcgctcgcgccgctttcctcttctccgcgcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgtttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccgcctcccgtcggccgtgccggcgaggctgccttcgggcgcgccctcgcggctgccaagtgggcccggccgtcagccgcccgcgcccgcgggtgcggctgacgcgtgggacccacggcgccgaccgccgccagccgcgtgcacccggtccaccgtggaccgagaggctgacgcgtgggccccactcccgtggacccggtccgcgcgcccctcccgtcgcctgatgcaataaatccgattttaaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagctcggaagatccgctcttcgtggaagttgaagccggcgtttgggaaagcgagcaaggcaagtcacatcatccttgaacatattgaatcccagtttataaaattattttgatttaaattattgcatagtcgctttatttaaattcccgcgttatcactgttttatttagccatgcctatttacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggt

SEQ ID NO: 54307 - DNA, 356 bp, Oryza sativa
acctgtttaaacagtgtgataagtattggaacctaccgaccccctcgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatacggagaacgcagccgatatttattaaggaagcatctaaatttattgatcaggctaaggagcatgctttgagggagaatatgacaaagatcttttgtccgtgtcgtcattgcaagaatcagaaattgttggtagatcctggtgaaatattgggtcacataa

SEQ ID NO: 54308 - DNA, 1501 bp, Oryza sativa
accgaagaatttttaggtggtgagagatcgctacaatctactggtcgagaaccaggtgtaggcgtatcttgatcacctgaagatgaagttttaggtagtgagaaatcgctacgatctactggtcgaggatcaggtataggtgtatctcgatcacctgaaggtgcgctagagttggtgattacatgtgtatctcatgtggccagcatgacccacattcccaactcatagcatatccggatgcccgttcgcaatcatgtcggatgatcaagccgacgtcgttcgcgagggattacccgttaacgacatattctcccatagtccggacgtggtcggtgctatatgtgagataagtcgtcagtcttcgttggtaggttgggtgcgacaactctgcatttgtcgagaacgttctcgataatgggtgtactcgaccacaacctactcgagtgctcaattgttcctgaaaaatattttctagaagacaagatgtatagcagataatatcgagcatgtactcaaaaaactgcatgaatcctctagtattatcaggatataatgagcagattaaatatcaggctttatgtaaaccataaataagcatgatttatacagagtaaaatagagcgagccccagcattaaaccgtagttggcctaatatagggaatgctcactaataaatattgtataaaaaacatgctctaggtaaacataataaattattgatctgacaatattgtatatatatgaaaaataagtacggtaaattgtatataaaatattgcgtaccttcgtagatacatgctggatgtatctacgaaattagtagatcaattaaattaattaacctactaattaccttaattagccatgctaatcacatggtgtgagcgtgtagcttatcttggtgcatgtccatctatgctgccatgcatgtctaggatttggttccacacgtgtggacgtggccggcttgagttgacgtcgtgatttgccattaatgttgacttgaattaatcctcctcctgaagactggagtctaaacccgactaggatacctcaatgatttctagtcggttggcaaaccgacgtcccctgcgacggcgatgacttgaatcttggttgatctcgaattgttgatgacgatggttccgatctcgtcgggacacgtactcttgccgggttggatctccttggtccaaagtagttgaagtatctctcatcaaaaaatccatagtgacgcggccatgacgaagcttgagatgacgagggtcccgatccgccagataatgcacttcggttgggttggatcccccctatagccgaagtcgtcgagtagctcgttattggagaatccatcttttgaacccatctcgtcgaaatcttgaagcaccaaaattcccctacctggcacgccattgtcgacgtttgatatcgcgactacagtgtttggatggtatggggatcgttggtaccagggtatatgcgagattgaggtaaaagaga

SEQ ID NO: 54309 - DNA, 1501 bp, Oryza sativa
ggaaggaattgtacagatactggaattcaaagtcacaacgtaagcagtgagtcattggattggtgattacactcatacctcttctccttgacgaattccttgagttcgtccatgagctgcttttcatccaacaccatcatattcggattcgtgtacttttccttgtcaagatcaatgagaatgtctctaaagactttcttcatgtcaggattccgacccactggaacaaaagctccgcattcgaaatgcggttcaacctggtcatcgaatgctttattcatgtcaggattctggtcgactggaacagaagccctgcacttgaaatgcggtttgaagtggtcatagacagctttggcaagagtggtcttgccgagtcctccaaatccaacgacagagatgactttcatcttcttgtcggacacatcaacatcaccccccagggatagcttgtttatgagatcgtcccttggcccgtcaatgccaacaagctctgttgcccttttgtacagattctggagacgaggatcgatggtcgttgccgctagagacttgaggacaacgctgtcgactgtgtacttgacatgccttgctttcacctgctcgaacttcttgttaatgtcttggatcaggttagagatcttacggcgagccttgctcttcttgaacagcttgcctaacttcttccggaggcgcaggagcatgtgtggatcggtggggtcagggccatcgtcgtgcaccaagaatgtgtcgacgatgtcctccatttcgtaggatgcctccctgacatcgcgcgcccaaagcttgaccagctcatcgacctgctccgatggcacatcgccgatcttgcggaggacggcgtgcacgacatcgagctcccgtgagagacttgatcttctccctcacgcccgtttgcaggccgtactctttctcgagcagctgaagcagcttgggcagcaggctcctcatcgcccccgtcgccagctccatgcttgcaaactgggggtcgggaacaagcctgtcgtagacagcaaggaaggcccgcccgccccagatccgccgcctcctcttggcctgaagcaggagggacgcgcagctctgctgtccctgccgctcgccggccagatccagcccctggaaggggttggttgacttctgtgagaccggaatggaagtcactccggatggctaacgcaaagcagcaggggagtgagtgagtagtgactagtgactactgactactgagtactagtctgtcccaaaaaaagccaaactctggctatgaacctggacacatgtgtgtccaggttcgtagctaggattggactttttttgggacggagggggtactgactagtgaggacgacagcatctgcaagggtggaccacctcacttgactggctgactctgtgatgtttgtgactggagtctacttccttcgtcctagattataaatatttttaattctaacatgatttttgagatactattttaagtaacaat

SEQ ID NO: 54310 - DNA, 1501 bp, Oryza sativa; identical to SEQ ID NO: 36359

SEQ ID NO: 54311 - DNA, 1501 bp, Oryza sativa
ccgtgccgtgctggcccacgggctatggcgtcggcccagacacggcacgggtaaacgggccgtgccggcacggcccacaggccggcgtgccgtgccgggcctgggccttctacagtgcggtcgtgcttgggccggcccggcttggcacggcccatttggccaggtatagggctgctcgtccctcagcgttttgcgctggcgtggacgcggccggggcgcgacacgtcacggggcgctggaaaatgggtgggatttcgcgagctctcctgcctccgcgtcgtcttggaatttttgcacaaaagccctcgcttttatagttattttgttatacgtcctcgttgtagctttttcggctccataatcttacgtttagaccctccgagtcctgagaaatccgagacgaaggagacaaaaatgggaaaaaagaaccgtgctctgaattatggaaactgaggggccttttcgcattatctttcctcctccccgtctcccccgaaaccctagccgccaccgttcactcgcctgtctcctctctatcgctctccccttcccacgacgcttccgtggctcctcctcctcgcgccctcgctgcgtcgccgccgttgcccgccctcctcgcagcgccgccgccgccacccgctctcctcgctgcgtcgccgtcgcctgctcctctcacacccagctggatcgccgtgccttcttctcgccgtcgtggtgagcttgtgggggtcggatgatgagctcgccatggcggagaccaaccaccacctcttgtgtgctgcattgagttgaccagccgagctttctcggagaaagaaaaaaaaaaggagaagggagaggcatctggttcctccttaacgccgtgggactaaatccggtggagggcaggccgtggtcaccggatctggcagccacgacctcctcgccggcagatccggtcatccggaggcgagggctagcacattgaggttcattgcaagtgtcgacgtcggccgttccttcagagtggtgagttccaggggggaaggccctgctcccctgccctttctttcttcactctccctctctctctgatccaaatccaaagacgatgggatgttccatgttacagatccaggttggcttttggctgtcgaatcagttgatggtgagttcttggtcgcttgatttagcggcaccgggctcgtcgatgacagatcgggcggcgctgaggaggatgaagttcccgtccactcccgcgtcctctgctggaagccttcttcgccgggaggattcctggtaatgcttgccccgcctccgccggtgacttcttggttttgtctccgttcttgatctggatgttgtcgtgttcatttcttggcagcgcgggatgcggcggtgctgatcccggtgtacggatcctgggcgtgattcggtgagctgagaactggtttgctgctgctgcggcgtgcgccatggatggcgacgcggatgccgtggtgaatggccgcccgaaatgcac

SEQ ID NO: 54312 - DNA, 1501 bp, Oryza sativa
ctgccgcccaccgatgccgtcgccgtcgctgcaaccacttaagagtttgcatgcgaaaatagatttttgcatgcgcctcattaataggaccgcatgcgaaaatagtcattaaaaattaattttaaaatatgagaacttcgaatcgaattttatggtacgctgcggcagtgctcctggtgtacctggcccacctcgccgacatggtggaccacttgaagctgtcctgaagcggttgtcacgggcgcggaggttgcagacgaacataagagaggcgctgggaggctggaggagggatggaggaaggagatgaaactgacagatgggtcccaagttcaagggtatttggtccatatgaagaatgaaaatagggatgaaaatgaagcggatagttgtttccgtccgctccagataaaaacgaatatggatacctttcgaatatagatacagctatggatattttctcccagatatgaatacgaatatggtatcggggtttccgtcggatacagataataattcggatgtccgatgaccttcaatatacctttttagattttaatagtagttatgtcttgacactagtccacactattaatattatttaattatttaaaactatttataaattatcctatattttatataaaatgagctaattatatatgttgatatttgtttatattagaagttgaattggtttttgtgttctgaggaaaaaatgtttccgtattcgtgtgatcgtgtccgatcatattcgagataatccatattcggcaaaaaaaaaaaaacgaatatggtacgagcgttatctatccgtgtccactccgttttcatcccgaactaaaaacgtgatggctatggtatagatccaatttgacaaaattctaatggcatctagccgatattgtaaacagtagtggcatttttctaatatgacaaatttgcaatggcttaaggctgggcatggaaatcgatgttacctattagcgtgtgatgaattaagtattagcaaaaaaaaaagcttgaaaaatggattaatatgatttttaagcaacttttatgtgaaaaactatttttttcaaaaaatacacgtttagcagtttaggaagcatgtgcgtgaaaaacaagatagttgaagttggaaacgtgggggaaaatcaccgcctaaaagaagactacctaaggctgatttcgtttctttaagttcccaactcactcatctcattttccgcccgcacgtttttaaaacgactaaacggtgcgtgttttttttcaaacaaaacttttatatgaaagttgctttaaaaaataatattgattcattttaaaaaaaaactaatactttattaatcacatgctagtggactggttcgttttccgtgcaaggaagtggggctcccgaacacagcctaagggcaagtactatgatgcttgatgtgttctctctaaaaataccatatacgattagatgatgaggtgggagtaataattgaggaaagag

SEQ ID NO: 54313 - DNA, 688 bp, Oryza sativa
aagcgagtacgacaaatgttgataagggaaatcagacatcagaacagtcaagtcagatttcaagactttgtcgcagactttgcaccttctcgattatccgagaacgaccgttggagttcgacaaggaacatggaatgaagcaatggtgtgcctgccgagacgaaatttcttgacttcaatccaaactctcaattacagcaagacgacagacttagtcgcatgttccgtaccttctttgccgacatcggagattaaactagacaaacctaatatggtgtctaaaaggccaataaaaggaatctagcactatctctgatctcaccgataacggtcaagcgagcacgatgatagttgttccaaagtcttcgatcgagaacctcaactcgttcatttgcattgaagtcgggggctactgtcagggttatggataacacatacccaatagtaatcaactaaactcggcggggcctaccacataccatttcttatacggaaataaacctcatatatagaatgagttccggataagaaaggacaagaatagttctatatggaaacgacaaggactacttgtatcgtatccatatttatctccctagtcttacttggacaagggggcatctatgggtataaatagaaacccccctagaagcagaggggacacatccaccaaaaagccacaaagcca

SEQ ID NO: 54314 - DNA, 1501 bp, Oryza sativa
ggttataaatgaattggagtttgtagtagttggttgtagtattaaacttgctcttactcaagtaaggaagtaaaaatttacgtctttgcccctgctcagtgtaaaattgacccctgagcacggtgatgatccagaacaacgccttctctccctatcgagatatcgtccaacatctcacgaattgagataattaaggaacaagatgttctctgactctatcccatcgatcatcagtgatatcaagctaaccgtgtttagctagggcggagaacaatgcatgcaacgagctcgccggcaagcttccggccgacatcgatcgatcgatcgacgacctcaccgtttaatttgtcaatgcccggccggtaattgatctgaatagctgcaggcatacatgcgtcgatgaagcaggagctagctcctggagaattcaatttgctcaacttgagcagcatgcaaccggatgcatggcgaacttcgggactctctcggtgtcctcttatatatcgatccttacatagctagatcattatccttgggcgtactctcgtttaattttggatgacgtccacgttcattacatgcctgcctggtaagtgaaatactccctccatctacttttgatagtcatatttccaaatctgaaaattttatttttgataggcatatttcaatccaacaacctatcatcttaatgactttctcggatttaatgcgtgactcttcattgttccacacatgattggttacatgagcattgagaaatataaatattaatgaatcgcttgtttactagtagtatgtttaaatggatgataagtaaaattacttatccttggtctatgtgccatgatgaaatataactatcgattactagctagctagggtacgcaaattaattaattagagatcagtagggtgtgtgacattgtaggagaagatcaagatggcctaaataattagggagagtattatctgatcttttgggcttccaactagtagtatatactttatgtagcttttgaaataaagggacgagagatagcagtagttccggtccttttcctcagaaaagggacctctttgtgatctcggtaattgtgatgtagtatatgattccatgcatacatatggcttagggtgcataaagttaaagttggtctcagcagcagcagcagcacgctagctagctggcccttcttccttctccagttctctggtccttcggcctccaaccataaaaattaaattaaaccggataatatataccccacaatcctaaaatataataatctataattaaatggaacacattatagtcacataaatctgaataagactataatgttcagattcatatataaatatgttccgtttatttgtagattgttatattttggaatggatgcactaatattatagtatgcacgcacgaacttgtgcttcacacagcattgcctgtcctagctacacctcgagaaaacatgcatgcatgcatgtagcc

SEQ ID NO: 54315 - DNA, 717 bp, Oryza sativa
aggatccccaagatcaatcttcgcaggcgacgcttatatggcccgcctgcaaagatgcccctatatagtcttcttcctccccgagccctgttcattctccccgacatttttctctcctaaagtaacttaaatataggggaggaggttttgaacttcaaatcttcgtgggatttttgtatggtacttagatctactcatttccacactaggtatgcagttttttaagcttttagaccttaatttgtgatggatttatgcatccaaaattgtgaaggaagagctccatgttttttaattttatttcttttcatatgtttatgttagatgtatgtgtaatacttgatgcctcttgttgtagtggtttaatgtggtaacataaattctcattttttttattttttgctatcatatccaccacctagttctagatctagatatagatcttgtcatgtatagagagaggaaaaaattttaaatatctatttattcggtgcaatcaaaaaatagttatagtattttgtaataagccgatgatttgattttgtatatccgtacttggggatgcggtcgatcttgtaattctctggcacaagaatgacatattctttggattgggcaccgatgccgaggaaaaacctgtgttgcctaaaccggggttgggaaaacctccgaggcctcctaagaggaaggtgactgataaggcggatgatctagaga

SEQ ID NO: 54316 - DNA, 1501 bp, Oryza sativa
aggagaaattaaaagagtcacgttatcagattactccatggcaaactgaattggcgaatgatgccactcttcctgtacactcacctacggatcctcttggaaaagcattggtgacttcagtatggcactatactccttgagttcttgtcataactattgcagaaatgctctaacctatttactttttcagaacaaaagcaacctcgatattgtgacccagacaccgtaccctcatatacaatctccaatgtcttcccctgttcaagttagaggtgattggggtgtagcagggaacaaaaaccgtcaagtcattccaactgatgttcctccaagaaatgttgatcatggtgacatgggaagaaactctctttcaagcaggtagtatcttctttaagtgcttaatactgtaccttcctgactgactttattctatctaccagcgttgccgttgcgcatgatgaaataattccattcttaaggtagcagctatgattgccagttcttgacctatgtaaattggctagcagcttctagtagtcattactcattacttgaattgcttttactaatttctgatatgttacactctactttctttagtatgctacaatcatgaaaaattcagggatgtgggaatttgctacaagaacatttcatttctttttgagaaaatccaagaaatatcattgaaaagctctcaattccaataaatgccatcgacaagtgcgagttccatgaaatgccatcgtgcaagcgactttgtcctagaaatgccattgccattagggtttcgtccatcccacaccgttaaatgcgttgtttatcctatagcacttaacggaggactgctaatggaaccctaacggcgatggcatttctgggacaaagtcgcttgtacgatggcatttcatggaactcgcacttgtcaatgacatttcttggaattgagcgtttgtcaatggcatttcttgaattctctttgttttttgtcgctgccgcactattttcaaatagctaaactgtttttgaggaagatttaataatcatttttctagtcaataattttttttattatatagaggcatcacaagaacattaaacgtggtataatttatatttaatagcttaaaattcaggagggatgtttcttctcaagtatctcagcatgatccacattctgtcccattggactttgagcccgagaatcaaaacccaccattcaagcaccttagtagaagtgacgtatcggatgcttcggagggtgctgaagtccaacatgcacgagaacattctgctcattggggtcatggagactcagttaatttggtatccggcattgaggatacaaacccttcatatccgtatcttcctactgttcttgaggagcctggatcttctttctctgaaggtaattactattagaaataaatttatatatttgtttaacactaatgcaatctgatgatatattcctcttttatgaatatgtagctgctgagga

SEQ ID NO: 54317 - DNA, 426 bp, Oryza sativa
caccttatgaaaatactacaaatctaaaaaaaatagaagaattacactaaattcttggacagaactatcattcaagatttcgttaacccgtcctctcctctgtcatgagtcatcgctcattttttccattttttttctcctctccccctaaatatttcggcagaggtagcggtgaggaatggactcatcggacgaagattttaagggtaggagcaatggaatcggtctaaggccattcactccgcagtgcatgttacctcttttgcatgactttaattgaggcgagctactcttcaggctacacatctcacaaatgcatgtgaccaagcctagcaaaggtatcccagcccaaggattaaattcctccaactaccctttctgcttatctggacacatcgcctcaagccctcgtctcctagtctacca

SEQ ID NO: 54318 - DNA, 1501 bp, Oryza sativa
tgttcagagaaagaacttgcagtttcagatagcgggtggctgtcacaacttttcaaacagtaacaaaaagaagaaaggggtgaaatggaaatgaactttgcagttaggtagccatagctttaatattgccagtatttggcagtggagagttgagacacagcaggcacttctcctttggaacatctacccgttcttctgttgcatttgcacctgatccaaattaggggtgaaaaaagcttatggctaagattggctcaaactcgtaatcataatgaaccgtgtcgcgaccattttttagtaagttaatttaacgagccagctcatgatcgagctactcattagtacaaaagtcactatatattttcatatttagtgcttcttaagttgtgagtacttacactacacaatgacccacgttcaccgtccgtccattgtgtagacaaaagtcatgtttggcaactaagaaagtatcggcaaagcctgtgccaacagaattttcagcagtcggtgttgcagcccttttatatgtttgcctacacataatttgttccaaaatttagtcttttttccaactgacttttgttagcaaaagtggaccatggtgtagtgttagtcctttaatttactagcaaactaactatttgtatttagtgaatattttactagttattgcttatattatactaacatatgataaattggtaaatattgaaattttaaagttgatataaataagattgaacttactaacgagcttaacaagccaactcgtaagctaagccgagccacgcttttagctcgttagggttaattaataagccgagctggctagtcatgatactactaataacgagccgagccaggtcattatcccctcatctaaattaacaacacccaccaatgcatatgcttctcacaatgaaaagctagcacattgagcatggaaagatagcgtaagcttgaactgaatctcttcgatctcctacctttcaccgcgcgctaaattaacctgtgtacttcatttcactgtgctcaatcaacttcgacaattgtcaagagctagccgggcaagcttcaaattaatcttaattttttttagacaatgtaagagctctaaacttcatgaactgaatgagattgagtaaggcacgatcaatgtcctcgatcaagtcacataaacaacagaagatgcttacagtacagacaccacggcacggctagcttgatcgtcaccgaagaaaagatccacccaatgatttgtcacagcataagaatccttcaatctttccatcagcatcgtcgtaatagttagctttttcaaaccattccttttgactagggtatctacccgtattctctcttttttctacataaatgattaatgatgtatgcatatgtaagcactgcacgtgatttttcctgaaacaatcaagggatagaaaagaaaaacatgtgatacaaatctcctcattccattgcatttcatggcattctatcttca

SEQ ID NO: 54319 - DNA, 1139 bp, Oryza sativa
caccttatgaaaatactacaaatctaaaaaaaatagaagaattacactaaattcttggacagaactatcattcaagatttcgttaacccgtcctctcctctgtcatgagtcatcgctcattttttccattttttttctcctctccccctaaatatttcggcagaggtagcggtgaggaatggactcatcggacgaagattttaagggtaggagcaatggaatcggtctaaggccattcactccgcagtgcatgttacctcttttgcatgactttaattgaggcgagctactcttcaggctacacatctcacaaatgcatgtgaccaagcctagcaaaggtatcccagcccaaggattaaattcctccaactaccctttctgcttatctggacacatcgcctcaagccctcgtctcctagtctaccatgccgcttcatctcccagtcagcgcgctgcttcgcctcccaatccactgtgccgcatttgccgaccactatgccccgccacagtcagttgttggcgatgaaactctagagtggactggtgcagctcctacccaggtataccccgtccaggaagacaagggcgaggggagaaagaaaaagggcaaggcggcgagaggagttgctagaacctcacgctacagtgctccgtcgacctcggctccggcggagagctcaaactcgttgattgagatgtggaccaaacctagcgtccaagttgtgattgacatcgacggtgtaccggtctgatcatccctgactgctggttggactagtctaatgccgcctgttggactagccccgtatatatgaaaggcacgggtcttttccaattaaatctggtcatgttttcctatttttgtttagatgctaaaatttggatgttaacaagagtatttctatatataatataaagttttatatgtataaactttggttgaaaagagaaagggaagtggggtgttcgtcttgagcgaacttgtctccttcgttggactcctacccccgagcccgtggggcccgcggaagctgagacgtagtgctagagctgtacacgctatcttttctctaactaaccgcgcgtcaagttcgcatctttgatctttccaaattccccgatgattaaatcacccaacc

SEQ ID NO: 54320 - DNA, 1501 bp, Oryza sativa
cttaatcaccgtgtgcaaaacttcagaaacccttatattttgagacagagggagtacatgctattattagtcactagtatagtattatgtcattagtagttattcatgtgctctagggatttctagtaccaaattttattataggtattcacctaccatgagcatgcattgtatagttcattgaatgttctattttttctatggttgcccagtgttttgagcaatgcaaatgccctacggtttcaagattcactgctttggcttatcaggtttgttttgatggtaccttttgtttttgttggtggcttaaatgtcttgttctgtgctgctttatgtaaccagatgattactgaaattgttctgtacattctagctagcaagtggaatatgtcaaactttcacttaccttaacagggttctcaaggagttctctgcgcttctcatgtctagtgctagggatgcaccaccattttggttaacaaatgacgaggtaaatttatttctgttttgctgtgccatttacatttcagttaattagcctgaggctaaagagcttatacgaatctaccactatctcttgtggtccccctatcactactaagtattttctagacttgtgatgttcatagttatacccacatatgacacaaccaatcaccttttttccgcagatgtcaattttggaaggttattggcaagatacctggaattctcttattcacgcacttcctttgtttagcaccacagctctagtcgtgagtatcagaaattgacccttctcttatgatatttcaaaacttataattgttataagttcataacattcttgtttgaaaaaaggtgcctaatcagttttttgtgctgtgcttctgaaacaactgtttactactactaaaattgaattatcaattaaagagtgtatatgactctgatgttatcagtgtttgcgctctttaccatatctccatttattttttagtccttcagggactgaacactaaaaatggaatgataattgtcaatataacctgcatttagagtacccaagtggttgtgaaatatcactgtatgatttctagaacatctaaaaatttgattggtattttattgcacatttataggttgattcagttctgaggttgttgggtgaaatgatcatgcgggtgagcttctcattcccaattatcttaacagaagctctaacatattctgtgcataatttcaggccagttatagttatttcgagatatcattgatattttgtgctttccttcttcaaggaccaagttcatgcatcatttgtgtcagaagatacatgggacctacaaatatttaaacaattaccatcatcgtacgtatgccctctttctgtgagactgaccatttattagttgtaatcttgcctcattttttcagtacaacctccgttaaaaaatataagaatatttgaggctgaccatgggtattaagaaagtaggtggaattaactggggaaatgttg

SEQ ID NO: 54321 - DNA, 1501 bp, Oryza sativa
gaaatctacgccatgcatactctattgcttatatcaccttttgttttggattcattattatcacttgagagatgatgagaaagggaaaaaagagagtgaatttactcggccattgtttgcctgccgtggccccaatcctagcccatatatgtgaatcttcagcgtcattcacagctcggcccatttcatgttacatctccttttttttcctttcctttacttttcttttggtaatggatataccttcttcgaatgggacaattcggtgccgtgcacccttcacatttcttcgataacgaactaaaaaaatgtgcagccttaacataattatggtactagatctcacaccccgtttgctttaaaactccatcaagatttatattgaacattggtttgtccaaatatataaaaaaacgcacatatgtatagcctaattaccccgatatgtgcatatttcacaacagaaatagaatatgaaaaacaaataatgaatataaaccattacgtccctcaaccattttgagatggcatacggggtacacagctcatataacctttttagcattgacggttatataattggtgtccataacttatacgaatatctccaaatgacgaatcacgaagttactcataaaacgtcaaacaatgatattaatagctaccacctctagaattatcgtgcaaaattaagttatgctccctccgtttcagattataagacattttaactttggttaattttttgagaattacgcagtacaacgcagactcgcactattgaaaaccattaaatcctgaaaaattcgttctgatggggagtcgaatccaggacctaatgtgctactgaggccctttcgcaaagtactctaagtttgactaattttgtagaaaaaaatagtaatatttttaacacaagacaaatatattatgaaaatttattcaattatagatttaatgaaattatgctgatgttgtaaatattactactttttttctataaaattagtccaacttaaagcaatttgattttgatcaaagtcaataacccgaaacggagggtgtatgagatgatcaaatacacattttgttcttgaaaaggaaatagtagtgacagattctcaaaaggtccaaacgtttggacgtgaaattcacttggacattgacttgcacggtttgtatttgtgatccaagtgaaaaggctactaaaggagggggggtagcagcagcggggggccccagttggcagccacttatctcatcgtagcccttatcttcctcacgggctcacgcgcggcggggagagagaggacgtcaccgatcggccatgtccgcagccaccgcgtgcgcctcgccggcggcggcgcgcccgcccctccacatccccctccgttcgcctccttccgccgggcactttccctccgccgccgcctcccgccgggcttcctccgccgcttgccgatgcaccgattcggcccctgcctccgcctggccctccact

SEQ ID NO: 54322 - DNA, 1501 bp, Oryza sativa
tcttaaaaataattaataactaacacgtatataaaatgcaatatgaatattacacattagtagttttgtaaagttattgcaaaatttaaaattatgttgttattttaatatatttgaataatataatgagaaaacatatatgctattatatgagagaaaatataatgatgctagccgcgcaatctgcgcgggccatcatgctagttttttttaatttaggttaatatattttagaacgaatagagtactttctctgtaaaaatacatcaatttctgctttgaatttaaatatagcttatgtccagattgaaagctaggcgttggtttttgtaggatagatggtgtactccacttgtaaggaggttaacctgctgctataagtgaactgggatcaggcacagtttctataggaactgcatgttaagctataggagccatctactttgttgatgaacggaccagatcgtcagctacaagtagtggtgcaaagcgctttaaaaaaattgctacagtaagctacaatcctggacgtattttaaccattagaccaagatgcaggaagtattttattttttttacttgtgctgtgccgttacatatcaggcgaccgtgcgggcatctggttgatcacataaaacgctttcggtggcttattatttggctgcacaacttgtatctaagatgattcatatatacggtgtcaggtgtcgtttttattatttggaatacgcttgcgtatttacgagagagaagtgcaacagaatatacaacggcatttttttcaatgaacagaatacaacacaaaactaattatgcgaccttgggatctatactcagagttagatttaactaagggcacccgcaatggttatctataggctctctacaagagactcatgtcagcatattttcctacttggaagatattaaatgaagagagagcaaagctatctactaacttagagatagtctatagagaaaaacgagacaatgtatgagagagctatagatacctatatagacatactattgagatggtttactattaatctagtatattgttgagatatacatgttttatagagcaccttactttactatttcgtgtgctcgaatgaggaggaatcgaccgttctcacccacgtgcggtgatttgttcatgtctagtcggttgatccgttgatggatggatcgtgtagacgtgtagtcgtgtactgctccctgggaggctgggacatgatatactccctccgtttcgttttatttgacgccgttgactttttatcacatgtttgaccattcgtcttatttaaaaacttttgtgaaatatgtaaaattatacatatgcataaaagtatatttaacgatgaatcaaatgataggaaaaaaattaataattatttaaattttttgaataagacaagcggtcaaacatgtgctaaaaagtcaacggtgtcaaataaaacgaaacggagggagtatcaagttttgcaatacgaaa

SEQ ID NO: 54323 - DNA, 1501 bp, Oryza sativa
tgttttggaaaataaccacgcttaggatcttgttactactatttgatattcgagaatcaattttatacacctaggtggatgtccacctacgccaatctccatccaatgttctttaagatctgtgccacccatatcccacgcccatcaccgaatacgaatctgcctgtgcacatatctcgggggatgcatcgacggcacaacagttgggtggacatccacctatgcgatcggaataatctttctttgatattctatatatcacaatacaagaataaggctaagttatagtgtttgcaaaaaaaaaaaatatacgaaagttgtgtaaaaaaacatattaattcattttaatttttacctaatacttaactaattatgcattaataaaccacctttccaagcacagcctaagtggtggtggatctaccatcggcacgtcacaactacttttacacgttttataaatcagtccatgaaaatttttaaatatttatttaaatcaagtgaatatatatatatatatatatatatatatatatataaaagcatttgcaaaataaaacacggacattttttttacccatagccttctgttagtagatagaaaaaagaaagaaaaagaataaatgccgaactgcaagtgaccatcagtcctcaccacagttatccatggcaacacagagagaagaagagaaggggattgctttgatgaaattgtgtgtgagcgaagcgacacgtttcgtttcgttttcttggaggaaacaaaataaacaccctccgcgtgcagataaagtacatgtgaatatcgcacatgctcatcgctgcttctttcctccgacgactcgccgccgcctgaaatctctttcttgattcgtgcgctcctgagctaccccgatggccgcccaatcttccactccctcgccgcaaggtcaggtttttcttcccctctcttactgtctcatatcctccgaaaatcgtggcgctccccgtccaatcctttggatcaagatgacgcttttcttcagacttggaatcttggcgcttcttgctcgatgtttctatcccgccgattgttagccatataatttgggactgagtttatgagcaactcttctctttctgttgagagacgagggtttggtaattttgagggttagaacatgagaaccgccgaatcttgtaccgcgattgcctactggaataagcgtaagagtcctggctgctcatatcatcactaattctagcctcgttagcaagggcaactagcttttgaggcgattcagccaagacaagttcatgccctcttgtggttgtgggcacaagtccagtggctggctgcagtttttgctgcaaatatcgacaatttagaggtccatagcaccaaatgaatttggaaccaccggggagaaattggctattctgaaaccttgagttattatcttgttattttgttagttatagtcactcagattcccctgtcctgaaaatcgaactgcattcccat

SEQ ID NO: 54324 - DNA, 1501 bp, Oryza sativa
catattctttttggacaagaacatgtccaaaagtgaatcattgtacaattcctgaggccttttttttttgtgtgtgtgtgtgtgtgtttgtagcgtgcgtgtgtggaggggctcaactacaattaggaaagagaatagataaaaacactcacaaccaagtgctgtaaagagccactctatgcccaagtacatctatcaaaacctcaatggcacaaagccgatggcgaatatgcctaggatggctagcatctgcaatttgctgatgtattgccaacagaaactgcaatgggaagcaaattagatggaacttggtcaaatccaattatgatcataaaaacaatataatatgtagattagaacgaaatgatgaatgtcttgcaactccgttaaaataacaactggatgatagtaaaaagtcatagcaaaaccggtagcaacttgtactataaaatgtacaagaaaacaagtataattccccctaaacaataaaatatgttaacaactggtacgtttaacatattcaatctctattctcatcggccactgagattgaagatgggttgtttacgagataaacaatttttttagatctataccagttaacattaaccgtgacaaccaagaatacacttaaatagagaaacctaaaccttgggctctccattacagttcttgatgtcttagaaaatgataaactttatctataaaagaaaatgatataatagaaaaagacattccaattctgttttagttcagagattagacaagcatgcaacaagatgtagatcgggtaccttaaaaaccctgtctgaacggaatatattgattttatcaataacaactgtttcagccaaattaccatccctgaaatgtggaaaatcacaacaatgctactgaattggcatgtaagcattatgtatgtattgaaaatgaaaaaaagaagagtatacattgcatccataaatccgtcaacaactgttttcaccgagtgtgccacagcctccttggagaagtgtgggatttctggctgacgtgaagaagatgaaactgatagcaaaaagccaactatggaaacctagaaaacaggagaagagtgagaaaaaaaaaagtacaaaaatgtggatcggtttatagctctgtagattatcaagtagactaaactagtcagcggcggagctagggcccagcaacccggggcagctgcccgggctccggcgccgcatgcatcattagattagttctaaatctcggtgcttagccacagtatacagcagccagcatgaagcaacataagtacgttttaataatctgttaatagatgttacatacacaatcatctagagtagcctgaagcaccatgattgtttactagatcattttatctactacttgagtggaagctattagacatctgcagcctgaaggcaaagtaaattttctagcacccattatatttttttcaagataacaaattactaggccctgtttgttccagcttatg

SEQ ID NO: 54325 - DNA, 1501 bp, Oryza sativa
gagtacctctgccaagccgatacaaagtcctcaacttctctaaattttcaggacaggacaatgtgtcaacctacgagcatgtcagccgatttttagctcaatgtggtgaggcatcggctactgatgctctaagagtcaaattattccctttgtctttatctggatcggctttcacatgattttcttctttaccatacaacttcattcatagctgggccaatttggaaaaacagtttcataaattcttctacagtgggattcatgagatgaaactatctgatctgacggcaatcaagcaaaaacatgaagaatctgtccaatattatattcaaaggttcagagatgtcagaaatagatgctatagtttggccttaacagactctcagctagctgatttggctttccagggcttattatcaccaatcaaggaaagattttcgcctcaagactttaagagtttggctcacttggctcagaaaatagcaacgcatgaacagaggttccaagaggccaagaaagcatttaaaaaggttaattatatcagcccttatgtctcttaatctgaagaagaagaggatcctgaagtagcaacagccgaatgggtgagaagaaagaaggtggtttcatgtcaatgggttaagaattctggaaatgaagaaagatatgactttgatatcaccaaagctgacagaatttttgatttattgctccgggagttatagattaagctccctgctggtcatgtgattccatcggctgatgaattaggaaagagaaaatattgcaagtggcataatacaggatctcacagtaccaatgaatgcaaagtttttagacagcagattcaattggccattgagctaaggtaaaatcaaatttgatgattcaaagaagccgatgaaaattgatggtaacccttttactgtcaacatggttaacacaagtaggaagatagccgacagaaagaaaaatcggcttgattctattagaatgattaacaaatatcagagaagatatgatcagtaggaggagcaatatttcagggatgatgacagtgttgatccacactggagttgtgaatttttcaggttttgctggaatgaagggatgagactgccatcagtacgagattgcccaggttgcagaaattctggggatcatagccgatttcattctagagaagatcggtttttacagagaaagttgcatgttcaccaaaggttgggccctattcatcaagattatctctaggaagaagttgctgaggaggttgcaaatccacaatggtgtccttctggtattttttccaagagtcagaagagaagggttcaaagaatgaggaacatggagcaatttcaagaaaatcaacaagatataggtcgacggctgaaaagagcaaaaacaaaacaagtttggcgtgttaaaagcaaagtggtgtcagccgatgagattaaagccgatgaagcagagagattggctaaaggaaaggctattgcttctt

SEQ ID NO: 54326 - DNA, 1125 bp, Oryza sativa
gcaaaaagaagcgccctgagggacagaaaaaagccaaagccaagttaaaagggagaggtaaaaatgtcgcaccttctcctttgggagaccagccatgtcaagactttgttctttacaatgaagctataaaagtgaaagcagaagcgatgctgaaatctgcagaagcaacatcgaaatcagctgaagcaaagaaggaatacacaagaatggagaagtatcagacatacttaaaattgttggacaaagacacttcaaattttagtgatgcaaaactgaagaggcatgaagctgtcctcgaaaagctagctacagaacttgctgaagaataaatgatcaccaagtgatgttgtatccctgttacttagtgtgccactatgtggtctatgatcaatttgctgctaggatttagacttagcaattattagacttgtgaactcagtgttaagtttgtaggctaagtaaatgttggattgtaaacttagtgaatgatggttgtatctttgtacctgtagaagatgttatgtactgataatatgtagcccacagtcttaattgaacttatttgaagttgttggcccataatttcttagcacttgatttaacagcagcctacaaaatacatatgtagcagcaataattagcacaattatttataatcttgctgttgtgatagtttaaaatagttgtaaagcaagacattgatgtttataaaactgttgtttcaatatataaaaagcaagacatggatgtttataaaactattgtttaaatatataaaaagcaagacatggctactaagaatctagctgttggaatacatccaaacagcaaggcatgcctgctgtgaatctagctgttggaatacatccaaacaacaagtcatgacatagttgtatggaatatagctgttggaaactagctgttggaacaaaagcaacactgagatgttagcacatatccattcagttgtatcttctatgaaacagggtatgcagttcagcaagatatataccattgcctttaattcagttcattctcaacaaagccacctagttcccacaaagatgtctagtgattcacaagtccattctagtcattctgatgagtccatcactagtgagaatt

SEQ ID NO: 54327 - DNA, 1501 bp, Oryza sativa
gaaaagtttttgagagaacaagaaaatatggcttgaagatgaagcccacaaagtgttcttttggtgtatcggctggacaatttttaggttttcttgtgcatgagaggggtattgaaatgccacaaaggagtattaatgctattcagaagatcaaacctccagaagacaagaaacaattgcaatctttgatcggcaagatgaattttattagaaggtttatttctaatttgtctgggagattagagccatttacatccttgctcagacttaaagccgatcaggaatttgcattgggggcagagcagcaaaaggccttggatagtattaaagaatatctaagttcccctccagttttaatttctccacaaaaaaggggtgcctttcaggttgtatctatcggccgatgtgaagtcaatcggctcaattttgactcaagagtttgaaggtaaagagagggcaatcttttatttaagcagaaggcttttggatgcagagacaaggtattcttcagtggagaagttatgtttgtgcttatatttttcgtgtacaaagttaaggcattatttgttatcaaatgagtgcactgtggtttgcaaagccgatgtggtcagatatatgctatcggctccagtgttaaaagggagaattggcaagtggatttatgctttaaaagagtttgatcttagatatgagtcacccaaagctatcaagggacaggctatagccaattttattgtagagcatcgagatgattcaatcggctcagttgaaatagtgccttggacgttgttctttgatggttctgtttgcactcatggttgtggcatcggcttggttatcatgtcaccaaggggggcaagttttgagtttgcttatactataaaatcttatgttacaaataatcaagctgaatatgaagcagttcttaagggtttgtaacttttgaaggagattgaagccgatgctattgaaattatgggtgattctttattagtaattaatcaactagctggagaatatgagtgtaaaatgatttattgatgatttatcatgagaggtgcaaggaattgatgaatggatttcggttggtcacattgaaacatattcctcgagagcagaacatggaagctaatgatttggctcagggggcatcaggatataaaccgatgatgaaaggtgttgacatagagattgctgcaattacagccgatgattggagatatgatgtgttcaattatttgaagaatccttctcaatcggcttcaaggaaattaagatataaagctttgggatatgttttgttggatggtgaactatattataggacgattgatggagtattgctttaaatgtttaagtgccgatcaagctaaagttgtaatgggagaagtacatgaaggaatttgtgatactcatcaatcggctcataaaatgaagtggtttcttagaagagttggatatttttggccgacaatgctggaagattgctttagatattata

SEQ ID NO: 54328 - DNA, 1501 bp, Oryza sativa
cacaaatcgatggatgcaaaacattacccgtgtcactgtcgacttggataacaaccttcctgttgttcaccatagtcggctgcgtaggcgaggtcgggcagtcggaggggttgaagccacgtcggagtcggcggcgcagtcggcggggtcggagtcatcggcgtcgtcggcggggtcggaggggtcggcgtcgacggcgggatctgagggatcggagtcgtcggcgtcgtcggcggggtcggcggggtcggaggggtcggcgtcgacggcggggtctgaggggtcgacggcggggtcaggaccgtcggcgtggtcgtcggcgggggagtcgtcgtcggggtcgacggcggggtcggaggggtcgacggcggggtcggaggggtcggcgtcgacggcgggatcggaggtgtcggcggcggggtcggctggctcctcacatggtcggtcagatgggatgaaggttgtggatgggggaaaccctagagagtgtgccttttattgtctataaaatgggccaccttatgggcttcaataaacgggccactcaatgggcttttgtgacgtgataattagcaatgaaatagattgacacaaatttaaagccgcatcaacacacgtcatacatatttgaagcatcaacatccctgatacatattttcgataattttaaataaaagaaatgcaataacgactagggaacccataagccaagccttgaggtcttctgtttccttttttatcctggaaactctcttcttatgttttgcttcgattgccgagatctgtgaagccatctgaaattctaacttcattttgtcttcttcgactattgttctgtctacaaaatttgaccattggtactgcgccttggtagggttgcgtgtacttgcatggtccaatgcaagccagagcatctcaaatgccttttgtattcttggttgccattcttcgtcaacccaaaacaaagcgtcgcactggtcctcttcctccagtgggcaaccaagaaaccttcttccggtgtccttccattcccatgcagttcttctcttcgggcggaggccatgacgacatttcagctgggtaccggtttcatccccaaaatactcgccgtcgtcaatatacatgggaacttccaagcaaagtccagaacggtgaaactagcaaaaaatcaaatgaacagaacgagtcaactcgaagtaacggcgacgcttaaactaataatactaacgctacgaacgatttacacgatcggacataccttgtctttcatgttcgccaactggggatgcagctcaggcagaaagagaagagatggaatggtggagaacaggatgcatcagagaagaatggaagtagtatataaggacgcattgggactgttgctttcattgcttggcatttagtagtagttgcacattaaattaggcgtacacaaatacacatgcacggctgtcataaatcagtcatatacatgtacacaagtgcacacgactactccctc

SEQ ID NO: 54329 - DNA, 1501 bp, Oryza sativa
tgttgtgtaaaaaaacataaagatattgttgtagtggtatgtaatttatgggctacttcgcagtagtaatatttaggggcaagaaagcaaagccactataattgtaagagaaaaatcttaagatatttaacaaagatgcatctcttggtcgcgcaaatgcacgactttgtgtggctaatatgtaatggaaacctaaaaaatattgtaggatgtaaaaatagacgtataaattttgtacacgtcatatcaagtaaaacttttactcccaaattaaaccataagtaaaacttttagttaggatgacgtaaacaaatctcaaacatctatttttcatcctacaatagataaaaaaaatcaagaatgatgtcccatttagacaacaatttttgatctaagggttgtgtttaagaggaggagaaaagagaagatcgaaaaaatatgcaaaacgagttgaaccattaacgcatgattaattgagtattaattatttttaaattttaaaaatgaattaatacattttttaaagtaacttttctataaaacttcttttgaaaaagcacatcatttagcaatttagaaaacgtgcacatgaataacaagggggattttctcccaaatcactattgccgaacacaaccacggttttattcaaatagaagttactaaaggattttcaatttgaagttcttatggaaaaaacttctaaattattatatttttcaatccaaaatgcaattgatcttatgatgtattaattaattagttaattctaaattgtatttgatatgctctttccggtttattgagacctatatttagccgggctgcaaagaaaactaatatggaagagcaatgctcccgtcctgcgttttgtaccgcgtggtacttgtaccgcgtggtaccaaaacccatccagccgttgattttgtggcgggtaggattggaattggcgccggcgcaccgcaatcggtatctactccccaaatcagacgcgagacgcaaaccctagccgccttcagtatcgccccgacccaccgcccgcccaaatttcatcgctctgaatcgcgcctcactcacatcggcgcccgacggcggaagcaacatccggcccaattcacatcgccggaagcacttgccgcccctaatcacatcgccgccccaaatcacatcgccgccggaaggagccgccgcgccaaatcacatcgccgccggaaggagccgccgcgccaaatcacatctccgccgtagcagtcgccgttgtctgagtcgctggagcaatcttgttcatcgccagaaggtactgccgccgtttcagtattctgcaacggccgtgtgtttcctgttacaggtaaatcgatgtgtcgtaaattgtttgaagtgatactgtgtaatttgttttatatattgagattattgttatttttttggcagaatcatgatggttgatgagatggcagacaatttcagtagcttagaggaggaagaggagtatgctacgttc

SEQ ID NO: 54330 - DNA, 231 bp, Oryza sativa
ttaatttgttgtcagcattaataaaaaaaaatcaaaagctctgtaagctgtattttgagatcaatatttatcctatactatctcacactgttatgtggatattccttttacctctttggcacatgtgacggtgcaagtaatcagagtcgcgcaacgcgcatgtggctagtgagtgtgatgtacgtgtgttgtggtgtgtatgtgtatatttttttatataatcataactaa

SEQ ID NO: 54331 - DNA, 1501 bp, Oryza sativa
ctttcgtgcaaaaaaatgttttgtctattcactcgccaatttgtcatgcttggatttatatacaaaccgaatgaatccagggaagggaccctctgtggattagcggatatgcacaaatagatacagatcaaaaggacaaaatggaataaaaaacatactcctagctaactgaattcttttagacataatggccaaaggccaaaaattagaggacatgtctaatctgcaactatttgccactttgcttccaattgccattgcctcattagtatgcccaaagctgcatatacttccattagaatgcagcccaacagaaagcccaattagtacggagtgagggagagagaaggcccagctgcttcgactctaatgggccaaagctccagggtcctagactatggtgtgttacagagtgatagatagccaccggctatttactagttacggatggtgtgtatgatataaggatctaagcagtggcatgctaggtggtactgtggtccatgaactacctaaaaatttaatcgagattaaaactatattatatatgcaagttaatataataaaaattatatagtggaccatccatttaattgaccttacatatagatggatcacttttactctaaatcctaactacgccactggctctaagcctgatttgcaatccatttttcgaattcgttttaagttattgtttttagctgaatctttgtgaatgtaccataaatctactgaaaccagcctgcagttaaatccgttgaactttacctttcaaacttggttcttcaattgattttacgactatcaggtattcatgtacacttaggatcgatgaataagctagctaccttgatgttttattccttcttatgaatcttcttttttatgcgatggccatgaatcaagtgattaacaattcaataaacttggaactctgatactctacacacacgttcaaattactcccttctggacaggcatggacaaaacatgacgaaactctgctatgttgttcccaacgtgatatccccttgtttatcaccacactagtacactgcagcacacatattctttccagtggaacattaaccaaaccttgtacaagtacggagtacgaccgatcgaccggctccgttgtcctcttaatatatatccaaagcagcattccaattttttccaagcatatactcctactactcgcatcgcatgcactggtcttctctgcccttcaaccacgttaacgttttggtcctcgtgggcacacggaacacgtgacctaattagcacgctagctctacctactacctctacctgcctaatgcacgtgctaattagaaagaccaaaaaggggagtggtacgtacattgctttctgtccatcaggttttgcatgtcaaattaagttagccaacgcccttctcagcgccgctctttggtacttttgaccgactgactgacgacgaatgagtactaccttcatctaaaaatattttaccttc

SEQ ID NO: 54332 - DNA, 1501 bp, Oryza sativa
atttcgactcatcaattgtcatgatatcatatttataccacatatgatggatctttgagagtttttactcggatttttgtcatatgtgttgatttatggacctttggagtattttttactcgggcctctttatatctccatttttggtatattaaagctaaagcagtcgggtggatgttttattaaatgtcacatgtgctcggctgtgttattctttggaacatttggttgtaaaaccactcggttggatgttattcgaaccttgactatatgtttagtttttaactaatcacatagtcggggctacacctaattaggtgcatctagtcgatgcacccgatttttttctattttcagaccttcacagtatttgattttgatactcggagatcagggcagaagaagtcggagtactcagattttcgttttggattataagagaagactatttcgtcgactggaaaggtctcaggggctactgtggagattatggataccccatacctacacggcatgtatagtccgactgggtatggggtgtcatgtatagatagaatatctttaaaaggactcgggttcaattctaaacttgtatgtcaaggaaatacccgagatcgtagtcggttacgattgtattttatctgtaactacctatttcgttaggaatatgggctgtgctttgtaatacggaccccttcccctatataaggagaggtccgggtgcctttaggggcacgattttcacccagatcatacaatcaataatatactcggcggatcaatccctggacaggagtagggtattacttcttgattaagaaggcctgaacctgtataaaattccttgtctcttaacccatccacttttccagcttgatagccacccccttttagtattgccaaaatcttgtttcgacattcaccttgatgtaattgcagtatattcgtcatagtatttggttatatcactaatatattttttctaataatatgctcccatctggtctataatttttttgtgcactcatttttatttctggtctttttctttgtgaattatgagacccactgtacattcgattgctttttaagttgtgttatactcctctgtaaaaaaaaacagttctggggatgtatttggtcaatgtgtatgtacagatacatcccttggattggacctttttttcgaaggtgggagtataactttagttgattcgtccttcattttgtagatttattaatattttgttttgattatccatcttcgttgacaaggtaattaagatgaaactagccatacacttttcatctccaattgattcattcattacttggtactatgatgtctatatttctccctaaaacattttttctaatttgaaagcaatactagaattgggataagttatatcgatgacattattatctttcgactgttctgactaattatgcatcaacattactttatcatagtttatcacttggttcacttcacacatat

SEQ ID NO: 54333 - DNA, 1501 bp, Oryza sativa
tgcgtcggtgcgataccggttggtgtgcccatagaaaaaattgagatgatcaagcttgcaaaaaccctatgtttacccaagcaatagaaataactagtttatatgctctttcttggccataatgactagatgcattcagttttgttgcctatagttgtcatagtctggtaagttcggtttcatccacctctctggtgcattgtcacgaatgctttggtggttttgtttgaagtagtttaccacctcttaaaacttagcttctatgttgtagacaatctccttgtgtgcattacaatgccttcatcgagccaagcctttgatggtgatgatgccacgttgagacggctcaaagatggagtagtgtttggccttttggtttggtggctcaaggatacgatggattgcaaagaatgttaccattgttgttgttgtcatcgttgctgccaccgtttgtggcgttcccaatgttggcatgtggtgcagagacatcgtcgccgctactgcttgctatgaatgtgttggtgcgatgttgatgataatatgggaggtgtgatgagcctactggtgacgttgaaggtccaaggaagttgaagcatggagctaccgaaactatttcactagggatcgaaccactcataccatcggtgaataacaccctggcggccatgaaagcagctcagtcattgccatggtgatatacaagcaaaccggtcatcaaggtcacaaaaaaccgagccactaccgcatccttggtattggggacatgtacaggcgatggctaggtagccgatctggagactacattgactaccaacaccctctcggcatgaagcagcacatgcgtggttggcgtctgctccttcgacgatgtcttcactggagcacatgagtattcggagtcgacgtacgccgcgtctttgtagaccatgggacagagccacaacttcaaccacgactacaacgacatgttgtcccaagaaaaacttgttacaaaggtctagataagtagaatacaacacctatcctttgcgccaatgcgatgccggttgttaagcacatagaaaaacttgagctaaccaagcatgcacaaacctaacgtctccccaagcagtaggagctaccagctgtttgtctccttctcggtcgtaataaccagatgggttctactcttctggtcatagtcgtcacaatctggtatggccgggttcatccatctcgctggtgcatgtcatgcatgggcatgtggtttaggaggaaatagttggccacctctcgaaacttggccataatattgtagatgaacacttgttcatgtcgtgtgcctgtgctgaacctcaccttcgagtgtggtgatgccacaatgagaaagctcgatgagagagtgatgtatggctgcttttttggtagcccaaggataacgttgattcatgagggctctatcatttatagagccaacaccatttgtcattgtcgttgttgccaccattttcaccgttgccaa

SEQ ID NO: 54334 - DNA, 1501 bp, Oryza sativa
tgcctaatattactgttctcttgggtttagttgtaatcgctattagctgttttctgtaagacagatgtgtttgaggcaatttaactaaacttattagggcatatctactcggtagtcgtaagtccacataagctttgtatattttgtgagaatgctttaggttttgaatatttgacctgatgtagtggcgagatattcaatggcatatcatttaatgttaaagctgaccatgtttgtaagaacgaaagggagaaaatatgtcagattttcctattcttgttattaatgtaggtgtgtctaggacataaaaactgaaccgaagtaactagtgaagtgaagagttttaatttaatatttgcctatcatacaagtgctaaatgtattgaatataattatttgtaaggtagtaccttgcacatatcttcatctatcggacctgttcgatgcactgattgtcgttaggtaatgaactgaactctgaagctagcgatatccttccaagcattgccaagtgcaaatgacagaaaacagcgtactccctccattttaaattattctaacttttaaaatttgtgtcaagatacttatcattctcacgttagaaagcacttgcgtctttctcttaatttgtaccctttatcaatgcaactatagtagtactttgaaaggaatttttaatgcttgctttaaaaagatgattaaattataattaataagggtatcttaggagatttactataacaagaagtaaattgaaaaggagggagtatattaagcggtgatgatcacaagaaaaagaggcaaaattggttcttgaacatttgcattaattggcactcattcaccaaaacataccacaatataattctcatattgcctgaaagacgctactctctctatgccaaaaatgcaatattataatatgttttatcctatcctaatttgttatattttaaaacggagtaaatacattttaaccaatctcatttataccaatacaaatacaaagcgattagaatgcccttcactttagcgaaattcaaatgtattgattgcttcaaagataaagtctttatggttaaaataaaatgtgctaaaaatataataaatcactaaggacaggaaatagtctaccaccacacttattttcttatggaagtctgaaaatcagccctaactatttctttcaaactagatactattcacccattgactctcccctctcccctcccctagaccttttagctttttacttatatagaagtctgaaaatctaccctaatattttttttaacctagatactctttccgtacttgtaaaggaagccgttttggacagtgacatggtcttcaaaacacaactttaacttcttgtttctataaaaatatttattaaaaagtgatatgtgtatgattttataaaagtatttttcaagacaaatctattcatataatttttacgttttcaaactcaacaacttgagagttatttatgatttat

SEQ ID NO: 54335 - DNA, 1501 bp, Oryza sativa
ccatggcggcaggaacacgagctcgatgccaaggccgcgcgctgggcgtgcccttgagctcccacggggcgtcggcgttcccaacgctacaaatgacgaagcaaagtgaggtcacagggagaaatgcttagcatgcatatttgggtacaaatcaattgaaagaaggagcttttgaagaggaatcgagaaatggcagcggcttgctctccatggctaacggcaagcaagtgaagacgagaatgacagagcgctctctttgatcggatttggatcctctaccttcacggcttgaaggcacgagcgtgcagtcggcacctcatccaccgttcaaataatccaatggctcacgtcgcctgtgcacgtctgaatggatatctgtctgtcaaagcccacgaagtactactgctatatttcagtccgaataccaatgatgtttgcattataaatttcgtaatttttcttatcaatcctatgctctaatcataatttttcttttgctttttatgatgtgacttgacattgcgtcatactccctccattagttcccaaaataaaaacttttcatctagaaaaaaaactaattacacagtgtgcgtgtaaattgcgagatgaatcttttaagcctaattgcaccatgatttaacaatgtggtgttacagtaaacgtttactaatgatgaattaattaggcttaataaatttgtctcgcagtttcctagcgaaatctgtaatttgttttgttattagactacatttagtatttcaaatgtgtgtccgtatatccgatgtgacaaccaaacccaaaaattttctccaactaaacaaggcctaagtcgcttgacttttttttagtccaacttcttttttttaatttttaacacaaaacaaatatattataaaaatatattcaacgttagatttaataaagctaatttgatattttatatattactattttttatataaattagtcaaacttaacgatttttgactagaaaaaaagtcaaatgacttataatatgaaaaaagatggagaactactttgtaatgaattagtgttgttatttgaaactttcggttttcttgtatttttaatttggtgatatcatccatttttttcatgtgtattagcactaatatagtttgtaagtttcttcagctcgcgtacacttcccagaccaaaacaaccatcgtgggattttttttttttttttttgcgatagaaccatcgtggtctttcacagacaaattcattcgtctgtttaagcgcacatgtgacgtgagccgttggattacttcaatgatggataaggggctgactgcatgctcgtgccttcactctacaaaggcagacgatccaaatccctctttgaactggggcagtgagggatgatgggtgagcttgctaggggaggtagaaaagacgagctggagccttgaggcttgggacatgcgggcgtcgacaagtgacattggactaaatactattaacagtcaacaag

SEQ ID NO: 54336 - DNA, 1501 bp, Oryza sativa
ggcgccatcgagaggagaaggccaggggcaggcggagccacggaggcggcgaagcccgtcttcggagaagctctgtcgagctccagtgcagagtggcacccatcttgaggaggagcagcgagggcccctccttgcccccacgaacccaacaacggcatcggcaaggcgaacaagaagggagcttctccaatcaaggtcccctccagctacaccaccggcgtcaacaccaccttctacgtaagtactcgtcgtcttcgtattcatttcataagtcaatttgtattgccgtccatcactacccactcgtcacccaaggtggccagatcttccccgaccgctagatgtgagatgcctctgattgggccactgacggcgagcgcttcaagtccgactactgctaccatatgttcgtctcgtgctatagagacctcaagatcgctggctgtgaggttgacgcatcggcgagctgtcacctggtgccggcatcgctgtcgggcggcaccaggctgagtgcgcaatagaacgacaccatgagctagacacaacatatactaatggagctcgacatagcttctcagaagacgggcttcgccgcctccacccgctgttggcgttatcttctccatggcgcctcgtctcccgcaacaccgacagggccagtgccgagcatgcccgcttgtgcggactcatgctgtggatggtgggtggagcgggagagattggggactcatgaagaggatttttttttgtgagtatgacatatgggtaccatactgattcagccaccatgtcacctaaaaatggaagcaatactgtcttagaactcaaaatgatctgattttgtaaggcaaggaaggcgttatatctttcttttttttttcttttagggatgattttgtaactcggcagtaaactgaggaacctgaggtgaacttttttccttctcccttcgggcatgatactaggccgtgatgggctgggagcctgggacgtttttactgccaaagtggacctattgggccactatcctatgatagtgggatgaaaaattggactggatttaggccgtgttcttttctaacagagatgcatgctttctattaccaagcttttctaattgctgagcgatatgttccgtgcaaaaattttctatattgaagttactctaaaatattaaataaatttaatttttaagtttataataattaaaacttaattaatcatacactaataactttcttatcatgtatggccttatttaatctttatcttcattagtacgaataggtttttacaactttgtgacatgcctttactactatgttatgggttcctagcgcttgtacgtttttcatagaaaaaatagatataatattttaggggtgactataaaaacttatcaaaatttctaatgccaaatctcgataacagtaaatcaaacatcaactacacctgcgggtaggtcttaaatatcagcaatagctattatagacacggtact

SEQ ID NO: 54337 - DNA, 1501 bp, Oryza sativa
taaactagtcctttaagaaaaacttaaattttagctctttaataatatcattggaaatttaaaactagtctttattgctaaattcttttaatgtaaactattaaataatctcacaaataagtatcatctattttactttgaaaaatatgagaaatcacaaactaattttgtagatcatgtttcttgctaatattttttagacttgctaactaattaaattgataatactttcaagctacacaaaataaactagataaatacttatcttagctaacttaatatagagtaaaatacatgagggtgtagtggtggtagtgtttggataggggggtgttggcaccctttggcacccccttaccttcgccactgctcgtagtgatccatatgaaccgataaatctctccacgccacatcaagtcatcaacctttgggcatacacagtaattggaacaggtcaaggttcattaagacaatacccaaaccgtcctaaacaccccaaccgaattattccgttcaaaacaagggaaaataagtacatatgcccttgatgagctagctaagcacaaaatgtacggattacatgtcaacctcgatgaccatttcgatgaactaggacgacgtccttgcagagtttcaaaatataaacatgtttagatactgatacggtcttcgagatgttactttgacgaacaatatctataaaaataaaaatattttaaataaaaagagttatatattatgatagtttgtttaatgataaatctagtaacatcaattttatatgattgattttttaattttttttctaataatggtcaaagttaaaaacatttaacttgtcactaggcttaaaaatgtttatattttgggacggagagagtacttgtcactatgcttaaaaatgtttatattttgggatggaaagagtaataatagcactaacaatttaaataataatcacggttgaaacttgaaactaatgctaagtctgtgtttggctcccactttttctcctttgttttcgacgtgcatatttcccgaatggctaaacaatagtatttttttaaaaaaaattctatacaaaaattatttaaaaaacatagtgatccattctttaaaagaatttagctaatacttaattaattatatactaataattattccgttttacgtgcgcgagggattaaactgaacacaacatataattcatcttgaatctcgtcagctatttcctccgtccgaaaatgttactcccttcgtccacaatagttgttgttataggttgtttaataccacctccgttttttaatagatgacactgttaactttttctcacatgtttgaccattcgtcttattcaaaaaatttacgtaattataatttattttgttatgagttgttttatcactcatagtactttaagtgtgatttatatcttatacatttgtataaaatttttgaataagacgaatggtcaaacatgtgagaaaaaattaacggc

SEQ ID NO: 54338 - DNA, 1501 bp, Oryza sativa
cttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcttttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattactaggtataacatccataactattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtatctcggaaaggagctgtgacaataccccttgcacaacacaatccaccacagcgcacctttcctggatcataatcaccctcttataaacaaggcatggactccccagcgacctccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatcattaaataataatgagtcataagttatcccaatagtgtgctaatgtttctaagcatggctaagtaatcatatctaatatctagctgaaccaatatatatagcccaactagtcatgttataataacccaaggtatcaaggaataaagtaatcaatgcaaacatgccataacaaaggaatagattcacaccacccagtgacattcgaaaataaatgcacagttgaaataaataaagaatttaaatataggatcaacatgctcaaaggattgtgtttaggatctgtgtgacttgccttgcaataatcggttttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaatttagagacttgaacggcctcattccgatttcatatgaattagttacaaattttacaagattaaattccaatta

SEQ ID NO: 54339 - DNA, 1501 bp, Oryza sativa
taaatgttattttaattttattatttttatacggtttagctagggtaaaattcactgtgcttgaatatttcttttagaaaatcataaactgcaattaggagtccgtatttcatctcaagctagaatgatttttttaaagagatttcttatacgacttcttttgtattttcaaaggcaaacgagttttaaatccaactcaaacatggatatgcattttcaaaagcgaacgaacttaaaaactgactaaaacacggatgatgtaccgaaataccggcaaaaaaatctttaatttttataatagtagaaatataaaataacgtaaacatttatccattcatcctttaagagaaacaatactccgtacagactagcaacaccgtgaaacatccccatcctttaagagaaacaatactccgtacggactagcaacaccgtgaaacatcccatttaaatctagagttaattcgattcataccattgtaaatgtggctattaaaaaaaagccattataattcgtctattcgtaaacgtgtcacttaaattttacaaaattagaaccataccatcgccgtcacatttttcatcttcctccccatctatacgtgggcccaccggtcagattcattttcctccatcctcccctattctcttttttccttctttcttgctaggtagagcagagggaagagaggagcggggcgccagtgctccggtggctaggaggtggcgaggtcggtggccaaatgtgttctcgtgccgtcgcccccgtcggatgctgccgcagggttccgctgctgtcgccgctcccgctccgcgcgcgcggctgctgctgctactccgctgttgctggcactgctgctccgctgccgctactcctctatgctgctgtagttgctactgccgctactgcactgctgtgctgctgcagcagctgcgcggccaacgtgggccgcgcgctctggcgcggtgccggcaccggtggtggcggggagaggatggattggtggggaggaggtgaagaagtactggagagagatgggaaaaaagaggagggaagaatggaggaagaagatgaatatgactggtgggcctcatgttgatggtcgttatagataaattttgaccatcaatataactaaaataaaggggagctagctatacttgcaatgcatatttattttagaataattatttgtttgcagtgattaagcaaataaaatggaggagaactcatccttaagcaagcttaaggataagatggggccacatgtcaggtgtaactgtcctcgaaaccgtcataactgccacaaccatcatagggacccacttgtcagtgccctagagtagtttggaggcctgttgggccggcccaagtatggccgaaccctggtgacgctagcttcgactggccttacacatggacgctcctgatcgctccccaatgacggattgacggtttcagggcatattggacatttcgcataggctacaaccatcatac

SEQ ID NO: 54340 - DNA, 1501 bp, Oryza sativa
ggcaatattatctctatattggtcatcttgtctctatgcccactacgtcagctaccatcaatggacaattgtgactacgacagaaggacaagctatatgcttagggacttactagctcaaacacaagtatcataccttcaatttggacttgttccgaatacatgcaacatgaattcatgatcatgggtctattttctatgctcaaagactggactatttattattccccgtaagggttatcaaccgaatacttgcgccagtcgggattcaattattatatctatttgggagtatcccataagggataatcactcagatcagaagctattcgtatgagctacacttggtctatatcacccggaagatttattactcgggagcatgttacatgcgtcatcctttaaagggtgtcgaaggcatattttttggcctaggcctaatatgtctgcagcccatattttcaggtgtagcctatcacgttcttttaaggacttaggcattttttgcttaggccaaagtgcgtgtgatcaagtgcccaataccttaaaatccttttataccgcagttactcaactttttaggagttggtacaatgcattttaaaaggtgcccagcagtgaagtttttcatagctgtcctactgacttttttatatagtcaatgtgctatttgggtttataaagcaattgattggatacaataccactgctttttgccacgtaagtgtgcatttttattgaccaatattatggcttaggctgattatatatcttagtcatttttcaggcggttggtaaatcctttatgagtttatttactcggattttacaccacatatgccgtatatttccgggtgtggtgaaaccatgtgtcttttagggacttaagcacatttattaaagcagtgtgtgcatggcgtatgcctaatactttgaaaatttctttattcacatcattcaagcttgtttatagctgttttgctatgtgaattttcaatgatgtagtcaactttaggttgctcgcatcaatttttacaaagcagtcggtatatcacttggatcatgttatttgggggattcacaccgcatatgctatatattgatatcaagtcacttggttgattacaattatcaaaaccactcggttggttggattatttattccttgactatatgcttagtttgttcagctaaccacgtagtcgggggctacatctattaggtgcatctagtcaatgcatctgactttatttttcagccctccacagtcttcatatttgttaaagtactcgggtgaccatggcaaagatgattgaagcacttggctttggagtaatctggttcgagagaagattatcttttcgactgtgaaggtctcaggggctactgtggagattatgggtaccccatacccacacggcatggttgtccgacgggttataagggataatttatatctatggaatatgtaacgaatcatgacttaggtattacgtttcctt

SEQ ID NO: 54341 - DNA, 543 bp, Oryza sativa
cgaaccaaacgatttgggtgaatgattaaattgcgaaaagaatagtgcaaatcatattccatattgaaacttgaaaaatccaaaatagacgtatgagatttatgcacgttaggatgagtaaacttttatggtttacactatatatttcttataaaattatggctatgaaaaactagtgaagacccttgccacgaaacttttatacaatgaaagtgaaaaatattaggtccaaaatttataaaaccatacgagttttagcatgcaacacataattctgtgtattgtttcacaaaacaatttaacccaaatttgacatgtggagtttaccagttttttcatctatcatacttattgcagcatgtaagagttttcatctacgacatgtcaaatcatataaaactatcatcccacatgtcaggtttaagtagaagttgtcaatttatatgattttgtgaagagtagattttactttggatcacctttttattatcgatgtttcgctttgaattaccctttaaccaatattttcacttttgaaccagg

SEQ ID NO: 54342 - DNA, 1501 bp, Oryza sativa
tcttgaaagatatgtactccctccgtcccataatatattaatataagggattttggagggatgtgacacttcctagctagtattacaaatctgaacatattttttctctagattcgtagtacttaaaaaaatgtcacatcccttcaaaatttcttatattataggtcggagggagtagtaactaagatcgttgttgcgtgaatgccaagtatattcaggtttagcaagtactcctattgatgctgaattcatgagatgattggcttgaaagacacaaacgacagtaaatcagaaggaattttgttcctgcatagcatcaattttaggccggtgcacatttgagatggcctgaaaaatatatagcagaagtccatgtatgatgccaagatctgatgagctttcttcatggtactgagaaagcaaatctacctgagacagttggagattttttttttctgttgcctgtgactattacaagcatactctttttttttcgattgaaaggtgaatcttctttctttctttggccataacaatgctaatagtctgctgtaatacgccaacgaaaattcagcatcacgaggctgtaatagtctgctgctcagttctcactacggatttgaggtgtaggtcaaatatcttcaattcgatagataccaagatgtgaaataacacaatacaaaagtagtatttgccttttctttaggggaacaatgcatccgaaatgcatgaaaaatgctcaagtcgggtcataactcaaactagattgtagtatgatgatgttgctacctacaagttttttttttttactgaagatgtaagtaaactatctgacagcaaaatagatgcaaattgaaactaaaacaaattgtgcagagtataacacgcccttggtgaccttggataagcagcgtacagtagagagtaatgccgatatttggtttcgtgtcacgtcaggaaaatccatggtcggctgccgtttgcgcctctccttgtacgatttaggcccatctgttgttgtcgtgtcaacgcagattgagactgcttgaaatggatttatctcattcagattccgatgacttggtctggattttttttttctgtacagttagactgcaattgttagattggttgaagcatcctttcaagagcacaaaagaacaacagtatggccttcagggagaaacatttacatttacagtcgcaagatcctttagaacaccggaattttacaggagttctgtgtcctttgaaacacagaatttttacaagattttcattggaattagtttttttttcagaaatttggttaatgaagtagactgacgatggtaaccaaatttcagaaatttggttcataagcacatacgagtagggagtagggacataatggatgaatgtgcactcatggcaatcccaggattatcaggagctgcttatgttacaaatgcacattagtagtactagcatacatgtatgatcatactccagaaccaatctg

SEQ ID NO: 54343 - DNA, 1501 bp, Oryza sativa
ccatataacatcaattgcttttagcgcttaaatgattaatctatggtccaattatctccctccttttcttctctcgttaagttatatcacctcaattgttttaagcccttagataattaaaatatggtccaaactatctccctacttttattctctcgtaaaaccatatcatattacttttatatttgaattatcattttatataatatttaaatttaaattatcacaaaccacatcaacttacataatcttatatagtgtaactatcttacacattatttttacttattgatatcctactgaacttccacagcaacacacaaagtttcacctagtttaactaaagctaggtgacagtggtgacatgtggtcacattgttatggacccacatattagtgggtcaagggcacctaccgttacgatagaggagctgcttccggaaaattgaacacactcaaatagtgtcaggttaatttctttgtactagctatcatcgttaacactgaaacatatcaagacaaaattataaaaattaaagatgtttttgccggtattttgctacgtcatccgtgtatgagtcggtttttaagttcgtttgcttttgaaaatacatatccgtatttgagttggattttaaaattgttcacttttgttaatacagaaagaattatataagaaatttatttaaaaaaactcgcatgctaacttgagacgatcggagtcctaactgcagctcatgattttctaaaaaatatatatccaagcgaactcccacagtgaatttcatcttaactaaaccatataataacaagattaaaataaattttacccgttgcaacgcacatttttttctagtcatcaagacaaaagtaaaacaactactatagttattaatttagatccagacaaaaatgaaacaacgcccatagctattaattttattaacttgtactccttcagtactaaaatataaaaatctaaaatcggattggatattttttaatttcttatattttgtgagggaatataaatttatagagttacatatagaatactgaagtatatactagttgcgtaattgtgacgccccgattttcgttcgggattaaaaatcatttaataaggcattttctagaaattaaataaaagttaaagctagttaatcaagtgaaattattgagggaattaaaatttcctttaaaattcatggccgggaatattttgtaatattctttgtgccctaatgtactctccggaattttccgtgaattttcggagctcaagaagtaattttaatagcacaaagttcatttaaccaattagaataaaaagaaaagaaaaataattttccccttccttgctttcgggctcggcccaaattcctcccctccccatctcgggctctctctctccctcggcccagctcgccgctcggccctctcctccccgaagtctactttgcctccccagccggcctccctctcctctttggccgacagg

SEQ ID NO: 54344 - DNA, 1433 bp, Oryza sativa
cctgaggaaactgatgtgcaaaaacaagcgtcatcagagcatgaaccataaaatggccataattcgaagtaataggacagtaaaccgttcacaggtttgtggggggtacatactacataattcaaactttaaaaaacagattctatctccagaaagattatcattgcctatttcagtagctgtatttgtgaacaaaagtaaaggacagacaatctacaagacatggtaggcttcagcaggctagcatacaacataagcacataaattattgtatgaatttatgatctcgactggctataacatatattctaattcaaaaaatataatcattatcctcaaacctaaaagattgtatacataaaacaaataaaataaactggacacacactgtacatatgatttttaacaaaaacagattcatgcttataggaacataaatagaccaattcctaaagaaatatcaaccacagattggtcaataggtcaagactattaaccttcttggtaagtctttgcttggtcagaatggatatggatgaatggttacgttgaggatagcgacgtagtgcactgttcattttacaaatgtaattccaaatgcccttggcaaatgccagttttgccatctctatgttcatgccgttgtcttcatgatgcagcactgtaattcggcatgcatcccttccagggactgtaaagtaacataaagcatataagcaacatcaaatttaaaagtagttgaacatatatgagatacatccccagaaaataacaatttatagatgccttttgatcataattataacaaagaaaattgagagtcgagataagctagcaaaaatggcatgtcataatggctcaactttcagttgcatattcaaggtcataaagaaaattgatggcaaggagaagaaatgtgtgacaatggtatttattcttcaaaaataaacacttaaaagaatatttgttttattttcagttgatacacagcctgcttatagcttcagtagaactcttcccattctgtttggttaacaagtacaacagaactattagtgtattaactcatggatgcagaaacaaaaattacaagcctttcattcttatcagctaacaaattcatccaactgcatttcaatctaaatattaaagtataaaatatatactgtagatactagaggctggtaaagcattaccaaacaattagatcatttgaagttattctatgcgtattttttagaaattacatcgacgcaatacataccactgaaacaagataggtcattctaaactcaataaggaccgcaaaaagaaggccttctatgaatattagagttgacttacttttcctaatgcaccatcctgatctcaaaagttgcactcgaacaaatttccgctgtcttggtgcaacaggatgctcacattcctgtcca

SEQ ID NO: 54345 - DNA, 1501 bp, Oryza sativa
agtgttggtaagaatcgccgtcgccttctctacctcccggtgccctccgtttgcatttttttgtgccgttgttcgccggcaaccgccgctcccatgccgttcgccggtgtaggtttttccctagggtcttaatccaatataatctaatccgcggtttgtctagcgttgtcgtctccatgtgttgctatcggaacgttgtcatcatctctccctctccgatcattttggttcggtgagacttctatccgttttccctcggtttagtttttaatctcccgtttttgttgtcgagtagtcgtcgctctgccgtagccgtgtgccgttgtcgctgtgccgtcgccctaaccccagccgcgtgtctccgccgagtcgccgccgcctagccgagccaagtcgccctagtgccgccgtgtcgcagctgtgtgcctcttaaacctagccaccggtttagccgcggtcgttgttgagtcgttcgctcgttcgttcgaacgaggtgttccccgtgcttcgtccgttcgtctgtgttgagtcgtcctttagtttagagcctttcagagccgccggttccgttcgccggtttcggttgatcatttgggtgatcccgtgtcacgtagaattgactcgttgagtcggtatctcgtgaggttcgcttgcaagattaatcttagccgtccaaaattgatataaatccgttctttcttttcaatgacatattattcctttttaatatatgtcatctaccaaatatgatctaatctttttccggaggatgttttaatcttctgtctcagctataaatcatttgtaaattgtttaattaatttggaatagtcttttctttaataggtttaattggaatttaatcttgtaaaatttgtaactaattcatatgaaatcggaatgaggccgttcaagtctctaaattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaaaaccgattattgcaaggcaagtcacacagatcctaaacacaatcctttgagcatgttgatcctatatttaaattctttatttatttcaactgtgcatttattttcgaatgtcactgggtggtgtgaatctattcctttgttatggcatgtttgcattgattactttattccttgataccttgggttattataacatgactagttgggctatatatattggttcagctagatattagatatgattacttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttgagagtcgtgctcatg

SEQ ID NO: 54346 - DNA, 1501 bp, Oryza sativa
gcggcgacggcagccggaagccgcggggctcgcgacgacggcggggaggtcagtgcagcaggcggcggcgcagtacaagggttagcggcggacaagtctctgcgatgcggatggagaccaattcgttagggcaacgatacaccactcatcgatccggatattgtgaaaagacaacgctacccttccaccctacgatttcaggcggtaccgcgcaaaggagaaatttggtaccgcgcggtaccgtgcattcctgaccgttagatctgtttacatccaacggctgcgatttggtaccaccttggtaccacgcggtacctcgcgacggtgctggacggtaaaaaccgtaaatatggaattatgaatatgcctttttacgctatttcaataatatgatttagtagaacgatgttaaaagaaaactacttagtttgttttgagatcaacaaatttcaacatcatttcagaggggaagaagtcaagcttacacattctacgtataataagcgtacaaatcacattatagctgtacgtatataggaatagcttgaaccttgaaatctagccggccgcctgggttggaaatggatccaaagtgcccgattaggcatgcagtgcattaggactaatctaaagtgccccatttgcatcaagtaaagtactatattaactacagtaaaatcgcacaccgttgtatgcatttgatcactgtagcacagacatcgccgcgaggaaccctttcacagaaactgttcgaatttaaatgttacaatgatgtacttatgcgtcaggttattcaaatgactttgaactaatcacgtggtaaagcagtatctcatctccaagacagtggtcaacaatcccaacaaacgctctctctcagaaaacaaaaaagacccaaccaacggttgaacgcacaatgagaatgtgagggaattgtaatccaacaccgaagctcacacaggtcgctggcctcccaccaccaccaaacccaaccccggaactaagcctccatcctggccgtccatcggccatccagacgctcctatcgcgccacaccaaccccaccaccgctttgcccccgtgaccaggtcagagcggcggactagcccaacgagacgatacgacttgtcaatttgcccatgcggccgtgcccaccaaccagccagcacaacagagagcacgagcgcgcggcgcatccacgtctctcctccattccgccgaggccgagcagccgatggatcgcggcccgccaaccctgtttccttccgtggcacacgggtttccgcgcgaaaccggcgaaattcgccgcatctcttcgtgctgagccgtttcccacgtactgactcactactacttgctactgccacccacaccaaccaatccattgacgctatataagcacgccacggccaacggcacccgacccagcagccacagctcgctttgcaattccaccaactaaaatcaaaccaccaaaacacaacacagggacgtatcgcac

SEQ ID NO: 54347 - DNA, 1501 bp, Oryza sativa
gacacaactcatgcagattcaacaaggttgtcagtttctggacaacaagatatccacaaaactaatctcaatagagaatacttgcattcaaaatagaagagatattcaggtacagaaccaattttaacagttattgtactcataacaaattcaggtactaagttaatgatattgtacttgtactatttatgatttcgaacatgcataggcaataaagtacaggttgggtacaacttcaaggtcacgaactttccgtaaatttaaaccagcagccaaacaagaagagacagtaattgattccagggcagattgccgacaagacctagttgatgattcaaaggtaaggttgcaagcaaaatagtatattccaatgagcattacaaatgactaactaatcttgttgcatcttaacagaactacgatagtcaaccaaatggaacagctacttctccacacataatcgaaagcgatgacaatagccagcaaaatccaacactggtttttcaaataatagacctacatctacattacaaatgctacactgaccattatgctaattgcttgtacattgcagcagttatcaacaattggcggaaggcttagacgaccggagggaaggattatcaagccaacacacaagtcacaaactgatttcatctactacaaaaaaacatttccaaagccagttaaatctagtagggaaccgaaaccacatgatctaagcctgctggatgaagtaaccttgagttacatctctaagagtgaagacaaaaaattgctatcaacaattgcaggaatcaagatttttcgacagcatctgaaaccacttatcctaccaaaacaggctccatccaaagcaaagtggttgaacggcactgtaagcactgctatctcctgcttctaatttaaccaacaacagaataattaaacactcacaatatgcactgctattggacaggtcatagatgcatacatacaaatcatcatagacaagcaatccgacactccacgaggacagggaattgcactccttgaaactgcaacacaatgccagctgtggaaaattaatggtacagacaaaggtacatgcaacaagagatatcgtgatcaaagatctaaagttgctgccagctatttagagcatgaaatggtaatacatacatcgtatacattatatccataagtgaaaatgcatttcttactcatgattccgcatgtagattttcctacccttaaatagaaactcggcccactggtatgtagctgtcctggatggtgtcaatgaaaaaatccaaatactggactcactgcatatggataggacaagctatgatgcagaaaaaacccttaccactacggtataatgaaaacacatttcatacacttcccttctgaaagcactacaactaattatatttctttgcaatataacagatcaaaggaatagagaagtatcttcgttatgccaaacaagatgaacacaagacttataaatggaatt

SEQ ID NO: 54348 - DNA, 1501 bp, Oryza sativa
gaacaacagcatatataatagctgaagttatcctgattttctgcacaatatatataatcagttttgtgcacacaatttcttgaaaaatactatcataatattgtaaatttattggatcactaatttattctaatacagaattaatgcccagaattttaaagatttattcaaatcgtatgcagacattaatcatttaaaatagtatagatttgtctatccgtaacgactcaagattgccatctgcatgtaagcttggtcagtcgttacaaagaattagtcacagatgtgaccaatcatctgtaacggttggaggccctgttatagacgagtttcatctgtaacggctgcttgtcttgagccgttacagatgtcgatgcatttttctgaaaaaaaagaaagaaattcagatccaattaaccgaggcaatgcaagcatcaataaaatgatctacactcaactttgcttgaagagtcgaagtctctaacacaagataacctcatcacatataagaactagaaactcatcacaaaacatcaatacaacatgaacaagacgaacacaaacagcgatgaacacggacttacctgccaaatcaaaaattaaaaaacaacacaaacattcagcagctagcaagcctccatatatgcttgagctccgaatcagccgggccaccagctcctcgccgccacgacaccatgagccgctatacacccccaccatcgtttgagacaccatgcccgagtcgccatagtttggtcaggcagctaaggaaggtgccacgatctcaaggaaggagaggctaactggagtctgatctccgtgcaggcgatcgtcgtccatcgatcgatacattttgaggaacacataaaaatgcttgtattttagaacaaattaaggaagcaacattgatttactatttcttaacaaatcccggcccatttctcttatacagttatgaccacgatcgatcgtaatgatatttactaggggctgtggtgagatcgaagccacatgcatgcatgcagggctacttgttattcctttccaatatattcacacatgtgtccgatcactcgatcattcgttgactttaaccgtgctgtgcatcccattaattggattaatctctagccacacgtagtacaggggcggtaggcagcgcaatactatacgagagttcgatcgatcgatcccaacaacacccacatgtccgtccaaatctagcaaagccccctcccacaatgatggagaaacgcaccgatcgatcgatcgagctactagtagcaaccactaacgttatactcatcgatggctcatccggtgcacgagctatagctagccggccaggtcgcatcatatcatatcaccgcatccatttctcctcgcctataaattcgcagtacagcagcgttacgtttgtatcaaaccacagcgtacgccctcaacctcaagccagcacgcacgccctcatcaagtgtacgagctataggtagagctagca

SEQ ID NO: 54349 - DNA, 1501 bp, Oryza sativa
aggacggcatggcgcgctgacggggaagcgatggctcaccgccgaggacccaccgccaacgacgacgaggcgcagcggccacccggcgcacgacgcgacggcaagcggcggcaccgagcacacaagcacggcggcggcgcaatgtcgataaatttgggcacaaccggctacttctacacgatctaggtttcatagggatgtcaatttcacgataatataacctatgttgcattgggactacgtttgcccacaggaagctcattggtggcataagggcgaccgggccggcatggctacggcggcgcccgccccaaatcgagggggccgccggcttctaggtcactaggtgaggctcggggcacgagggttttaccgtgggggtggtgtaacggcaaagggcggcaacgcgcgacgtggtgcggggcggtgcagaggcggaacggcgtcggcgcccgattcttggcatctgggatgcgacgttgggagcaagattccggcggcggcgactgcgagggcggtgcagcagagtaaggccgggtcgagctcgaggctgacgaggaagaggaagaacgtcagcgtcgtcgagaactccggcgacggcggtggcaaagtacgccatcaggtgtggaggaggaggtccggtgccgagtaggccgcgcgcgctctgtgcgtcgccgctgtcaccgaacaagccgcgaccaggagaagagagaaagaaaagaaagataggaagagagatagagagctgacatgtgggcccaagggcatttttgacatttcacgcgatatctctcctcctcaaccggaaatcattattttaatcggcacggtgtccattggcaaattaccatgtttatggagtgttttcccccaaagtgagtttgggcagtgttccacaactaaaccacacaatagcagtgtcctatcactggcaacgaccaatctagtccattgcgttgtgtaacaaaaactctatttcttctactctatccgtcctaaaatatataagagttttggttgtatgaaacatatcatagtattatgtctgtttgtgaatctaaacagacagataggatgtgccacatccaaccaaaactccttatattttgggacggagagagtaatatactaatgcaattcttttacgcgttcgcgaataaaatgaatttgtaatgatcacaaacatgcttccgtcattttttctgtatcacaaattttacagtgaacaacttcagtcggaattttgtaagtcatgcatttcataataatcttaattgcctacgcttttataccaactctatttttgtaagttttgtgcgttctggtatatttgccgacttttcaaaagtttacattacacccacccccccaccccccgccaaaaaaaaaaatgttcaaacttcttttttagtcatggtgcaaatcgatgcaatattgcaaaagaaaaaaaaaaactgtttacagtcctatatacaggaaacgtcccaaattgaaacataaa

SEQ ID NO: 54350 - DNA, 1501 bp, Oryza sativa
tttaataagacgaacggttaaacatatgctaaaaagttaacggtgtcaaacattttgaaatagagggagtacatcgatcctcagaatctttcgagcgcacatacgtggatgcagatttaaccatggtcgatacgcgccactaggccagtcagtactcccccatttgtgcattgacgaatttaaattaagaccttcaaccataaaatgcctaatcccttgtttgctgggttttaaatcttactcctctgtcaaaacaaaccaattatagatatgtatctggacaatatttatgtccagatacatcctttaggattagaatttttagatggatggaatacactatactagtacgagccaagcataatgagatcttctatccccatggggctgtcctgtcaaactggctatgtgatgtgcctatccttctaatcggaggctgttgcctctttgatattaaaaaaaaaaaccggtcagaggttcgttgctcacaaccacacatgcgtgcaatttgggcagtagtgggctagtggcgtacgtaagctgccaatttgggcccggccttttcgcggtggctcctgccgccgtcctgcgtcttctgccagagtgctgtaccatctcgacatccttttttgagaaatgacaacaatctcgacatctcgtagtctcttaggcgtgggaactggcatgtgtacaacaaggagtacgttgtgattttggcctcgatcagttggctggtgattactgatggccgttatgcggtacggagttacaaagttacaacaccaaaattacgctgtcatattgtttgtaggggtagcaaacaaacaccttggctaaaatgttgtccaacaaacttcgctgtcacattgcccaagttcgatgaatcggtcacgtcctcctgcatatgaaattgatctacttaatctaggttgcgagataactactttccataacaatggataccagttgatacttttccccattccataatataagacttgtttcataatatagagcatgtatgtatgcatgccattaactaggaaatttttttcactaaaatattattatttaaatcttctaccttcgagatatctaattttaatgggtgcatgcattttatttattaggacaatccaaattataaggtgataataattatttcttgattttttggttaaggtggttgtgtcttatattttcgaatgaaaggagtatctaacatgtatcggctgatatacatataagttactactcccactgttcatattataagccgtttaacttttttagtcaaaattctttaggtttgatcaaatttataaaaaaatagtagcatcaacaacatcaaattagttttattaaatttaatattaaatatatattgattatatgtttattttgtatgaagatgttcctatattttttataaatttgattaaacttaaaaaagtttgacaaaaaaagtcaaatatataacttatgatgtgaaatggaggaa

SEQ ID NO: 54351 - DNA, 1501 bp, Oryza sativa
tgcagattggttctggagtatgatcatacatgtatgctagtactactaatgtgcatttgtaacataagcagctcctgataatcctgggattgccatgagtgcacattcatccattatgtccctactccctactcgtatgtgcttatgaaccaaatttctgaaatttggttaccatcgtcagtctacttcattaaccaaatttctgaaaaaaaaactaattccaatgaaaatcttgtaaaaattctgtgtttcaaaggacacagaactcctgtaaaattccggtgttctaaaggatcttgcgactgtaaatgtaaatgtttctccctgaaggccatactgttgttcttttgtgctcttgaaaggatgcttcaaccaatctaacaattgcagtctaactgtacagaaaaaaaaaatccagaccaagtcatcggaatctgaatgagataaatccatttcaagcagtctcaatctgcgttgacacgacaacaacagatgggcctaaatcgtacaaggagaggcgcaaacggcagccgaccatggattttcctgacgtgacacgaaaccaaatatcggcattactctctactgtacgctgcttatccaaggtcaccaagggcgtgttatactctgcacaatttgttttagtttcaatttgcatctattttgctgtcagatagtttacttacatcttcagtaaaaaaaaaaaacttgtaggtagcaacatcatcatactacaatctagtttgagttatgacccgacttgagcatttttcatgcatttcggatgcattgttcccctaaagaaaaggcaaatactacttttgtattgtgttatttcacatcttggtatctatcgaattgaagatatttgacctacacctcaaatccgtagtgagaactgagcagcagactattacagcctcgtgatgctgaattttcgttggcgtattacagcagactattagcattgttatggccaaagaaagaaagaagattcacctttcaatcgaaaaaaaaagagtatgcttgtaatagtcacaggcaacagaaaaaaaaaatctccaactgtctcaggtagatttgctttctcagtaccatgaagaaagctcatcagatcttggcatcatacatggacttctgctatatatttttcaggccatctcaaatgtgcaccggcctaaaattgatgctatgcaggaacaaaattccttctgatttactgtcgtttgtgtctttcaagccaatcatctcatgaattcagcatcaataggagtacttgctaaacctgaatatacttggcattcacgcaacaacgatcttagttactactccctccgacctataatataagaaattttgaagggatgtgacatttttttaagtactacgaatctagagaaaaaatatgttcagatttgtaatactagctaggaagtgtcacatccctccaaaatcccttatattaatatattatgggacggagggagtacatatctttcaa

SEQ ID NO: 54352 - DNA, 1501 bp, Oryza sativa
tccaaacagaaattacatgtcgatcttcagtctttatgttttctgtccacagagcagcctcacgcatgcaacgttgcagccaggaagcaatcgagggggcttgacctctaaaaacaacatcatatctgtgattccacattgcccagaaacataggaggtagaaaatctgaaaatgaagtataggcactccatgtactagcttcagctaatgaaacagatgcacatcttgaatcatcggttgcactccaattttgtcccggaaactttttgcaaacgggcatagaaaacaaaagtggctggtcgtttcggttccttcgttatagatgtcacaggtgccagtgggaacaatgttcttcttctgtaaatttttctttgtggacagactgtcttcgaccaggagccacgcaaacaacttcactttcagtggggctctgcatttccagatagcatcccatagtggagagacagctccgggaggtagcttaattagcatcatatatctgtttagttgttaaacttaacgttgagcctttctcatttcttcgtttgtctggttcgtctctcggggtgaaagattgtaagatctcatgtaatctctgtagctctatgtttgcagcttgctcgaattttaaaatgttcggctctaaaaactagcgagttcactctaacgaaccatgttctttcgacgctctcgatcgatcggaagcatgcatatgttacccatcacgtttgtagtactgtatgctggattcatttttaatttataataaaacatgctagttgcaatgtaattatattatgattgtattattttattaaaaaaatcagtgctatttactgtcgaatatttgctaggtagtcctttgtatattctctttgcaagcatttcacttaagcacgatatatatgtacaaaagaaaatgactgctagtaaatactacggtgctttaaccggataaatctgatatattgaggtaatgcggatggccggcttaccaccttgcaacccttgtggagatatgctaccatatgcaacatattctttgaccaaaaaaacagggagcatatgtatcataatgtgtttttgtctttgtattggaaattctgcgagcctcgtgcacttgctacaacatgagcttaccagttaacacttaacacacgtactgcatgtcaaccaaaaccatcatctattagatcgagaagtgatatactcctatttgattggattttcaacttagctagatagtcaacaactaatttggtacgtagtatgaaaaataaaaccaaacgaattcaagtagagatagagatatcagatatagactcgaatcaatttgagtctcatgtgtgaatttttttgtgttgaatctcgcgtgtaacccatctagctggttaggaagggctaaggcatcgttcgtttaggggtgataggggagattggctctcgtttttcgcgcgcacgcttttcaaactactaaacggtgcgttttttgcaaaaaat

SEQ ID NO: 54353 - DNA, 1338 bp, Oryza sativa
aaataacgtatataccctattcaatggagtgatgttcggtgacgtgaatcgatgaattatgatgcatttctgatatgtatttagctccatgataccttcttaggtttcgctcagtaatgttagaccaatcttaagactcatcactgtttttttgagtccatctcctcatttcttatcatgtcagatgcacggcattggcattttaatttgttgcaataattaggttgtagcccgtgcgtttactgtcatcatgacttcttttttttgcccgtgcgtttactgtcatcatgacttttttttttctttttgttgtttgcctgatggtagggcgcgcgaagcacgccttattatctactcccccgttccaaaataagtgtagttttgtactattcatcttcaacgttcgaccgttcgtccatctcaaaataattactatttttattactattagatgataaaacatgaattatactttatgtatgactaatttttaaaaatattttataaattttttaaataaaacgaacggtcaaacgttggacacggattttcacggctgcacttattttgggacggaggtagtagtatgaatgcattcagacccaaaacacacacacacacgtatgaatagctttgtatcgtgcaaaatttcacatctccctgctttcggtctatttttcatataagcacagctagtgtgagtatttgataggttagattgcaaaagttcgtgctgtggtgcatccctagcagaatcaaggccttcctcaatgggtaacttcgactctatatggcatacctttgtacccttggcaaacacacccatcacaactcttcgaaaaaaatggtaattccaaaactttccactctcaaaactcaacaaaagctataaaggtcttaaaccgaacactacccaaacatcttctacggaaccaaagtttgctaagttttctctttttttaaaaaaaaaaccaaacaaacccataattcaaagcgattttgaatttttaaagtttgatttttaagaataatattagctagtctttgaattgttctcctagtgatcatgaaaaagagccagacaccaagacaaaaggagaaagacaatggaactaattctaaaacaaaagcttaaaaagaaaatcaaaactacctctaggagagtccctgttggcatcatactaaaatcaaagcctaaaataaaataaaaaatacctgaagattttagcctttcgatacagcttccatgtgtcaccagccgtctgattctaattgcttctaaactataccataaaggagaaagcaaaagagattgtcccggaataaacatcatactac

SEQ ID NO: 54354 - DNA, 1501 bp, Oryza sativa
atgcaccgccaacgacgccccggtggcgatggccaccctcatcgcggaggccgccatgctgctcgaactagacccgctcactggctgtgcgatacgtccctgtgttgtgttttggtggtttgattttagttggtggaattgcaaagcgagctgtggctgctgggtcgggtgccgttggccgtggcgtgcttatatagcgtcaatggattggttggtgtgggtggcagtagcaagtagtagtgagtcagtacgtgggaaacggctcagcacgaagagatgcggcgaatttcgccggtttcgcgcggaaacccgtgtgccacggaaggaaacagggttggcgggccgcgatccatcggctgctcggcctcggcggaatggaggagagacgtggatgcgccgcgcgctcgtgctctctgttgtgctggctggttggtgggcacggccgcatgggcaaattgacaagtcgtatcgtctcgttgggctagtccgccgctctgacctggtcacgggggcaaagcggtggtggggttggtgtggcgcgataggagcgtctggatggccgatggacggccaggatggaggcttagttccggggttgggtttggtggtggtgggaggccagcgacctgtgtgagcttcggtgttggattacaattccctcacattctcattgtgcgttcaaccgttggttgggtcttttttgttttctgagagagagcgtttgttgggattgttgaccactgtcttggagatgagatactgctttaccacgtgattagttcaaagtcatttgaataacctgacgcataagtacatcattgtaacatttaaattcgaacagtttctgtgaaagggttcctcgcggcgatgtctgtgctacagtgatcaaatgcatacaacggtgtgcgattttactgtagttaatatagtactttacttgatgcaaatggggcactttagattagtcctaatgcactgcatgcctaatcgggcactttggatccatttccaacccaggcggccggctagatttcaaggttcaagctattcctatatacgtacagctataatgtgatttgtacgcttattatacgtagaatgtgtaagcttgacttcttcccctctgaaatgatgttgaaatttgttgatctcaaaacaaactaagtagttttcttttaacatcgttctactaaatcatattattgaaatagcgtaaaaaggcatattcataattccatatttacggtttttaccgtccagcaccgtcgcgaggtaccgcgtggtaccaaggtggtaccaaatcgcagccgttggatgtaaacagatctaacggtcaggaatgcacggtaccgcgcggtaccaaatttctcctttgcgcggtaccgcctgaaatcgtagggtggaagggtagcgttgtcttttcacaatatccggatcgatgagtggtgtatcgttgccctaacgaattggtctccatccgcatcgcagagacttgtccgcc

SEQ ID NO: 54355 - DNA, 1501 bp, Oryza sativa
ccttatttccccttaagaacagcaaagagagagtagcaaaagccaaattcaagcttgtgcttacatatatatagcctatgacaaaccgcatttttgtttggttggttctgaagtgagaattcttcgatcagatccaaacacatttgttacagataggatggaaacatggattacccactgatattcaaatttatgtacaaaaaagaaatgttctacaaactcacacattgcatctctatctgctcttctacctcctaatttaacagcaagtgttcgacaaggacacgttcagctccgacgaccggatgggcgatgtggaggtggacatccagccgctgatcgccgcggcgcgagaacacgagagctcggccgccatcgccggctcggtggaggtcacgaagctgctggcgagcgacgacggcacgctggccagggacagcgtcatctccgtcgtcgacggcaaggtgaagcaggacatcgcgctgaggctccagaacgtggagcacggggagctggagatcgagctcgagtgcgtgccgctcagccagtagtatagctatagctgctgtacacattttattgctactatagctggccgggatgaaaaatgctcgatctgcattcgctgtgggttgtgtgatcatatgcatggagcttaatttgcttctgtgttttactccatgcctgtatactttgtcaagttgtgtcatgttgagggcttaatgttcatgtcatcgtgtattaattagatatggtttgtataggtaggaaattaagggggaaatggatcgtctaaaacaactctaattttaggcttcaatgttggttttggctgattctttgttatccttatactattactgctagtgtgtgtagctaattttggtagttctcaagcatttccagggtgttaaggggtaaactgccagacatacagtgttcacaaactattactccctccgtttcacaatgtaagtcattctagcatttctcacattcatattaatgttaatgaatctagacatatatatccaactagattcattaacatccatatgaatatgggtaatgctagaatgacttacattgtgaaacggaggaagtaccttataagactaccacgcaagaaaaaagttcaatagaaatttagtgaggctagagaattactcctagcctatgcctctttaagcatgtgaaaagggaggacttgggggtgtgtgatgtgagtgttgtgtgtttcttgcttgtaataaaaaaaatcaaaaggataaaaactggcattcaattgagaaaaagaaattgaaggaataatcaaatttgtaaacagatgaaaatcaaatggaacagacatctactccccaaatcaaaaaggtaattaagtaagccaagaagcaaagcatcagaatgaccaaattaactaggaataagtctactttgactctcttaactagtgaccgaatctgattcctattcttgaacagcaataccagatatcttgacc

SEQ ID NO: 54356 - DNA, 419 bp, Oryza sativa
gcggaccagccgcagcgctcacccgctgctcgcccattgccgctggcctcactcactgaagaagagagagaagagataaaagagaagagaaggagaagaaaagaaaagaaaaagattatgtaactgatatgtgggccctaagtacttttttaattttttttttctgactagtatgccaccactactgcacaagttatctttacctccggttcgtaactgcctgttctcccggttatacaaccgggagtccaaatccgggactaaagatatatctttagtcccggataaaataaccgggataaaagttgatctttagtcccggttgataacaccaatcgagactaaaggggaggaaagcggcagcctggttgccatttttttattgtttctttgctagatgcgtttttcattctattttc

SEQ ID NO: 54357 - DNA, 1501 bp, Oryza sativa
ctttagctctaaaagtagttgtcgtgtgctgaaataataaaacgaggaaaaattagacatgatatacttcttcagcacgtagatcgcatagcagatcttagcagagaatacttgccattgcatcgtactcgggggataggtcttttccattccagtgttcaatgcacttgagcgtaaacaatccacatgaccatctgaaattttcaattatgtttatagtgttacatttagacatcatagtaatttttatttacagatagtagaaatggttacccgtccttctgttgaggcacttgcatcgggcatattggccatttcgtgatgttcgtagaattccatttataagtcttgtgttcatcttgtttggcataacgaagatacttctctattcctttgatctgttatattgcaaagaaatataattagttgtagtgctttcagaagggaagtgtatgaaatgtgttttcattataccgtagtggtaagggttttttctgcatcatagcttgtcctatccatatgcagtgagtccagtatttggattttttcattgacaccatccaggacagctacataccagtgggccgagtttctatttaagggtaggaaaatctacatgcggaatcatgagtaagaaatgcattttcacttatggatataatgtatacgatgtatgtattaccatttcatgctctaaatagctggcagcaactttagatctttgatcacgatatctcttgttgcatgtacctttgtctgtaccattaattttccacagctggcattgtgttgcagtttcaaggagtgcaattccctgtcctcgtggagtgtcggattgcttgtctatgatgatttgtatgtatgcatctatgacctgtccaatagcagtgcatattgtgagtgtttaattattctgttgttggttaaattagaagcaggagatagcagtgcttacagtgccgttcaaccactttgctttggatggagcctgttttggtaggataagtggtttcagatgctgtcgaaaaatcttgattcctgcaattgttgatagcaattttttgtcttcactcttagagatgtaactcaaggttacttcatccagcaggcttagatcatgtggtttcggttccctactagatttaactggctttggaaatgtttttttgtagtagatgaaatcagtttgtgacttgtgtgttggcttgataatccttccctccggtcgtctaagccttccgccaattgttgataactgctgcaatgtacaagcaattagcataatggtcagtgtagcatttgtaatgtagatgtaggtctattatttgaaaaaccagtgttggattttgctggctattgtcatcgctttcgattatgtgtggagaagtagctgttccatttggttgactatcgtagttctgttaagatgcaacaagattagttagtcatttgtaatgctcattggaatatactattttgcttgcaaccttacctttgaatc

SEQ ID NO: 54358 - DNA, 1501 bp, Oryza sativa
ctttcgctaacatatatgcatttcttaatccggtctccttatgatctcctaattattttttaagagatacatattgtcatagaaatgtgaacgtagcggttagcaaattgtcatagaaatgtgaagaatgatatatattaatctatcatatcattttttttagaaaaaaagttatatttatttggatgacatataagagacgaatggacatgtctcaatggaaaaaaaatatttttcccagaaatatgaggagtagaatactcctcatatttttataggtaagcacatgcatcagtttaattccaaatataagcacaccaaacccatatttcaatctgtaggcaagatgctcaaggtaggcgttgttccatcgaatataatatccaacaaaataataggccgttgaatttagttttgtaataatgtttgacatatttattaagtataatttgaatatagcatgatgctaatatacctaaacaattgctactagtttacaattaagtgagtttacatcaccgggtttaaatgatctatttattttgttaggtattagatatatcgagggattgacgtggtccagtacacgtacatgtttaggaatggaattacgaatatgatgtgctcatatacgtaatcaaagggttggatgcgttgcgactaaaacaaaatcgggaatactccatccaggagtatatatatttcagtacgtaccaggatctcggcgaccaccctaggctggcgcaggggcttaagcgcgagcgcgaggccctgcgtgatcaccaggatgacggccacctgcagcgccagcagcggcagcgcgaagtccagcgggttctccccctgccacatcccgtccgacgccatcttcacggtgaccgccgccgccgccatgctagctctacctatagctcgtacacttgatgagggcgtgcgtgctggcttgaggttgagggcgtacgctgtggtttgatacaaacgtaacgctgctgtactgcgaatttataggcgaggagaaatggatgcggtgatatgatatgatgcgacctggccggctagctatagctcgtgcaccggatgagccatcgatgagtataacgttagtggttgctactagtagctcgatcgatcgatcggtgcgtttctccatcattgtgggagggggctttgctagatttggacggacatgtgggtgttgttgggatcgatcgatcgaactctcgtatagtattgcgctgcctaccgcccctgtactacgtgtggctagagattaatccaattaatgggatgcacagcacggttaaagtcaacgaatgatcgagtgatcggacacatgtgtgaatatattggaaaggaataacaagtagccctgcatgcatgcatgtggcttcgatctcaccacagcccctagtaaatatcattacgatcgatcgtggtcataactgtataagagaaatgggccgggatttgttaagaaatagtaaatcaatgttgcttcctt

SEQ ID NO: 54359 - DNA, 1501 bp, Oryza sativa
ccattcccgtcgctccttctcaccatcccttctccgcttccacctctgcctccccctagccaccgaattttttttatctaaacacatgcaaaccactaattacaaatgtgagcacacaacaattacatttaattatttaggcaagatgctcatatacagcgatatgtttccctctaatcagtagcccaacaaactggccgttgaactaatcatgttagcctaacaacccacctctaaaattggttagttgcatcattacggggagttttctccattgttcaaatctaattcatccggtagtatgaaaatcatagggtttaattagggtattatactactaaattttcaatactagcgattcatattagtggatcaattgtttgctccatgctagcaagtttgattagtcgatcacaatgtgctcagaatagaagaattttagttgcactatggccacgctaacactgtcactgtcaaaggttatattagatggtttatacatacacacaccatcatcgtgtcgaggctaccgtcatggcactgagccaaagctaacaggataagaaatgaggagcccatatcatggacagtacagcactaggtcaactggatttacggtggtgacgtgggcaggttgtttagacctagaattccaacttttacgtgctcacatttgtaattagtgtaagatcaacgtgtgttttgattcttattatgtgatgaacaattggcatatgtgattattggttttgatatttggagattatcgtcgaagtggttttggacaggtgatgaacaaggtttgttgttttgtcgggaccggtcagactgggcggaggttgccggtcagaccggcgctatgtgtgcggtcagaccggcccggcccgcggtctgaccggccgacgctgtgtcggtttcggtttcgggttgtttctttggatatccgtgcttgtttcatggttatggcttctagatggatactatacgtatgtaataccgttgtttgctaacaatgagtcaagttggggatagcttggtctcggaatatggtttctttatttgcttcatgtgtaggtgactcaatgcctcgggagagtatttgcggtgatggactgggagtcggtttggtggtaagacgatgtccgtggtggtcagatatcatgcgggatactaaggctagagttgatgcacgtggttgatggagattccatatggcatacgatggaggtattgtgtgtatatgggatgcggagtcaaatttggaaggagtccaaatttggtacgattggttatgttaagtttgtgtcttgtactagagggttttctaaggtgtttagaactcttagtatgagtttggttcgtggctttaggctgcctacctcatgtataaatagagggggagcgtgaggcttaccggtatcgcttttgtatcgctttggagagcgattgagttgctagtttagctagggttttgagtttagtcgagatttttgtaaggagt

SEQ ID NO: 54360 - DNA, 1501 bp, Oryza sativa
acacgagaaaagaaaagcaaaaaaagggagaaaaatatggttttcgttgtaaataaaaaagcaaaaaaaatgctaaaaaaacttttagaaagaaatgcgccatttctgaatggtttgagaaaatcgtgcaagaaaaaaagaccgtttataaaaaaaaacaagccgctcattaaaatacaaacattgtcattgacatgattattcatgaaaaacgtttattatcattagaattttttcacccgttgcaacgcacaggcatttttgctagttaagaaaagatataaccaaaaatcaaattgtgtcatctttttttttaaaaaaaaaggatggagtacaagctagtaggaaatgctctgattaagctgaacagagtgtgagatatgtcgataccgaaactactgatcaaacaaaacaaaagagtttgctccgttcggtagtggaagaaagaaagaaagtaagtttgtttcgttttccgcgggtacgtttcccgaactattaaatggtgtgtgttttgtaaaaaaaaattccgcgggtacgtttcccgaactattaaatggtgtgtgttttgtaaaaaaaaaactataggaaagttgctttaaaaaatcatatgaatccatttttaaaatttacaatagttaatactaaattaatcatacactaatgacctacctcatttgacgtatcttctcaatcttccaatcttctcttctcgcaaacagagctgccctggtgagtagtatttccctggcctgcagccatccggagcagcaagtagcagtgtttggttgcttccctgaagaaggttgtccatgctcaggcatggttgccggagtcacgccaccaaaaatgaacgcctgatccaggcgtgggcgtgtgcctgatcatcccccattgattcttaacggatgtgactactactacacttgtaaacatctcactcaaacaagcatgtttttttttatggccgtgtttagtttcccccctatttccaactttccatcacatcatatcacatcaaaaaaacttttatacacatataaatttttagttttttttccaaactcccaactttattcaaactttcaacttttttttaggactaaacacaacctatgttcaatatattcagccaggctcatgtcttcaaccaaacaacagaacatcatatatgcctgctaggcatgattcaacacgagcttttctaccacagtacaggcatagatttttctcaggcaagtcatccagatcaccaaccaaacatgcccttgctaattgtgagtgcgagcgttgcagacttgcagttcgatatatttatttatgtttcaatttgggacgtttcctgtatataggactgtaaacagtttttttttttcttttgcaatattgcatcgatttgcaccatgactaaaaaagaagtttgaacatttttttttttggcggggggtgggggggtgggtgtaatgtaaacttttgaaaagtcggcaaatataccagaacgcac

SEQ ID NO: 54361 - DNA, 1501 bp, Oryza sativa
ctattatgtagaagacattcgacacggaaaactaaccgtacaacctaacattctcaagattcttacttagggtgaattagcactataaattataattatgtcgatatattgtcgtagtattgtttttctgatatttttccatgtgctaaattaatggtcaaccatcaagaaaaataacttctgatgtgaagtcgtattttcttgtgggttcacccagacaggacataggatatatcatgtatcctaattctagtagtgatgccactacatgcacacacacctattagttagcaatattgctaactagagtaaggatcattagtggacctattcggctgcccttatttgcactgtgttgcagcttatacggacagtactttatatgtgcagctgtagcgcagccgaacaggcccagtaagtccttggctaaaaaggtcccggcgatccactattgaaatttgaattaatttggttagccaaataataatttctttggccaaacaatttacctgaattttagaaatttcgatccaaggtattacgacccaaccatggttacaagtacctgtgatggttgtaacgggacattccctcgcacgtacgtacaaggataattagctggattttccattttccatgtgaccaagaaggtcaattttaaaaaataaaaagaaaatattttttatcgatatgacatagatatactcttttcaaaataattagtaacattatactgtcatcgtatctgggggacgcaaaaacgctggatatgacggtgggatgcgcgagttcataccaaccatttgcaaactaaagataaaaatgaggataacctgttatcggataattggaaaaaaaatatgagcatgttgaaaaccgaacacacatgactcaccgctgcactatccagtgtatctccacccatgcgtaaacttgcatgagtttgtgttgatgacgtcctgagttcgcgctatcaactcgcacgagtgacgtcattagtttgtgcggtgaaatggcaaactcgcacaagttcacatggtgaactcgcgaacttgcacgactccatgccgatgacttaacgagttcacgcgttggcagtgtgaactcgcacacatcatcactgtgtcaccagttctatatctcgcggatgtgacaacggtataatgttgctaatagtttaaaatgagtatatttatgtcataccttctaaaaaatatattttaaaagaaaaatcgaattttgtgccgaaatcccgatagtttttctcctcccacaaccgaccaaggtacaattgattccgtgtcgcatatctgtcttaatttcgtggaaggccatagcggagagatcaaaatcccggccggcctgattgggttatcttatcctcagtcctgaacacaccacttgatctccacaaagtcgacacgcaaggtgcatgtaaggttaccaactgccaaaacacaccaattgtctgatagtagtaggaaagtagagcccggacggg

SEQ ID NO: 54362 - DNA, 1501 bp, Oryza sativa
acgacgctgacgttcttcctcttcctcgtcagcctcgagctcgacccggccttactctgctgcaccgccctcgcagtcgccgccgccggaatcttgctcccaacgtcgcatcccagatgccaagaatcgggcgccgacgccgttccgcctctgcaccgccccgcaccacgtcgcgcgttgccgccctttgccgttacaccacccccacggtaaaaccctcgtgccccgagcctcacctagtgacctagaagccggcggccccctcgatttggggcgggcgccgccgtagccatgccggcccggtcgcccttatgccaccaatgagcttcctgtgggcaaacgtagtcccaatgcaacataggttatattatcgtgaaattgacatccctatgaaacctagatcgtgtagaagtagccggttgtgcccaaatttatcgacattgcgccgccgccgtgcttgtgtgctcggtgccgccgcttgccgtcgcgtcgtgcgccgggtggccgctgcgcctcgtcgtcgttggcggtgggtcctcggcggtgagccatcgcttccccgtcagcgcgccatgccgtcctggcttgggctgtcgcgctgaccatgcattgcgctgttactcacccgcgacgagaggaggaagaagggagaaacaaaagaaagagaggaagagagatggagagctgacatgtgggcccaagggcatttttgacatatcacgtgatttctctctcctcctcaaccggaaattattattttaatcggcgcggtgtctattaacaattatcatgtttatagagtgttttctactaaaagtgagtttggacagtgtcccacgactaaaaccacataatagcagtgtcttgtagcaaaatttgtctagaaaaaggatttcgaataaaaaaaagataaaactaagaactaaaagttgtttctcttaagaaaatgatttcgaataaaataaaggttaaaactaagaactaaaagttgtttctcctatctagcaggaggggtggtggcagaggagcctcctaatgttccaataggtccccaaatgatacggcacgagcgagataatttggttgatgaaagagcccaagcgcagattagagcttgaaagtcgaaaaaactcatcatacctatacagatctgaagtagtagcccacatcgttttttttttccctgggacttttccatttgacttgaattattgatggtcgtcattgctatgcaaattttctctagtaattcatactttattttgtatcatcgttgaatacaagagcacgtgtagcctcaaatagtcacaagatgtcttcatcgaagaaaattgatggttccggttaaatgaatgcaacaaaacagtaggagtattcttgttggcaaattgcacggaatttggatggaattataaaaagcattaattcctcccgtatgaattcgccaatctgaatttccgggaaaattgagaaaccatggagaccgcgcatctagcctacg

SEQ ID NO: 54363 - DNA, 1501 bp, Oryza sativa
cagttcaatatgctattcgtgcaaacatgcatgatattcgaatatattcctgcggcctatcctataccacgaataaattttattcggtgctttttgtgaactgcggtgatatttatcgatggcaacacctcataataaccataaggtcacgtcaaattttgctgtcgtcctgtatattctgaataaaagcgtatccagattcgttgtactcaaagtcacatcatattttaagttaattattttgggatgaagagaatttgccaattgatgaagtttacaactaggtattagaaaaacatgatatttgctagtagaagaattcacaaagtagtggcttcattaggaaacagtctaaacgtacttgattgtttatatactagtcattattttatattaaaatgtaatatatactaagcatatggacaatgaggcgaaagaaaatgataaaaatacaatcagttctattcttatttctttcatttattcttttgggtgtcccattcttttttaagaaattgagtacatacaccttagaatttgattaagggtacacactgctttaagctgagttcttttcttggagtttcaaactcactcccctcattttacacgtgcacgcttttcaagctgctaaataatgatgcaaaaattactatatgaaagttgctttaaaaatcatattgatttaaaagaaattagttaatacttaattaatcacgcgcactccgttttctgcgcacagggaggtgaagttcccaactccaactccacctcccaaacacttgtccttgataaaaaccccctcttctatgtctcttcttatcatttatttcaagtaaactttttaaaaaatacttttagcgattataaaactaaaaatttagcatcaaacctttcatacaatcacatattgaaagtatcatatcataaaactataaatttagtgataactacatatttttagagtttagatccatagcactataagttatttatacgtacatatagttttgtgataattgatattaaatccgtggtttttatgatatgatatcgtcaatatgtagttttatatatataattgacactaaatatagttttatggtacatatttttaaatcaatataagtagttttctaataattggacgaagtatacatagttttgtaaaaaatattctttattatctcatcttgtgtgtgttttggtactacacagcacagatgacacttttccccgatgaacagttctcttggacttttgggcggcccaatatgtgcgaacgttgtgggctggccacttcagatcgagttcagaacttccatcgtaatgtccgattgtgattcagagttcagaacctccatcgtaatgtccgattgtgatatgagaaaactgaatgcagcctaaccattttggacttgattatttcatgcttcatattccaataattaagcttgtcccaggcaagaattgctccctagctaaactatgtatggcccag

SEQ ID NO: 54364 - DNA, 1501 bp, Oryza sativa
ttacagtataatcgtataatcgtagtgttattacactgttaacttgcatgtaactataatataatttgcatataactttcacataattttgaaccgttagatttcttcaagatttgtatgagtggagaaagaaaaaagtcactgcgcgtacatatgtgggaggattcgttcccaaaacctccggtttttatcgaaatagcatgttactgtcgacgggtgatacccgtagaccggatatagagggtattggggtatgttggtacaaggatctacgtagtatgacatcgagcaaacaaaagacaagaattatactggttcaggccccttgataggtaatagccctaatctagttgatgtgggattatatggtggaaaacacaggttacaaagagaacgatggaacttgtcggatccagcgagatcttagtcgagtaggttcgactggatctcaatggctttgctccttgtaggctccggcttcgtagactgtgtgggttgtgttggtttcgagattcgatgtcttaagccctccccggggggtcctttttatatcgcagatctggtggtctccaagtagaacttggaggtatcagaccctatacaatacgtcaacgacccagttctgtccgggtaggattcttccctactgtaaattacgcgaaaggtttccttagaatatacaggaaatatccgcatgcgcgtgggtatgccatatcgatatgcaacgtatatcgaagggtaaagggtatgccgaacccgtaaccctgacagttacaaagagatttttgaaagttccatacaaattacatgtaagttagagtgtaatttcacaacgattatgttatagttacatttgtcaattttttagagaaaatttgtcgacaaatgtaggtaaatcttccctattaacttggatcaaattaagctacgatcaacgtggtcaacgagttacagtttatgttgccgagaacaattgagcaattgatcattttttgaacgcgtcctcacctattaattttcatccccaatcgacacgatgcatgaacctaaccttggctcttcttgcatgcaatggccagcacgtccatcttcctattgttgccgacttgcggagaatataccgaagaattctgaggtaaaacgaaagacaagtggcatataaaattaagcatttcttttgctttgaatgtttcagccttacttatcactagctgtagctactcaagtatcccctccttagcttcactcttcggaagtgtttgtcttgggattgtatcttaggttctactactaggtaagttcatcgccctggaggcctggacccggtcgtccttctatgagccagtgatgaactggatcaccggaaggcggaagcaactcgagctaggtcaacgcatcagcctttcatcttccctcgatgtgtatgagcatctttacttaatttccagtttaaggtaaaaggctatactgcgtgttttactaactgtaattagctcatgac

SEQ ID NO: 54365 - DNA, 1501 bp, Oryza sativa
gttttggttataagctagaactgaatgagttgagaggttcttgtctgttcttgctttcaattgcatctttcggtagataggaatgcatgatttgtaaccctttcagcatatgcttttcgccatgtgtttctcttgacttctgtactccaacatatattgaaaaaacaatatattttgatgactagagtctgtcatctgtatgaaattggaatgcactagaagtgtggtcctcgatttcgccttatggtttgtactggactgcactgaaaattttgaacttgtgcattacagggttccaatggatagcaattttggggcctctagaccaacatcgctgacaagatcaggttagttattcatataatataatataatataggtttatatcttaagctgtaccatatttggtttatttgatctgataaaggatgaaatagagatgggtgcctcaaaaataactttaatggcctcaatagttcaagacatttagacatgtttttcttaattatgattaattatttcacatgcagagcaaccgatgttgttgatagtaatcttaaatgagatggagtagggtgcaatcctaccagctgcacttagactgccctggtgaatgcattttgcaagggaaagtcagtatgagaagactgaagaagtgtttgaagaatgcaacaggctagccacgagaccgaagtgtatgcttatgatgtcctcatggaagataaatggtggtcatcataaatccatggctacacgagcctacgttcctaccgacatctggatggaattttttacttttctttaagtttggagtaatatacattgtatatatcaatgcaccacagccatacaggattgctgcaaggcgcttgagggatctctccttgatgcagcatttggtgaggggtgattgtgacagagcttcatataacatcttggtggatgcatatgaaggtacagatggtggtagataatttgccaattttgtgataaaggaaccaagaacttgagtgccatggtgccactttctaaaactgaaagcttttgaatttgctgctaattttcagattcagaagcaacattcaagcaactgaagcagcaggtgatgacattctcgatgaagacattcttacttctgttgttggcgcgtgcaggtctggcaacgtggtgaggatcaagtggaggtgatggcatggctgcacaaatccggcatgtcataactattgataatgctatgcatatggccacctttatgaaagcttttgattatcttgattatggattatatgcagttgtccaaatatgtacctgctatatttgaatatacggcatgagtgcataatgactagacccccccccccccaaaaaaaaaaaaagtgatgacttgtttggttggccagatatttatgaataattttgttgtttggggataatcagatattagagtaatcataagctgtccgttgctataattggtcccaaagaggacctatgagtctac

SEQ ID NO: 54366 - DNA, 1501 bp, Oryza sativa
gcatggaaaaatcgattttcgtgtgcgggctttttaagtggaccacacaggaaaatacctccctccttttcctctcacccacttcaaatttttgacatcctctctattcctttttccccttttattctccctcaaccacttcccccctctctctaccttatctctattctctacctcctcctcctcctcccctcctccgacaacagcgggcgtcggcggcggccccttccgtgcgcgtggcgaggcggaggcgtcaaggcagcggtggcaagcgggcgacggcgagcgggcggaacctcctcctggtcgtcgtcctcgtcatgcacgtcgtcgctcagctccctcgacgatgacgccgtcgtcgcgtgcgttgtcaaggcagaggaggtgagcggggcggcggcgaggcggccggatctagcggcggcagccatcccccgcccggatctagcagcggtggcggcccccgcccggatctggcagtggcggccgtcccccgcctggatccggcggcgatggcggccggcgcgactgcggcggcggcgggccggcttgaaggcgatgacgatggcgggctcagcgatggccgagtgcgtgcggtctagcaggcggcggtgattttcgcgtttttttttggttttgttggttccgtgcgggcggtataatttgaccgcacgggatactcgagtatcctgtgcggttcggtcacccgcacatgaaaatatttatttttccaaacgcctgattccagacagggaaaatatccgcacagaaaaatcaatttgaccgcatgaaaaaataggttatgtagattccactacagagaaccttacctgctgagttatgtaagctcaattcgctggtcataaatatttgacgttgagtacaggtttttctcaaagttttaaattttgatgatcgataatttctcaaatgcttagctaattaagaaaatgtatcgaaatttgtcttgaagagtactataatactaataggaaattttgttgtccttgacaggtagtactatgtacctctagcactaagaaactcttcaattttatgttaaaaaatgtggtacaattctatatcatggcattaaatatttttgaccaaaggaagtactaatctctacatacgcatcatttaacatattttcccgaggacctgtttagttccctaaaaacttttcaaaaaacatcacgtcgaatatttggatacatgtataaagcattaaatatagataaaaaaaactaattgtacagtttacatgtaaatcgcgaaccgaatatattgagcctaattagtacatgattagtcataagtgttacagtaacccacgtgtgctaatgacggcttaattaggctcgaaagattcgtctcgcggtttccaagtaagttatgaaattagttttttattcgtgtccgaaaacctctttcaatgttcgattaaacgtccgatgtgacagaaaaaatttcccatttaccgactaaacaggcctga

SEQ ID NO: 54367 - DNA, 1501 bp, Oryza sativa
cttgcgtgtcgactttgtggagatcaagtggtgtgttcaggactgaggataagataacccaatcaggccggccgggattttgatctctccgctatggccttccacgaaattaagacagatatgcgacacggaatcaattgtaccttggtcggttgtgggaggagaaaaactatcgggatttcggcacaaaattcgatttttcttttaaaatatattttttagaaggtatgacataaatatactcattttaaactattagcaacattataccgttgtcacatccgcgagatatagaactggtgacacagtgatgatgtgtgcgagttcacactgccaacgcgtgaactcgttaagtcatcggcatggagtcgtgcaagttcgcgagttcaccatgtgaacttgtgcgagtttgccatttcaccgcacaaactaatgacgtcactcgtgcgagttgatagcgcgaactcaggacgtcatcaacacaaactcatgcaagtttacgcatgggtggagatacactggatagtgcagcggtgagtcatgtgtgttcggttttcaacatgctcatattttttttccaattatccgataacaggttatcctcatttttatctttagtttgcaaatggttggtatgaactcgcgcatcccaccgtcatatccagcgtttttgcgtcccccagatacgatgacagtataatgttactaattattttgaaaagagtatatctatgtcatatcgataaaaaatattttctttttattttttaaaattgaccttcttggtcacatggaaaatggaaaatccagctaattatccttgtacgtacgtgcgagggaatgtcccgttacaaccatcacaggtacttgtaaccatggttgggtcgtaataccttggatcgaaatttctaaaattcaggtaaattgtttggccaaagaaattattatttggctaaccaaattaattcaaatttcaatagtggatcgccgggacctttttagccaaggacttactgggcctgttcggctgcgctacagctgcacatataaagtactgtccgtataagctgcaacacagtgcaaataagggcagccgaataggtccactaatgatccttactctagttagcaatattgctaactaataggtgtgtgtgcatgtagtggcatcactactagaattaggatacatgatatatcctatgtcctgtctgggtgaacccacaagaaaatacgacttcacatcagaagttatttttcttgatggttgaccattaatttagcacatggaaaaatatcagaaaaacaatactacgacaatatatcgacataattataatttatagtgctaattcaccctaagtaagaatcttgagaatgttaggttgtacggttagttttccgtgtcgaatgtcttctacataatagtaaaagaaattgaaaaaaaaagacgtcatggaatatgtttgcaccgcgggcttcctttactttttgtcgacat

SEQ ID NO: 54368 - DNA, 1501 bp, Oryza sativa
ccatcatcaacgcaggcttgtcgtccttctccatcctcgcagcttcggcattgcaatagacgtctcacaacccatccgtatcaaccaccctatcgccaatcttcaccatcctggcgatccctctaaaaccaccctcgtctgttcctaccccctcttaccgtctccactctctaacccagaaccctaatccgtaggtcctcagccagagttaaggggtcaccgtcactgagtcttgccatcactatcgttggtcagtctgccatctccatcactctcctctcctcctgcctccctcttgtaaaggtggaggacaacgggcaggtcattggattttgatccaacaaaattcataagtcgacttaaatttagagaagtttcacccgactcatagaaagcaaaggtgtttttcgttgattaaaagttgttgatgcaatatagtatactccctctatttttatgttgtaacttaattttgagttgtcgtaaatattaaggagggcatgaaatcaagagagataagcaaagtttgctacctactcccttcatcctagtttggtcatcctttaaggaaaaggcatcaagaccaaaaacatgaaaacatcttggtgtccaacataaattaattatcatcaatcaaggtactccgtcacttcttgtctaacagaaattaattcatactttaaatgcgcatatactctttgtacaaataaacaaagaaacactttgttatatgatgtcattttaagaaaacctcaacaagcttaggtgatgatcaacttgggatggagaaagtatatataaacacgttggaaacagatacagtagtgaaacatattgtatggtgtatttcaacagagactatgcaataaacaagggcaaataagaaaatgacccaataaagtatacatgcaagccttatgtttcaaacaagatgaagaaaaccttgtgccatacatagtacacaaacggacagatcccatccgatggcgaagtatatattgaggcatctaaggaatatatatatccaagtcgttggacgtctcttaggcatctcagaaattaatccctggcggatgatgcatgcatatggacattcaacggggttcaaagtctagtctctccatcgtcgccatggaagaccaccataaatgtcaatatgcacgtgcgcagtgcgctaatccatgtcagacgcacgtgcgctaatcaccacggaagaaccgtccttgccgatccctataaatttgccgccacaatcctcgctcgtctctcctcaacgcgctccggccaggcaccgctgacagcccggctccaaactccggcacctccgatcgatcctgcaggcaatctaaccaattaacttggccaaaatcgagatcatcatgatgtggaggaggaagagcagcagcagtggcggcgtgtcacccgccggcgcctcgccgcgccacggcggcgacgacaacgacgaatgcaatgtctttccgagagggtacgtaccgatagt

SEQ ID NO: 54369 - DNA, 1501 bp, Oryza sativa
ccctacatgatacagttacgacccagtcctatccgggtaggaatcttttcatctatggactccgtgatgaatttccttagcgcatacaaagaacgtccgtatacgcgcagatataccacaccgatgtatagcatatatccaagggtagagggtataccttatccgtaaccctgacagtagcccccgacttctacttaaatgaactcatgtaaccgatcgcgacttctgatgttgggtttgttgtcgttctcgtctagtcgatctcggcgtaaggaccgtagagacaaagagtaatcgacaacgctatgaaaagttcaacggtcgtgagtgaatttaaattgaagtccaaaaactgccgcgcgtaacggacccagaaattttcggcgggcatctctcctctttccttggaaatcgcaccgccggtagtgcgcctttaaaagagttttggggatccattttgaagtccgcctgttgcgaaagaacttttcagtctctaagcgctcctcatcttctccgctcccgcaaaaccctagcttgttcatctccgtccctcctccgacgatctccgacggcaatggatctcgacaaatccacttccaccggcgcgtcgctgaagaagttacaggaggacggcgctctccccggttgcggggccatggagagagaaccaggaggtactgaccctgagccagtcctgggccgcatggttgcagttgaggactacattctctgtggttttcttcctcctccttccgaatttctgcttttggtcttgaatttctacggtctttctttgctccatttgaaccccaattccatcgccttccttagtatcttttcgcatctttgtgaggcctatattggagtagagccatttctcgacctctttcgtttctactacgagttgcgttggatgaaatccaacagggtatctggatgcgttggtttccgactttgggatggcctgaagtcgcgctacatccccttctagtgcccctcttctcgtagtaaatggcgggcgaggtggttctatcttcagatagaaaattcggatccagtcttcgttgtccctgaggagcaaccagacaagatttcttcttgcaccgccaaacccgccttaaccccttcccttcagtccttcatcgatatcatcgatgacctccgagtacaaggattgtcggggtatgaagtcgctgccgacttcattcgtaggcagatccagctgttctaggcttgagcccacccaccctttcactattctgggccggaggacgtgacccaggtttctcctcagggtatttttcttgtattttggactccattccttaagtgtgtattcctcctgacttatcatttctggttttcgatctacaattgaacagcgaaaccgtggagcaccgtgtcggtcaagtgatgatcagcggtcctacaacggcgagcaacgtccccgtccctctttgcgagaaggagccagctgaacgcgaagccgcgatcaatgtga

SEQ ID NO: 54370 - DNA, 1501 bp, Oryza sativa
aattcgtcacttgccgcaagggcaccctctaggtcgaagaaatctcctttgacatgacagcactcatggtggatgaagtggcacagatcacgctgcacatttgtgatacctgtatcgtcaaagcttgttcgacattctaatcttggcaactgcatacattgaaattaatcaatatattagtatcataaatatcaagagctgtctagtacatagtatagagacttacatcctccgcgttagtcctgtaccgtccattaaccctaaggaattcgcacgcataatacccgcaaaggaccgttcctcgcggttgcttgtgacactgaaggacatatcatagaaaaaagtagttataatttgcaattagtgaaactattggaatacataaagtgagtggagtattaccggccaataggtacgtactagcagcttctcccgtgttcgggtctgttctccacccttgaacttgtagtattggtatgtactgtatggatgtcataccgtttcagagtaaggaggatatttatttgtaatacatccatatacaaatgcaagagtcataataacttactactgtaagattgttagaaattctttgtattgcttgtgtttgtaatcgagaggatccaagactaccatggttccgtctttagggtggatgagtaaacagatataatgatcgctacatattaacaacattataattagttagtaacagctaaaataagacatatgtgtacaagataaatgtaccggacttacttaaaattataagcggccatgaagactcttattttgaaagtgcaagaaggctcgtccaatgtactgtgcgacagtaatcaatttctccttgtgcaagcccttcttgtattctgctatctctttcggattcttgcccttcagctggtctgaccctggatctagcgtaacggtatgctgtgtttggcatatccgagttggatccaagaagccgatgggttcttttttcttcttagcatccatgtattgcatcctacagaagaagtttgttagtaacaatcacatggagttgtattgtacatatttttcatctaattaattaaaactcgtactcacatgcaccaaacaccgacataattgacgttcatcttatcccgacgatatatggcgtggagatatgagaaatctagccatacgtaaccttcttcgccgaaacaatctgccggtgatcgagctgttatattgcccaagcctttcttgctggcctccatgtagaagttatgtaaccttctcatctcccatggtgcctctttcagtgcccattccggcaagagtgctttcccatgttcgtacttttccgggcaatcatcggttgcgaagtatgttggcccggctagcacagaagccttctgggggtcgtcatctctgagcttggcacgttccttaccccctctaaagacggttagcatgaacttctccttgttcgcatctttggacttggattcgtggctcctaatcactcgtg

SEQ ID NO: 54371 - DNA, 502 bp, Oryza sativa
ttcctgcagccccaaccgggactacaaatagatcttttgtcccggttggtaacaccaaccggtattaaagattgaaaagtactctggagcttttacaccgggactaaagatgtttttagtcccggtttttactacaaccgagactattatgaaatctggtcgaccgacaaaagatgatttcttcaccagtgtaggtactcacgcgtattgggtgagtgggcttttgccacaaaataataagtttatgggttaaaatctctaaattagagtgacagttcaggtggtttatgcaattttttccaccacttttagcgagtcaagaggttaggccacgttttaatttacaactcaaattgcacgtggactatatacatgtataatatatactatcacatcgatcagccggcacggttgaactaaataaattttccgaaaaccaccaggccggaaaggcagccgtggtggcccatgcgaatatatatgtaccgtgtctgttactagg

SEQ ID NO: 54372 - DNA, 1501 bp, Oryza sativa
aactcccacatcggggaagcaagaccccctttcgaagatttggacaaggggcgagtctaagcctgagtcaccctcaggatcaaatggacgtgatgaagtatacaggtttgagccatacggatgcgtaacatcttactcttgtgtgtatgtagactatcagtgatgaacttgtattacgatgagatataggacttatgtgagctctaattgctaaaagattcaaccttctattcattgggatagatcctccttttatatgccaagggaagtgcatagtgctaaaacttgcatctaagagcgggccctattccaaagagttgggtgtgtcttgtttcgtcgatgtcccctatagcaagatggcaggaagtgacatctttgctctccgattgacacacgatgcagaggcaaggtgatcttctcaccattgggcccaccagtcaactcttacaaggtggcaagattgaatatgctggagtgatatgggaggggcatgtccaccccacctattccttcggcagacatgggttctcgggaggctacatgcggcgtcatgtccctaagatgtgggtggatgagctgttctccaaacggctccctcctacaacggaaataataatattgagttggagttaagcccgttggcccaccaagcgaggtgaaaaaaaccccatagtgagcccggggcaatgaggtgtgctcgggcccctgcctagggccccaagtccattggtattgcgcattgagggtgcctccactccatggggcttgtttccatgcctggcgcactgagtttcccaggtctccagggatatttcctcttgcttctttacaggtttcttgttactttggacgagcttctcgaagatgtcgttaatgaacgggttcaaagtggttaccttcgtcaaagaagcaccatacaccttggagatattcttgtaggtctccaccctcttctcggtaccttggatacgtagatcttgtaggtttctacacttttcttaagatctgaatgtagatcttatacgtctcttgaagatatagattttgtacgtctcttaaatatgtaaatcttatatgtctatctcttgttgtgatacacatcatttggagccctgactattccagggaaccggggaccccattcccgttctccaaacaggccatattatagatcgactttttaagtcctatactgctgtatgcatataataatcaatacattttatgaacttggtcaaactaaaaaaattttaactgagaaaaagtcaaacaacttataatataaaatgggtaagtacctcttaagttcggccccactcatatcaagatgcgccactggttgacctgttctttgtcgaacatgttgccgtctgttagacttcttagagaaggactcagcaacttgtttatagcaattaccaattaacgtgggggcattttagcaaagctgcggagcatttaattattatgaagtggagtagataagttttcatttgttcag

SEQ ID NO: 54373 - DNA, 1501 bp, Oryza sativa
caactgggcgggattatttatatagagcaagggtgagtacaggagtactcagcaagccacgggaattaagtgtttaatgcaggcttcaaaggaaaggctattgtttttgcaattgattttatttaaactcctttttgaaacgactaagtgagtgtttctcaaacgacccggatgaggcagtgcgtctcgtccggtaggagtatgtgcaatgtatcagtctttgaattgatcaaggttggcacccggccaacagctttcaaacggccacccgggcctggctgatcccatcagccgccgattttccaaacatcgaatccattccacagcagcaatttcacaagtagtagtcaaacaaaactacgctaggaatcacctcacatccgcccatgaccatgggcacggctgttcgaacagtttaataacctctgcagaggggggtacactttacccacatgacgttactagccttggtcacccagcccgtgcagaacagccacgtctggtgaccttgggactttcatgacaaggcatttcgaaagccgacacaggttcaccatatgccaacgagaggggtcccagaccaacaccagattaggtcccagaccatactgtgccaggaagcccgggggttctccccgacaccaccccgttgaattcacatgtctcttggcatcaaggctcccccgattagcaatttactcagccaggggtgtcccatttcacccatgtggtcgcacttgtcttatgttcggatgaaattccaaggaaacggtccttaagtgcaagagcaggaaaccgtacacccggtacgttccccggttcacgattttggaaattcatttagttcgcaagcaccgacccaggtgtcgggttttccaagtcttttgtaaaacccaagttttacccatcgttggatattttatattttgagggggggtgttctgatgcgcgtacccgaaggcccgtgcatcaaagcacaacagttgacaaaggaagtctaagtgttcaataattcaaggggggtaattgcagcaattaggattgggagggggggccagcaggctatctcgcaagccgcggccgaattacttgtataaaacctattcatgcaatatttgcagaaaagaaatacttagatttaaattataggtgcaagatgatcaaaggtgacttgccttgctcgagatcttgagcttgatcctcgaaatcctcgcactgcgggtcttcgggctccgaaactacacgtgaaatgggacaactcaacaaacggcaaaaataaagccctattattgacctctaggcgtgccattagatagatctcgagatttaaggaattttggaagttgaacggagtcaaacgggcttacggttgggaagatattgaatttctaatattattagatttttggtccaaaggaaaaggatttatttaaatcctttttgaaaaaaaaaagaaagagggagggaaattagacttcgcgggcggctcggccgaacttaa

SEQ ID NO: 54374 - DNA, 1501 bp, Oryza sativa
aactatattataataacttatatataactagaaagtaactacattgtaactcgtatataatttatacgtaactaaaataaaaatatccaaaaaattatatggcacggtggtagcatagatcctcaatgagctcaacggtgtgagatcaaattttagcagctacacttgctaatttattttttctcctatttgctagcacgaatcttaaagcaaatctaatggtctaaaattgaaagttttccccctaatctagcaattccgataagggttctcgaatgttggtgtgttctcgtatgagtttagatcggggcggtagccgcggtacgtctcacaggttgtgcagctcttgggacggcgctactacgagcgatgtggcttatgagtttgtctcgatctaacattccaagtctcgagttgcatccaaccccaatacgctgcaatctatactcatcgatttaagtaatagtaagagagagtgacatatggagcgtattgtgttattgactggttaattttcctttgtgatcagaacaaatcagatttttgactttcttttgtgatcagaataactcacatttttgccatccaaaacaaagtagtggacatacgcatgaatgaaccgataacaacatcaaattcaaaccgatgttattgaacatcctaagggtaagagcaatgtgtcactatatatatttagcctggggtgccaaatagactaaagaacttcaaaagccactacaaaatgcaatgtggcctaaaaccgagtcatttatgtttgaagacacacatgtggcatggcctagcccacggagccaagatttgtcccagcacataaaattacctatgtaccctcgaaatcaactagtacactgccctttgacgaggccggtacaaccatgtctcatcgcctcctcctaacagcatctccttcctctcctcctcccgcgccaccgtacgccagtctgacctcgccgacgatgaagctccggagtggcttcgtggctccggagcggctatccccaaacgcggcacagtctccactccctccggttccagccatgcacaggcttctctgaaactatctgctgctgctgctgaaagcctgaaatgtgagtggggctttgtttctttctttgctactcccgtgcatgtcttggatcctttcggtatggtctcttgctgcgccgtgtgagattcttgcatctgctacacatgggttctttggtaaagttggtttttgcctctttcagttcttggtctgcttcatctgtcttgttatcttccatttgctaatcctttgcattttatttgttgataaatggagacttgtgacctttcatctcttgctcaagtttcacctctcttcctgcatctcactacctgatttggtgcttaatctaatccaattcctttttggttcttgtgattgcggtgggtgattaggtgcttaacataatcccaatcctagaaaaacaggagagccggccatggctgtgattgc

SEQ ID NO: 54375 - DNA, 1501 bp, Oryza sativa
aagaggaaggtgactgataaggcggatgatccagaacttggtaaggaaaatccagtgccggaagtgccaccggagattgcattgccggagacagccaaggagattgcaccgccggagacagccatggagattgcaccgccggagacagccatggagattcaagtgccggatgtgcccatagagattacagtggcagaaccagaggtggaatttgtggcatcagtcgggtcagacaaagatgaagtaccaggattggaatgggatggtacagagccagagatatttgaagacccttctcctgcgaaagaacccgaggtgccacgagtgattaggagccacgaatccaagtccaaagatgcgaacaaggagaagttcatgctaaccgtctttagagggggtaaggaacgtgccaagctcagagatgacgacccccagaaggcttctgtgctagccgggccaacatacttcgcaaccgatgattgcccggaaaagtacgaacatgggaaagcactcttgccggaatgggcactgaaagaggcaccatgggagatgagaaggttacataacttctacatggaggccagcaagaaaggcttgggcaatataacagctcgatcaccggcagattgtttcggcgaagaaggttacgtatggctagatttctcatatctccacgccatatatcgtcgggataagatgaacgtcaattatgtcggtgtttggtgcatgtgagtacgagttttaattaattagatgaaaaatatgtacaatacaactccatgtgattgttactaacaaacttcttctgtaggatgcaatacatggatgctaagaagaaaaaagaacccatcggcttcttggatccaactcggatatgccaaacacagcataccgttacgctagatccagggtcagaccagctgaagggcaagaatccgaaagagatagcagaatacaagaagggcttgcacaaggagaaattgattactgtcgcacagtacattggacgagccttcttgcactttcaaaataagagtcttcatggccgcttataattttaagtaagtccggtacatttatcttgtacacatatgtcttattttagctgttactaactaattataatgttgttaatatgtagcgatcattatatctgtttactcatccaccctaaagacggaaccatggtagtcttggatcctctcgattacaaacacaagcaatacaaagaatttctaacaatcttacagtagtaagttattatgactcttgcatttgtatatggatgtattacaaataaatatcctccttactctgaaacggtatgacatccatacagtacataccaatactacaagttcaagggtggagaacagacccgaacacgggagaagctgctagtacgtacctattggccggtaatactccactcactttatgtattccaatagtttcactaattgcaaattataactacttttttctatgatatgtccttcag

SEQ ID NO: 54376 - DNA, 1501 bp, Oryza sativa
attggcacaactaaatggagctcaatgatgtttctgaaaatctgaagaaaaaagatctagtttgtcgatgctttcacacgtaagttgctagaacaataagaagcaactaatgaaacaaattagcaacgtgtaggcaacattttactaaatatatggtcagcttgttaaaagtcttccattcagtaattttatcaacagaagaaagagaggaatgataggaggggatccacgatcaaataataatatattgtgactaagggcctgtttagtttgcgaaatgaaaatttttgggtgtcacatcaaacgtttgaccggatgtcggaaggggttttcagacacgaatgaaaaactaatttcataactcgcctggaaaccgcgagacaaatcttttgagcctaattaatttaccattagcacatgtaggtttatgtagcacttataactaatcatgaactaattagactcaaaagattcgtctcgcgatttcccctctaattgtgcaattagtttttgttttaatctacatttaatgttctatgcatgtgtaaaagatttaatgtgatgtttttgggaactaaacggggcctaacaagaaagacggcaaaagactgccaaaaggggtagctgaaattgttgttgcagctttaatgaagagtagtagacgccagttcaacaattctaacaccacgaattggctgctgaagtttttatagatgattagtgtgagaacgtatagattggatcatctgagtaagcatttgaccaataacctaccatgcaatgtgcaaatgagaacatacaacagaaataggcaacggtggatgggtagggagaatggtgcagcaagtggttgctccgtccacggcaagcgtgagcactgagcagacacagacaggtgacggcgggcagatatatatgcgtgacgtcgaggccgtgtgccatggtcgatggtcgctggcggctgtgacggagcagtgagcgcccgacgatgggtgttcgaccggagctgaagtgttacccagttcagagctagccgccggaggcatgagaggatgggtggcgcccgtcgcaaccaagccttcctgcggtgccagcggaagagaggaaagagaggacggcgacgctcactccgatgccacttgctccacagtgctgtttccatcctcacacgccctactttttctcccaagaaccggtggccttctttggacacaagaacctcatttcggtgggcccagatgcaaaggtggcatgtgcccttaagctttgcctatgtgggatggcaagagagaatgccacctcaccgcactgtgaaggccctaagtcgcaacgggtgttatggcggggcggaggtcacggcggcggggaaagcgtgaccaggtaacgtcacgggatcagcagtagaaatttcatatgtttgattgaaagggtgaactctttctttttatatattactttgtacgatttaatacaagttatagtgtacaatatagttataata

SEQ ID NO: 54377 - DNA, 1501 bp, Oryza sativa
aagccgccgcctggtggtccacgagcggtccgatgatatcagtaagagggagagcctgcactacataaagtcacaatgcgatcccggaggaaaaagacaacagggccgtcgagtacactcacattgatcgcggcttcgcgttcagctggctccttctcgcaaagagggacggggacgttgctcgccgttgtaggaccgctgatcatcacttgaccgacacggtgctccacggtttcgctgttcaattgtagatcgaaaaccagaaatgataagtcaggaggaatacacacttaaggaatggagtccaaaatacaagaaaaataccctgaggagaaacctgggtcacgtcctccggcccagaatagtgaaagggtgggtgggctcaagcctagaacagctggatctgcctacgaatgaagtcggcagcgacttcataccccgacaatccttgtactcggaggtcatcgatgatatcgatgaaggactgaagggaaggggttaaggcgggtttggcggtgcaagaagaaatcttgtctggttgctcctcagggacaacgaagactggatccgaattttctatctgaagatagaaccacctcgcccgccatttactacgagaagaggggcactagaaggggatgtagcgcgacttcaggccatcccaaagtcggaaaccaacgcatccagataccctgttggatttcatccaacgcaactcgtagtagaaacgaaagaggtcgagaaatggctctactccaatataggcctcacaaagatgcgaaaagatactaaggaaggcgatggaattggggttcaaatggagcaaagaaagaccgtagaaattcaagaccaaaagcagaaattcggaaggaggaggaagaaaaccacagagaatgtagtcctcaactgcaaccatgcggcccaggactggctcagggtcagtacctcctggttctctctccatggccccgcaaccggggagagcgccgtcctcctgtaacttcttcagcgacgcgccggtggaagtggatttgtcgagatccattgccgtcggagatcgtcggaggagggacggagatgaacaagctagggttttgcgggagcggagaagatgaggagcgcttagagactgaaaagttctttcgcaacaggcggacttcaaaatggatccccaaaactcttttaaaggcgcactaccggcggtgcgatttccaaggaaagaggagagatgcccgccgaaaatttctgggtccgttacgcgcggcagtttttggacttcaatttaaattcactcacgaccgttgaacttttcatagcgttgtcgattactctttgtctctacggtccttacgccgagatcgactagacgagaacgacaacaaacccaacatcagaagtcgcgatcggttacatgagttcatttaagtagaagtcgggggctactgtcagggttacggataaggtataccctctacccttggatatatgctatacatcggtg

SEQ ID NO: 54378 - DNA, 255 bp, Oryza sativa; identical to SEQ ID NO: 26814

SEQ ID NO: 54379 - DNA, 1501 bp, Oryza sativa
ttatattaaattgaattggttagattcatagttgatttcataagtttccaataaataaattgtgaaaaactaaattggtttcacttcctagttgatttcatagatgtaataaaacggatgaaagaaagtaaacaaacctagtttctcctcgtacttgcgataggcccagtgataagcttgtgcagctactggatcatcagtaatgccatacaccacctcaccggaaggagttctcaagataggcacgagtggggcctgcggttcacgaagtggagagctatctgcagaggaatccgagtcttgctgatcttgtgctacctcccactgcttctcctctgaagctatggaggagtcgttgaattgcgattgaggtgttgaaagtggtagatccaattctgattgtttggactcagttgcctgtggatcatatgacattgtcatggaatcggctctacgagggcgagcgaaccagtatgtcggaggagcctccgtaacagcggggaggctttgcgacggcgacgcccgcgatgatggagcagggagttcctcccggcttggctcctccatgctagtgcctccacaagccggcgacccgcatggcgcagacgacgacggtggcatggtagacatacctggctccagcgaagggggcaacgaaggcctctcctggtcctcgtcgctcgccgctcttctagtcctggaatccggcaccttggatcctggtcccgatctcatcttcgccggttcggatctcccgcagatcgcagtcgagggccgacggccgaggaggagagattagacggaggcggcggttcggagcgcccgcaacccggcggctaagcggaagggagtgctgaaaagccaaagcaaaaggggcgctttttatttgtagcgtcaaaccttggacttcgattggaataggtattcccgaatacaagtaacatttttatttatacttaagaaaaaaaagtccgtgcgttgcaacaggtgaatgctattttaatcttattattgttatacagtattacggtttagttaaggtgaaacacattgttggaatttgcttggatattttttttaagaaaatcatgagctacaattagtccgacattcatctcaagttagcatgcgtggttttttaaagagatttcttatacgattccttttatatattttcaaaagcaaacaaatttaaaatccgactcaaacacggattgtatttttaaaagcgaacaaacttaaaatccatctcaaacatgtatcagtatttccaaatgcaaacaaacttaaaaacccactcaaacacggataacgtaccaaaataccggcaaaaacatcttctgatctctactattataaaaattgaaaatgttttcgtcagtattttggtacgtcatctgtgtatgagtcggtttttaagttcgtttgttttttgaaatatatatccatatttaagtcggtttttaagatcggttcttttttttaatacagaaggaatctc

SEQ ID NO: 54380 - DNA, 1501 bp, Oryza sativa
ctagcaatggaataggtaagggtagtaatatatacatgctgacactacggtattatttcgatgcaaatcaaattaccataagataatatatgttttattaaacgagattgatttaaaacatcaaaaaaaacagtaacagtgagaaaagttattttgttgttagtatctccggttataaatatttgacttttgctctcatataaaagaaaaccatacttacttgacctgcttgataacatgaaccatttgattgttttttcaagttccaatgaattcaagcaatattataatttttggatttctatccactgggatcccgtcgggagtcgggacgggacgggatccccgcattcccacatggtcagcaaatgacttttcacacggaagcacgaagaaggcgtcgtacgccttgttggcctcacgcgctcccagtccattgctgccaggagctagaccatcgtggtcgcgagcccgcaacccccatctaccgccagcagccgaatcgagaggagtgtctccattggtgcccagcgaactcctccatgacctccaccttccgacggttgcccctattcctccttgtgcttgctgctccttgtccttgttatctgcaattgcagggagggacaatgtaggggagcatcctgctgctccccctcttgtctaggattgcggtaagagaagatgggagattgtggagagggaagatggggagcgccgccatcgccctgggggaggacaaggagcagcgtcgtcttcgccacagcaatgctggtaaccatctccatcccttcttctcttccccctctcggctcagatttgatactcgattggtgccatgtctaatagcggtaggtataggcctaataccgatatgtatcaactggcaccgactggggtattagctagtaccgatgaggtattagttaatacctgacgagtatcgagtgatacatatgaggtataaaatctaataccaacatgtacaggaatctgatacctgcttggtatcatcctgtctggacgggatcacgctgtatagcagtctcctattatttttgataaaatttgaccattttctaccgtaagtcaatggtttcaaaatggttttagcgaaaaccagaaaaaactggtttttggatcgttaaggatttcccccaaatagtccgatttttcctccacgccgataaggagcgattcctgcttcattcaggcgagttgcagcctgcaatccgaactgaggacgggtttttggagttagctcaccctcgcgagatcgcgacagcagagtgctttcgccgttggtgttctttccgatctcaatgcatttcaccggtccaaaaattcttatctttagaccattctgagccatttacgaacattacggcaaatatgatcaagacatttatagctcccacataaataagaagttgtgccacagctataaagtaggaattcaataaaatatagaataaggatattattagaatttttttgttag

SEQ ID NO: 54381 - DNA, 1501 bp, Oryza sativa
tccaatgtattacggtgagtgatattttatcgaaaccatacaaatgaagtaacatattgtctattttctagctcagaacgctactccccccattccaaaatataatcatttttattatagtgccaagtcaaatatttataactttgactattaatagaacaaaaataaaaaagatcaatcatataaaattaaaattaatgttactaggtttatcattgaacaaactagcgcaactctttttatttgaaacatcttacttatatcgttggtcaaagtagcatatcgaagactgtcgaagtataaaaatgcttatattttgagacggagggagtagaaaataaaacacatgaatacaaaacgttagaatatgattaaaaaacatgtgatatatatacatgaccctggtgtttggacggataggaggaattctaattaaaataaaacacatgaatacaaaacgttagaatatgattaaaaaacatgtgatatatatacatgaccctggtgtttggacggataggaggaattctaattaattaacctttactctagcaactaatatcttcatttacatagcattatcctgtaacctttcatctcagtcactggtgatctcgactcgcacacaactccacggaccatggctcgtgcgggagctcaagcggcaggaccttcggcggcggcggcggcggcggctgtagtgtgagcctgcgaggagctcgtgtggtggcctgcgttgattcccgacgtggcgcgagctctgccggcgagagctgaagttgcggcgggcgtgcgctgcggatcccggtggcagcacgagctccggcgacgactttcttagggcctgttcggatgaaagggtttacataggatttttttttgtaggattgatgattctttttggatttgctactgttcacttgtttgcatcgtaggaatcaatccataccaaaataggtgtggaataaatcccctccaatccctcactcacagtgattaaccgaagtccgaagggattttgaaggaatactgtagcattccagtgaacacaggaatttcaaaggattccaaacatcccctccaacctttttgtttgtgtctcatcattggctgctatagggtgtttgaattctccactttctatttctgtgttccgaatatccaatcctataaaattcctctgtttcctaatcctccatttttcatcatattcctgcattttttcgtatccctgtgttcttttagcagcaagaaggccataactgccgtttggagggagatcatttgcgcccttaggaggaaacctctttcatttgctttccttttgaaagtataggatttctcccctttccctaattaggaatttgagatgctctttcctttgatccaaatgaggtcatatataggaaaattttccaaacgataccaaacctccacgattcctctgagattggacgaccgcgtggtggtggtgaggagagcagaagcgagagcggaggcg

SEQ ID NO: 54382 - DNA, 1501 bp, Oryza sativa
gatccctggctgctcctttattatattcttttcttcattgtttttaatatattgatttcactccatccccatccccaaaatcccaaatcaattatcacctccaaatcctcaaatcgatcatctccaaatacatcacaaaatcttttaaaaaaattacatcacaacttctacaaaattcatcacaaatacatcacatattcatatcacacacaaatcaaatacatctcaaatccggatcacaaattctcaaaaaaaaataaaacaagccgccatcttccgcctgccgcccagccgccaccttccgccttccgccagccagcgccgcgcgccggccgccgcgcgaggccggtgccgcgcctgcagatcggggatgagtggggggagggggaggaggagcctcgcgtggcgccgccgcctgcagatcggggaggaggggggagggggaggagaaggagaggagggggaggaggagaggatcctccgcgtgtaagatagcgaggagaaggggaggagaagaagagatagaaccgggagggaggaggggaggaggatatatgtatctcgatcccgcacgccttgatctctccgcgcctcgatctctccacgcatgctgatcttttttcctggttggtgttaccaaccgagactaaagattgatctttaatcccggttggtaacactaaccgggactaaagatattagaggggtttgacatcacctaccgttttttaaccgggactaaagatgatctaccaaccgggactaaagatcaaaaagtagctctaaccttttcaaccgggactaaagataatctttagtcctggtttttattgcaaccgggactattgtggaatttggtcgaccgtccaaagatggtttctccaccagtgtaatctttcgaatgtacttatgaggatatggtgtgcgtgtgtacgttttatagggatgagtgtgcacatctgtttgtattgtttctaataaaaaggttgggtgcacttgtccagcacatatgtggtacttgcactcttgtaagttagtctcacgtatcaaatacacgtaagcaacaaaagttatagttttttaataaaatagtttgttatttttgtaattttatgaaatgtttggcttaagttgtagctaagtgatagttttgataaaataattgtagttatgtgaaatttactttataaaacttgagtggtagacctatgccctgatccctacgtcaaaaccttaaaagggcggttattttttaagttgtgtgaatttgtttgtgaaattagacgaatccaaatcaacaaaatgtgaaactacaaaaaatttctaaaatgaggtcaactaacatgatttgtacatacggatgagaactgtgaggtagtacagctataaagaaatagagcaaaactttgggatgtagaagtgattgaaaaaaaaataaacacacaagatgaatttccttagaattactatatgttttagatagcaacaagatagtattttt

SEQ ID NO: 54383 - DNA, 1501 bp, Oryza sativa
aagcagcggtctacagatttatagccagctgtagcacggactccaagacgtagtatgtatacgacaggtgggactatatattaatagtgtagtatgtaattattgtatgaatgagctataagattggctatagatgaattggagttagtagttgactatactattaaacttactctcatgttcaaagttttatcgtttctctcctatcttttaggcctagtttcccaactttttctttaaacttctaaattttccattacatcaaaacttttctacacacataaactttcaactttttcatcacattgttttaatttcaatcaaacttccaattctagtgtgaactaaacacatccttagtgtccatgtgccaaaagagaacatgctcgtgggtacgtattctgagtatgtgttaaatgggtaatttattatacgggtaggaaataaccgtcatgggtgtagccaagggccgaccacaacgggcaagtaccggggctccgcctcgtgtagtagtacgtcccctgcttgattaacaaagtaattagcaaagtaattaaggctaacataaaaatatattagcctagtccatgctaacattaatcgatctaacctctcatattggttttagtgtactaaattacagctatattctactccctccgtattttaatgtatgacaccgttgattttttaacaaacgtttgaccattcatcttattcaaaaaatttatgtaattataatttattttattgtgacttgatttctcatcaaatgttctttaagcatgacataagtatttttatatttacataaaaattttgaataagacaagtggtcaaacgttgattaaaaagtcaacggcgtcatacattaaaatacggagggagtattaattttacctttataaatcataaatagtctatgtccttatatagatcatgtggatgaagtaaatcggcaaaatcaactactcttaaaagtttggtcagaaacttgcaaactgtaagcaggaagaggccaggtaatgtttgtagttaacacatatggactttaggcctgaaagaaagaatacatgttcattgcgctttgctttggtacaaaacagagaccaatagttgcattgttcttttggtcgatatgatagagatggggttatagaatggaaataaatgatattgctgtaagaaaataaatttaaaaaatcaattaatatagtgctgaattttcggaaatcactttcatgcattttagaagagaactgaattctcttttggaattaaaaaaaattgaaggtaaaaattaatgatcagaatttatcttcccagcaattaccgcaagagctgttctgccaaatcgatcagcaaataggaatgatttaacattacagggaaaataacataataatacaaaacgaaaaagaattgcatcatgcaggggcctcaccgaaagaacacctacagcattgcagttttttgtacagggagaaaaagatgagtacag

SEQ ID NO: 54384 - DNA, 1501 bp, Oryza sativa
gtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcaccatgacgttcgcctgttcttgcagcagtgcacgtacccctgctctgagcgcatcaggctcctctaccttcaaaggtgtgagcctttctcactaacatgtaggcccatatgggcccgatgaaccccaggtccacctgttagtgacaaaggtatggtgtctttgaaagcagatgatcttaatccgctctgaacacgcgctcggctggttggcctgcgaaagacatgcttctcttatctcccttttctctgatcgttgtcgctgactctcttaggtctcaacctaggtaggagtctagaagaggagacacggactcatattggaggccgggggctgctgttgtcgtgtggacagcgaatcgccaaattcaggtggcgaccgacgttcgagttgtgttgtcccagaggaatttagattgagtgatttgagtcgaacacgtcgtgcgtgagggactgtagtgttggaacaaaaattaggatgaagaacacaacgtgacacatacggatgaaggcgacggaggaaactcctggtagaaacaagtgggtccaaagatgcaggcgcagcggtaacgcggaaaaggacaacttaccagagccatggtaaaagatggctgctacagtacgagatataccgttagaatgatacactt

SEQ ID NO: 54385 - DNA, 1501 bp, Oryza sativa
tggaaccatgcaatcaccgtcacgttttacatcctcttccccatttgcacgggggacccacacatcacgttttacatcctcttccccatttgcacgggggacccacacgtcagattcacattcttcctccatcctcccctcttatctttttttcccatcactctccaccacttctcatcctcttccctactccaagaaacctccgcctactcgaaattttcaaaattggaaccatgcaatcgccgtcacgttttacatcatcttccccatttgcacatgggacccatccgtcagatttatcttcttcctccatcctcccctcttctctttttttcccatcactctccaccacttctcagcctcttccctaccccaagaaacttccgcctacaccactggtcgcagcaatagctaggccgccggagcaagccgcaatggaggtcgaaggcgtggattcccatggtggcaaggtcggaggcatgggcacccgtggcggcaaggttggaggcatggctcttgcagccacgagggcggaggcgaggtcatccgcggcggtgaaaattataataatataataatatataatctttgtaaaaattataattatttgaagtttattatcactaataataataatagttatctatatcttctatgttttttgggctttattttttccggtagtacattatgtttgtttgtatattcggtcttttttttttgacaaggactacgttcatacttttctgctagtctgaaatagatcagtacgtacgtagatctgatctgatctcccgttacgtttgtatattcagttttttttaatagatctgatctgatggtctaaaataacaggcccacaaatttaagtgaaaatcaagggctagatgttttgcttttttctcagaatttctaggattttctctaatttattagaacgccatgtggcgacttgagagcgttttgaggaagtttaatggacttttagtatataatagaagatagatagatttgtcttgaaaaatactttaataaaagtatacatatatcacatttcaataaatatttttttatagaaaaaagaagtcaaagttgtattttggagaccatgtcactgtccaaaacgatttcctttacaagtatggatagagtacataattagggcttgtttatacatctgaaaacaatgtgtaccttaataatcagaaaaaggacacctccttggtgtatcaatcggttgtactgtagctacacttatggagtacagtatagtacgtatagctgttaccatcgtattcgtatatatatacatacgaataatattactgcacgtacgttggggggaatgcatgtactactacattgttaattaacgtactaatgaaagtacttttatatcgcaatacaaatctgcagtaaaagtatacactacgtaccatgtgaacgtgcacggatgagcacgcagtccgaccggaacagttacatgtgatgaaaaaagttg

SEQ ID NO: 54386 - DNA, 1501 bp, Oryza sativa
acgccccaattgaaaaagaaaaatctcgttcaaagaaacaaaagaaaaacagctgtctgttaaaaaaaataaaataaaacagctgttgtgtttgatggagtagtaacgttgttagaatcaacgcaggtttagccgcacgtggaattttagcatgtgctaactggcaagtggcaaagcatgacgtcatgcacgcatgcaccacaactgctagcaagctatattaatccatggaggaccgtatatgctaatggaaatcccaacccaaatacttattcatattcgctatgttacatagacaccacatatataaaaaagtggtttcttacatgtgaaatatttcttcgtatttttttctatcctctcattaactctcttactccgtactagcttattttttttcacttataggacggtatttacaggtacttgttacaatattacttccttagttacatattaaatttgtcagggttacggataaggtataccctctatcattggatgtaaattgtatacttgtcagagatatgggcccgggggtatgcgaagtgaggggaatctacattcccatcctgccatgtgtcactacagcctggtcctgcccccgcattccgcgaaccgtaggagcggccggggggtcggagcctcggggtgccacgtcatgcccctcgggcccttgcgccgctttgccccgaggccctcgcccagccaccatttggcggggagagcaagcgaggaggggggccctggctaaacctcctttaatgtgcgcagcgccccaactgccccctgtcgcatttaatacagtagggcagacgtgcagcgtgctaaactgacgcgtgatggtcaagaatgaccggtctgtgactggcctgatgccggtcacgtctgactggacggacaaccgtgctcccacgttgcatctgcttccggcggagtggaggtaggtatgacccgtcccatcggagggtcattcggatggcggccattgcaagtattcacccattaatgagggaatgacagggctatcccccgtgtcaggcgagggacggcgctgggcctcgctcaaggacaagctgtggtttagcttccaggcgaaggcgcgggccaagttttggtcaagatagggtgggtccccacccaaaagaagagtaggtagatgcggtgcatgtggtatccccttgaggtataaaaggaggaccttgcccaccgaggaacaggacgactctcagaaaacctgagctcgtggaggagggaagtaagagtgttctcccgagtctaggaactcttgtaactctcagtctaaatcccatacacaggagtagggtattacgctctatagcggtccgaacctgtataatttggttgtgttcgagctagctaggagccttgggaacgaatgcgtgatttctagaggcgagctttttcccccagccgaactcacgaaaggggggtctcacgatgtcccgctagagaggatcactcctcgacaatactgata

SEQ ID NO: 54387 - DNA, 349 bp, Oryza sativa
gccacccggtgctgctcggctgcccgcggacccgccgcaacgctcacccgccgctcgccaatcgccgccggcctcatccactgaagaagaagaagagaaagagaagagaaggtgatgaaaataaaagaaaagaaaaaaaatatgtgctactgacatgtgtaccccacatacttttttaaaaaaaatttctgactaggataccatgtcagcgaaaccatccacagatactgccatgggacctcctttgaacagtttgtgtgagtttaggggtacacatttctagtttgtgtgatctcaaaaattctcgctgttaagttgaggggcctccggtgaacttattccgcataga

SEQ ID NO: 54388 - DNA, 1501 bp, Oryza sativa
atttggtccatccagcaactgaaatgaactgatcgatcgatgatgaccatatatgctcgcgatcgagaggcatgaattgatgagtcgatcgatggatggccgacccagttggagagagatcgagatcgggactggatacgagagagccatatcagctagcggcagcagagagatatagctaagctgcgagaggctcaagatgaagccttatccgtcagagagttggagtaagatcgtatcacaggcagtacagtttcagatagggatcgatcgagctgcaggatatatctctatccatcttgccggtgcgtgcgtggaaagccctgcacagggatgtgggtgtctgggaatttggctagtgctgtgctgcatgtgtgcattgaggagctttgctttcaacaagatcaccaggagatagagaactgtacatcatgctggaagcatttaagatacgtagtatatagttatattcctttgtttcattgatttttggtatgacgtttggttattcatcatatcaaaaattaaaatacatgtattatttattttgttgtgacttgttttttattaaaaaaattaaacattacttgtacttttttagtatttacatttttttgaataaaacgagtgatcaaacgttgtgccaaaagtcaatggtgttatctgttgagagatggaggcattaattgacaagtactactcttcacaaagttattattccatgtaaaagtaatgcatataatacatgtgaaaatcaggtcaccgagagaagtagtggctgttgaatatattatccgctggacaattttgcaatttagggatacctgactgctactactgcttacaaagttattattccatgattccatcgcatataattcaggtggaaataaggtcaccgagaggagtagtggctgttaaatatattatatccgctggacaaacttgcaatttagtgtagctaccactttgctcttttttctttgaggttttctcaattgttttttatttcaaaagtagcaacaacttggagtttctgcttggatggttaaaaaacacatgctaaaaaaattatccgatcgataccgggggctcatcctgaaccgggagagagaatgaacaaatccccccaacatgccatgctattgtcatggacgcagcatgagaaaaaaggcccaaaagtgtggccttcccggcaataggcaagtaggctcgcgcgtagtttaaaatccagtggccacgagtcattcgagccccgtctttcgcgagtcccaaggaagattttcgcaacagcggagatctcgttccagaagcggctcgctttaaggtggcagtggcagctcccccccgcccgacgcgacatgcgaaatttcagtgctcgatcggatagttgttggcgccaagctaattagaagaaccggccttaaatcatctatagtcatatagtcaatttagtagttaattcattcaatagctatctataaacatatactccctccgt

SEQ ID NO: 54389 - DNA, 1501 bp, Oryza sativa
attgatatatatgaacgatgactttcagtaagataaacacggttaattacgtgttcgatcagccatatgttattatgcgtgtaactatggaaactattctaactataaaaattaagaagatgtattaatatgtgatatatcaatcaataaatatgtaagtgtaaattcaacttctacaaatatcaaccaaaaaacaaattaaactatatctagacatctagttaatgtatattcacagttaaatttgttttttcattgtgacatgtagatgttaaattttaacttgcatatttttgagtaatatattacatgccaatatatttttttaaaaatctttcatgactatttaagtgacatgtaaataatgagaggatgtttcctcgagagtttaaaatacactatagtatatataactatgcttcggagttcaattctatgatttctccaacatttccaaattccagtcgaggacgtgtacggttgtaaattaattgagttatactagcatggcgcgcgattaatacatttggacgaacacgcccaacaaataaccatgaccactctatcacggcgcattaacaagaaattaactgtgaacagtagtcaggtcgaatccttaaaccttagcggtttggacaccacatgctataaccttagtgcttaagaacttttaagaataccatagctctgttaatagacctgatccagcactggatttatcctaaatccaatatccaggccaaaagcggtcagcttgagtggacccacccaatacttgcaacagcactcaatcgactacgcatgcatggaaagtcaaggattttgtaattagattccacgtgccaaatcggaatggaattaactaacccaagcagatatataccctatccatctcaaaataactcaaccgagaatgagatatgattcatcttaaaacaaagaatctgaacatcacatctcattttaaattaagttattttagaacggagggagtaaactacattattaaattgtgcgggagaaagtcatcatactttcatacattcaagcggtcaagagcctccactatcattatctagagtagtggaccgagcaagcatagatcctctagcaaattaatctgtcaaagaacttattattatatcacgaagaaaagacttccattctgcaaaaaaaaaaaaaattctagagacgtgcaacaactgagttagctggcacgtagtaccgatgaaacagcagagtggagaccgcacaaaacagaaaagagatgctcgcgtacgtacgcacgatgcacgcagaagctacccgtgcacgcgacctcctcctccttgttcctcgttccctcctgcccgggaaatgcatggccagcagcagcggcagatcgggtcatcgaggcctgcgttgcagccgatcttgaacggatgacggaaatcttaaatgaaattccattcaacgcgaataatgggcgcacgggagcacgcaaccgtccggctcgaccgat

SEQ ID NO: 54390 - DNA, 1501 bp, Oryza sativa
caggtcaggtataaatctagttgtactaaatgttcgttttaattagcgatatggaattatggatgtgagtattgaagtacctgtgtagaccatgactccatgagtatgtaaagatgtgccagggtagaccgcatgaggtactgtggtatcaaaggggtgtggggacgatcacgttgtgctgtctattttttctgccacattttatttttggctgggtgcagtggcgggtcaccaaataatgggatcaatgctaatttactacggatcaatttggtacctgcaagcacacttaggcctagttacagatcagaggaagaaaatagcaaaatcatggagcactacttttctactacagtattagtatggggtaagttttttttttggtacaactttttttgaaagatagttatatgttattagagggcacattatattggcatatttgccactagtagtatttctgaatgtcaaaattttttaaggcgtgtctcaagaggaatggatccatattaattttaaaggcctttgttacctggtagagactgtcataaaatctcttcatttacacgtccacatgtgtacatcctttgggaattttgatatgtactacttccttcgtcctaaatataacacatcctagttctacaaatttaagcagtcctcctatacaaatttacaacactataatgtgtcacgttttgtagtaggtttattttcttaacagaggaagtagttcactagttctctacttgcacatagccagaagttggctttttttgggatagagggagtagttcacatgtgagagtacatagtactggtacttatatgtgtcaagattcattaacatatatataaatatagacaatcgtagaaagttttataatctaaaacggaggtaatactattttagaggaagaagaaccttttaaaatgaatttctttcgtacgtgaatatatatatatatatatatatatatatataatatacatacatatgcacaatttactactccctttcttttaaaataatttatattttttaaaatttaataatcttttgtatgtaaatctggacaagtcgattgattttggaacggaagaataccctaagaaagtacactcccctgccaatgaagagaaaatgagaaaacaagtacactgattgttattagtatatttaaaccaagtttggtatgacttattgtgtgctcgaaaaagtacggagacagcttggccaacaagtgttctttttatgattaatataaatagatatcaagagaaaagttagctgtcaacttgtccatagtgttacattgctctagccttgtcacgttcaaatactgtttgccatggcatttgcaaggagaagatgctgttcttgatttctttcgcatcattatcatgatgatcatcaagtcattgtacatacatatatatactcgatgattgtaaacgttaccataccaaccaataattatattccgagataggatccgga

SEQ ID NO: 54391 - DNA, 1501 bp, Oryza sativa
gtttgttaaaaaatcaacggtgtcatacattaaaatacggagggagtagaatatagctgtaatttagtacactaaaaccaatatgagaggttagatcgattaatgttagcatggactaggctaatatatttttatgttagccttaattactttgctaattactttgttaatcaagcaggggacgtactactacacgaggcggagccccggtacttgcccgttgtggtcggcccttggctacacccatgacggttatttcctacccgtataataaattacccatttaacacatactcagaatacgtacccacgagcatgttctcttttggcacatggacactaaggatgtgtttagttcacactagaattggaagtttgattgaaattaaaacaatgtgatgaaaaagttgaaagtttatgtgtgtagaaaagttttgatgtaatggaaaatttagaagtttaaagaaaaagttgggaaactaggcctaaaagataggagagaaacgataaaactttgaacatgagagtaagtttaatagtatagtcaactactaactccaattcatctatagccaatcttatagctcattcatacaataattacatactacactattaatatatagtcccacctgtcgtatacatactacgtcttggagtccgtgctacagctggctataaatctgtagaccgctgcttttctctctctttatttatcttactaaaatatgtttgcagctggcttatagcctgctattgtatctgctcttatgtgcatagtcatacgtcaattactaacttagagctagcatctcaatcaaagtggttacatacggaccatccgatttgatatcctacgtgtgaattcgctcactaaagttgcacattcgcctcaattgagcttccaaaaaccactctcgtctgttccatttggtgctcggtgtaggtgacagtgtcgtaggtgacgttcttgaggaagatcttgatcacgccacatgttcctcgtagatgagcctggagatgcgcttgggcatgccgcgggtctcctcgtaaatgaaactagatgataccccgcgcgttgctgtgggatatcgtgcctaaataactttggagaaatgggcacatatatataataaagatctatacaaaaattaacactgcaagctagttttcagtggcatgcataatttctaatgtcaacctgcttagtggagcatcactgcgtacggctgcaatcacgtggatgaaataaatcggcaaaatctaacgagatctctaattttattgggtgcatgcattatatttattagattaatccaaactataaggtgataataattatttcttagtttttagctaaggtggttgtgctttatattttggaatggagggagtatgtaataattggttatagtttatttgaaataaagaccagaacaaaaatagtatgtgtggatggtgtgtatacacgtgtacaatcttctatgtaaccataaaaaag

SEQ ID NO: 54392 - DNA, 1501 bp, Oryza sativa
cgacatgttcctgctgattcctgactgttcacgtgaccctatctaactttgtcagttcgacatgttcctgctgattcctgtagccgtacttttttatatttttttagaccaactacccagttcgacagatggctgtcgaaccacggttgttcgacagggtgctaaacatgcgatttcgcctaatcgacctatatttttacaatttttcattaaaatcgtattatttccaaaaaaattcgtgtttaaaatactttgaataataaagtaagtcaaaaaaaataaataataattccaaacatttttaaataagacgagtcatcaaagcaaacaaaaactcaaaatcccttatattatgggacggagggaatactttgaaaactatatagtatcgttttttttttcattccatgtttgcattagcttcatttcggttgtaatcccagagtttggccaccgttattttaagactagccactggaattttagattggaaaagaacaccggtccattttgcaactattgtgaagtttgccggtttaaagtgaaaatctgcaaactagataaaaatttgttcccaatatgcaatttactcttattataatctttcagaaagactggtagaatgctggcaagtgcttaaacagccggtttcaaagtctttccaacatcttgatcaatagttgacaagagtaatgctatctgaattctgaaggaatgctcacacttgtataagaatgaacatacagcagtatcttctcaaaaaggaacaatacaacagtatcctcatttgcggcttaaatagcatcgcaaattcgactgctgttcatacaagaacctcattggacaaggcaaaaacgagcacatacatttggctcgcaaaatgccacataattggctctggaaaccgagaagataaagcacttcccttcagaacatgtgtgcttctgattgcgcagatacggatgagctctgaagtctgaactgataagccctgcagctagtagtagtgaatggcagctacctcagccgtgcttgcactttgggcaaaatggaatgcacttttattgagagcatttgttgctggatgattctgttgaactcagatcatgaacgcagacagaaggcatacgcaaatccaaacatgctcagataaggaagctggcaggtgcatccacaattttgtgagaatcagctccgagaggttcgtctagctgcttttagtgctgcacctgaaaacttgctcccatctgaacgtctgacggcgcttttcatgggtttatattcgaatgtgctaatatcaggagggctgtccgcagtgcacatagctttgcgcgtgttttcactctgatcaaaacggctggtggtagatcttgttggtgcataagcaaatgttctcaggtcaggaggtccagcagcagcatctgtagctttgcttgtgatcttcccctgatcagaatgagcagaagcaacttatgatgtttctcatgtccttttcttcaga

SEQ ID NO: 54393 - DNA, 1501 bp, Oryza sativa
gaaatttgagtgactaattaacatcaatggcccacttgaagtacacaaatgtatagcacggatttttggtcagtactacctccgtcccaaaataattaccgtcgtggatatccgtacccaacgtttgaccatctgtcttatttcaaaaatttgcgaaaaatttgaaaatatttagtcacacataaagtactatttatgttttatcatctaatagcaataaaaatattaataataaaaaattttcaaataagataaacggtcaaacgttgaacgtgaataatgtaaaactgcacttattttgagacggagggagtagtactctttcaagattgatttgtttcctggcaactgagcatgcaaggcaataatcaaattaaatacagtattaattagtcgtaaggtcgtgtgtcaaattgagagtatgtgtgtatgcatgattcttttctagcagtatcattttcgaattgaatttgccggttgcttgcatacgcgtacctggaggactaatactgttctatcatttatggctttgagaaattaaaacaagactgccaaaacccaaaccagttcaagcattcaattcaaagcgtgtatttaaaggacccgcaattaataggtacatttaatccctacattggccgcaggaattgattgactagctagctagagagacagttccatgctctctgaattccgaattaaaggaccgttgtacagtaaactgaattccgagtactttatagtagtatagcataaaaaaaatcattgttccagttcctctcgcatttttatgatagtaacagtagaattgataaatacatttgacaatattaaggttagagcaaggataataatagagcccacttcctactattagctcatcttaaagtcaacatatataatagattagctataagagcaggtacaattgcaggctataagctagctataaacatattttaaagagataaaggaagagagagaaaagcagcgggctacagatctgtagccagctgcagcacggactccaaaatacaatgtgtgtatgataggtgggaccaggtattaatagtatagtaagcaactattgtatgaattggctattacattgactatagatgatttggagctagcagtgggctatactattgaacttgctctaaggttggctacaattttcttctcctctctctatctctcacttatacatttaatgtatttgtcttggagcttgtgataagctagctcttgcattagagccaacatccttaatttttcactacctctctcctccacctaagtttatagtaggcttatagctcactattatacttgctcttagaccctgtttagatgggactaaaacttttaagtccctatcacatcggatgtttggacactaattataaatattaaacatagactattaataaaacttatccataatcttggactaattcgcgagacgaatctattgagcctaattaattcatgattagcc

SEQ ID NO: 54394 - DNA, 434 bp, Oryza sativa
acaggacatatcgaactttcaaagttcgacaggttgcggctacaggtggctgtcgaactacggttgttcgacagatacctctgtcgaaccacggttgttcgacagggtgctaaacatgcgatttcgcctaaccgatctatatttttgcgatttttcattaaaatcgtattattttcaaaaaaaatttcctttaagcacaacttttcgttttttatatttgcataaatttttttaataagacaggtggtcgtaagcaaaagctcaaaatcccttatattatgggacggagggagtaattaatattcaatttcttacttatccattgaaatatactccatataacaattgaagatactgcacgaatctccgcgcaatcagccgtgcagattcccctactatcccggccagggagtacacttcggtggacatcatca

SEQ ID NO: 54395 - DNA, 1501 bp, Oryza sativa
acgtgcttttagaaatccagcggatagtacaatggggattcatatgcggatatggtatctctaaaattcggcggatgcaaattatctaatatttttgccagattatcggatagaccgtttgtcggataatccaaaattatcaacccatataaccactctatctattttgtataacatgagctgacccatctaatggcctaattcatcaattaacctagatttctttgtcctcaacgtctatctcacacttgattagctgtatttttatattattgatatcatgcatttatgttttttaatacataaatacataattattacgatgggtcgttcattgattattgcattgtagatccttgtgttactaactcgatggtgtattggttgcatacacaataacatccgataaatttaatttattttcgaactaggtctgcactagatatgatataacccctgtccgtccgaatctgctccgtattcacccctaactaaaatcgagaattgtctccagttttaataacaagcgaaattacaagacgtatgacccggttatccctgtataggtgcaggacagtgtgacgtgtgcagcatacacgttcgatcgattaactggacgctcgtgcaggcagtactactaccaccgtccccaaataaatttatttatcacatatcacacacacatatcaatagaaaagaaaaaaaaaagctagaatatctctactttatcaaatcccaatacaactttaatcagtttatctactttcatccaattattctctacttttataaatttcgatgcaatgattactttaataatgaacttattttggaataaatggaggaagctaaaaatgaactttatcgacgagggatacccgtagaccggatatagagggtattggggtccgttggtacgagaatctacgtaatacaacatcaagcaaacaaaagacaaggattatactggctcaggccccttgataataatagccctaatccagttggtatgggattatatgaagaaaatcacagattataaagggaataacaaaactcgatgatactgacgagaccgtagtcgagttggtccgactagatctcccggcgacttggctcctgtaggctccgtaggctgtggtgggtatgttggcagtgatattcgatgctttaggtcctgcccagggggtcccttatataccgcaggtcagttgatctccaagtaggactcggagatatcggacccttcacgatatgtaaaaaacccagtcttgtccgagtagaactccttccatccgtaaataccatccctatcacgtgatagatatctttaatgtatacggggactacccgtatacgcgtgggtataccgtatcagtattgtcgaggagtgatcctctctagcgggacatcgtgagacccccctttcgtgagttcggctgggggaaaaagctcgcctctagaaatcacgcattcgttcccaaggctcctagctagctcg

SEQ ID NO: 54396 - DNA, 1501 bp, Oryza sativa
agaacagcaaccgggatggaatcgggttctggtgttttcggatggtggctggctggctgcgagaggttaaagagaaaaagggcgggggaatatctgtgggcgacggcgcgttggtttaccgatgaataggcgaaaggggagaggaagcggagggctgtgggatcgcgtggggagtgcgttggcgcgcatgcttccgcgggtggatggggtttgatttggttttatagcttcctttcggtgcactccaggcagccggttagaattggagtgcgcggcgggtcaggacaaggatatccttcgtccggagacttctttgcggcggccacttctggtcttgtattaccctcgtccaggagaatgctgtgcctgaacgctaacggattgctttgagcgtccggcttacctggcatctactgttccaagcttctataccctagctagtgcatcttggcactatggtagtatggtccatatccctataatcattcgttaatttatagctaatacactagagaattgcacattgttgtgtattaagaaagaagtttttagtacatgtcgtcccggcgacaaagcagccttaggaaaaaaatactaggggaaatctcatgaaaaaagactaccattgctatacgttggtctaggcgttggctctcctgaccgtgcaccgaagagcagcttcttttgcaatcttatcgaagacgatcaactaaggaaagggttgattgttgatgacccggttgttttgttccttctagatcacctaggctactaggataacaattgtgtcgaagcatcttcttgctgcagggattaggcttctagtgtggagccaccaggctgggaaatggtcatccgcaaccgggaagcagttgggaagatggagcgcagatagaatccaccaccagacctagcgtggctgaagctttgttttgatgtgaatctcctcaacccatccgataaaagaggggaggtgacaatggttcggaaggtaaacgttagatatgagatgtgtagaactgtacttattttgggatggtgggagtattaaatagatcttcaatactactagtagtgattacttaattacttgttgtattttttttttacaatctaatgtgacaaatgcaactattaaatatggccaatatagtaaattttactttctgttaatttgtccaaccaatcttaaaaaggctggctttccaggacagagggagtaggcttctttgtattcctcagggaagactccaaatggtagttgtttggccgtcgtcggctcgtcgcctcgtagagatgcatccagggtttacattaccggttgaccactaaatttcgagctatatcgtatcacggttttcgataaatttcgaccaaatctactgtttaaccttcgaaattctaatcagaacttaattttgagtcatgccaaaacgtcgaaatttcacagaattcgaccagtttttgttggaattgtgaacgctggatgcatcatgattca

SEQ ID NO: 54397 - DNA, 1290 bp, Oryza sativa
cgtgggatggtgtaacttgcatctataggtgaaatatctgtcaggagatagcatttctctaggcgtctagtgtttctagtttgtacaggtgctcagattttgtagttaaaggtggcattgtggtgcgattcattttttctccgtgcaagtggcaactcatcaggtaatttttcgatgagctgcagtggtgtcttttgatcatgaagatacaaaggagaacgtcattagctaacgccatatttgtacatagttttcaccagcaatcttaactcatcttgagcttcgcatttcagccgtatggttgtacatcataaaccatgtaaaagattaagctgaacttgtcttcgacaatttttttcagttgatcaaacatgatagtttatggggaatgaaatttgctcaaaagttctaatgaatgtgtggcatagctcatcactgatgtgtgtatgtaggccaagacgtgtgcattcttttgttctttcaagtccctagtcatccttgtacagtttattttagggggaaggggggatgttggtggtgagggttgagatgaggaagtcggtgaagttatattttgagattaattttgagtatttacaggtggaactttaaagtaagtatggttcctgcgctgcataaagctcagttggcttcctacactgtttgggggcaacaaaagtgatgatttggcaaaatggctcacggacactttggctgtgtccagttccttttaaattttcaacttttccgtcacatcaaatgtttaaacatatgtatagaacattaaatgtgaatgaaaaaaaaaatcaattgcacattttgcatgtaaattgcgagatgaatcttttgagcctaattacgttatgatttgacaatgtggtgctacagtaaacatttgctaatgacagattaattaggtttaatatattcgtctcgcagtttacatgcggaatctataatttgttttgttattagtctatatttaatacttcaaatatatgtccgtatggatcaaattctttttaccaaaacaacttacggcctttgtaactgcagtccgatggaataagaaacaaccgctcgtttttgttgcgtgataaggttgtaacttgtaagggctgcagccgctgactattctcgcagcgcataattgcgtatcagagctccagatgacttagcacaagagcacaatgcatttctcgctatccccaactttgaatcaacgatttttttacttctcccatctcacaatatagcaacctaatatttaggataaaacatattgtactg

SEQ ID NO: 54398 - DNA, 1501 bp, Oryza sativa
aaatttcgacgttttggcatgactcaaaattaagttctgattagaatttcgaaggttaaacagtagatttggtcgaaatttatcgaaaaccgtgatacgatatagctcgaaatttagtggtcaaccggtaatgtaaaccctggatgcatctctacgaggcgacgagccgacgacggccaaacaactaccatttggagtcttccctgaggaatacaaagaagcctactccctctgtcctggaaagccagcctttttaagattggttggacaaattaacagaaagtaaaatttactatattggccatatttaatagttgcatttgtcacattagattgtaaaaaaaaaatacaacaagtaattaagtaatcactactagtagtattgaagatctatttaatactcccaccatcccaaaataagtacagttctacacatctcatatctaacgtttaccttccgaaccattgtcacctcccctcttttatcggatgggttgaggagattcacatcaaaacaaagcttcagccacgctaggtctggtggtggattctatctgcgctccatcttcccaactgcttcccggttgcggatgaccatttcccagcctggtggctccacactagaagcctaatccctgcagcaagaagatgcttcgacacaattgttatcctagtagcctaggtgatctagaaggaacaaaacaaccgggtcatcaacaatcaaccctttccttagttgatcgtcttcgataagattgcaaaagaagctgctcttcggtgcacggtcaggagagccaacgcctagaccaacgtatagcaatggtagtcttttttcatgagatttcccctagtatttttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaagccggacgctcaaagcaatccgttagcgttcaggcacagcattctcctggacgagggtaatacaagaccagaagtggccgccgcaaagaagtctccggacgaaggatatccttgtcctgacccgccgcgcactccaattctaaccggctgcctggagtgcaccgaaaggaagctataaaaccaaatcaaaccccatccacccgcggaagcatgcgcgccaacgcactccccacgcgatcccacagccctccgcttcctctcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgcc

SEQ ID NO: 54399 - DNA, 1501 bp, Oryza sativa
caacatctgaccaagatcatccgtaacgtcgttaccatcagcatccatttcctcctcgcctgtttgatttcctttaaatccaacgtactgagcaaagtccgaaatattgtcgtcttccacttcatcttcttccatttcaacaccttgctctccatgggatgtccaacaattatagcttggcatgaaccccgactcaaacaagtggaaatgaatagtcctggttgtagaatactccttctgattcttacacttattgcatggacaacaaataaaacccctttgcctgttagcttcggccactctcaaaaaatagtgcacgctgtcaataaactcttgggaccgccggttagcgtacatccattgccgatccatctacatgagtcaaaaaaaaatcgtacaaaaataattattcttacaataatgacagtcatacaataattataagataattacaaactgtttcaacagtcatacaataatgacatatctttattcatataaaaatcataaaatattacaccaaataattcttatttactatttctaaagttttaaactaattttaatatgttttacttcttttaattttcattttagtttgttttctagtattcaagattaactttcactatagttttccttctcaactattttataaaaccttctttagcaaatcaactaaatttctatatattctttcttccccacacaaattttctccctcatcaacttacaactaaattttggagacaaaaaagtgtgcaaaacatagctgcaaatgtaatatgacaaaaaaaaacattggaggatgaagttgcaaaccttttaggaacctccgatttgtatgtaatcaccaaaataaattcactagaaattttggcatgacctcccctcttttttgaagaaattttgaagcttgctcgggcagctggaggaggaagaagacatatatatataggggtgggactttagtcccggttggtgttagatcccgggggactaaagatcaaatatgcccgttaccttttttaaccgggactaaagatcatctttagccccgatttttattgcatccgggactattgtggaattcggccgaccgacgaaagatgagtttctccaccagtgtatgagccaccagccggtagtagctaacaccttctacctcttgcggcagctcgtctcctagccgcggggccgcaccggcgccgcctcccttctggcgccccttcgtgtttgccacgagaagtgagccagccagccaccgtgaacagaacgatgccctgcttgttgtccgcacgaaaaaaaccttaaatctataaagatattagtttttggtgaggtacaaccactgcatcgctcctctcgccacgcaatcacggtactgttgccctgttcatgtgcttgctcgccgttcgatgaacatagctatgagtgtttctagccgtccaacgtacggatggagacatcgcttctggtcgcgtattaggttccagtcagc

SEQ ID NO: 54400 - DNA, 1501 bp, Oryza sativa
tatgacgccgtcgactttttatctaacgtttgaccattcgtcttattcaaaaattatgtaattatcatttattttattgtgacttgattcatcattaaatgttctttaagcataacgtaaatattttcatatttgcataaaaaaatttaaataaaacgaatggtcaaacgttagttaaaaagttaacggcgtcatacattaaaatacggagggagtactatatactaaagctgaagtaaaagaaatgcaacatgaaaaaaaacatttcggtgagcttgaaacatcagtgtgggctgattgattacggcagagcgtgcaagcaaaactaaagccgcagaaatgctttacgtattttgagatgaggctgggaaattaaaaggtatgtcgtcacttgaattttgaagtggaaatcggtactacaaacagtacactttgtgctgtacgttcagaccacgcaacatatcacaggtactgtacgtatatatacgtgcgtacaacacaagttgataatcgatcatgacctccttgcattggtccctatagctaactcaatgtcttggatcgatcaacagtataacaacttatagctcgcgcatggctagctggttctttccatgtacgtttggtacatgattggtgcacccgtatcaagttgcaaatccacaacatgctcgcgatcaattgagaaatggaccactcactcagttcacacaccatgtatgtatatatatatatatatatatatatatccaatcaagccctctatagtgtgactagtactgtctcgatttatttcttcttgatgaacactcaatttttttttttgcttttatgaacactcaactatcttatatctcagccaacgattgagccacatgcttacccttacatcatattacttgaatgttggcgtttgatccttatttggtgaagctcgagattctgagtagcggtgagaattagtttaaaaggacatggattttaagctttgtattctaaattctacaattacactaaatacacataattaattttaaaaataagctgcaacggctagaatctctaagccacggatatctcagagctaatacgcccgactgcaggatgcgatcatatccggatcaccttttatacctatacctatatagagagctagatttaacctagctcgcacgaccaagcacgtgtacgcactacgcactctctaccgtgagttaattcgcgcgcgtgcattaactggagtctggaaatggtctctgctggcctggccggccggatcgacccgggcggccccgcgtcgcatcatgtaacaactctcacaagtcgctcgtatccccacccgccaaccatgtcttgtccctcacgtgcgcgcgagcacgtacatgtgagaaaataccatgtcctccgctccgattccccagcgcgcgcccctcgcccggccgaaaccaatggccgaattctggtgggcgtggcgtgcggtgcagcgccgcaggggtcgtcg

SEQ ID NO: 54401 - DNA, 435 bp, Oryza sativa
ttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattaaattatgacgcatttatatggattttaattaaattatgacgcaataatgaattatttttgaaaaggaaaagagaattattgcgtcagcggctagggtttcggtggaccgggcgcacgggcgacggttcacgcgaacggacggccgagatcaatccatccaaaacggacggccgagatcgatcggtccacgaccggctcacggggaacggcaacga

SEQ ID NO: 54402 - DNA, 1501 bp, Oryza sativa
atgagaataaatagtggatcatgatcagtgaaatcgatgaggatgcatcgtaccctaggggtaaaacagatattttcttgctcttaacggaatttgactaactgttgaccgccggcgatggtatgtaaggaagaaaagtagttattcgatggtatattatagaactgagctttgtcaatggtatattgttgaatccatgctttgtcaatggcatagaatggattatctttataaacataagcgaaaagataacatcgcacgagtttaaggttatgtgtatttttaattgtttggtgcaatttttttaattgaatcgcacgaatttcatgtgctccgaagagtgaatcgcgtgttaatatggtttgactgtactggtctcaacgtacctccggatgtagtcaacaatgatgtagattgttgtgctgccggtcgttgctcgcagactatggagttaatcaaatagtaaatcagctcatattacctttttttgcaaattagtttaggccgttttctatcgtacagtgtcctgtttcaaacagtataatacttgttggatactggatatggtattctatcagtatgaactaatatatattagtactagttgatatatatcagtatatataaggctgatacccgttgatgacatttgatatccatcggcatcggttggtgaaggttttattgtgagcgtgggacgcgtattgttgccgctcaggtgatgtatatgcatggtgcatttccctgcgattggttgcaagtggagggtgttaggcagttggctctcgatagtagcacctaatgagcaaccaaacctttctagttaatatattatgaactttcattatttttcaaaccttttaaaattgtaattttacgaataaacttttcctaactaaattttaaactctaaacattttgatcacgtcacatcgccttgtgtggcaaaataaaattgtcataccccccgctagactggtgtgacgaaacaatactcacttttggcagactggcgtggtcggccaaataaaacactggcacaccagtcagttcgacatggtctttttttgtcacggttgacgtggtcaaaatgttcatattcgaaaacaagttttgggagaatttattaataaagttaaaaatttaaatggttcagaaaaataaaaaagttccttagagttccaagtttagtatacgcatagactcatgtaagcatgataattgttgatatggaaaaatatcacctgatgcttcatacaattaaatattctagcacacatcatggtttcccaaaccaccgaggccggggttaccgcgcggtaaccgcggtaactgtggaaaactgtacgaaaccgtgcaaaatttatcaaaagttcaaattatttttaaacttatttaaatttaagaaggttaccatggtttttctattatcgtacccgcggtaagtccggtaaccacggtaaccgcgcggttaccgacggtaccataaaccttgtaacac

SEQ ID NO: 54403 - DNA, 1501 bp, Oryza sativa
gggaaaatggtgagagttccggcggggaagacgaagcgtcgcttggatctcgggatttcttgttaagggtatcggaggtgcaaatgggcctaggcctgaacagtacttcagcccaatacttttaaaagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacaaaagctgtctgggttatttggaatgacttgtttttatcatagtcacttccttggtatgttatatacctattttcattatggtaaatagtcatagcctaggctattagacttattcattaccataatttttataatacttggtgggtaatctttagagttttatattcggatgcctgtccagtgtgttcattcgtgaaccttttagagtgtaaaccactcggactcttttcattatggctaaaaagcggtcggctagcatgcctatttaggcgccgtgtgtgcttttgtcatatgatgcacgattgtgctattatttggtctctcaactatatgtttagttcgttaactaatcacatagttgggggctacacctaattaggtgcatctattcgatgcaccatatttttatcttttcgccctttacagtctttgtcttcgctactcggcaggccttggcatgaaaagtttgaagcactcggattattatctttgagaaggctacgatgattgactgcaaaggtctcgggggctactgtggagattatggatatcccatatctacacggcgatgatatttggactgaatataggataccgaatatagatagaatatcttatatgtatcctgggtttgtttcctaacttgtatatcaaggaaacaccttaagacttagtcggtcacgactgtattccgttagggacatagattatcttttgtaatccggactccttcttatatataaggggggtccgggtgcctctaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaacacaggactaaaaattttccaagtttgttgcctacggactggacggaatgcaagtctgaactttccatgcatcaggcacgattttccacggcccagagtacgtaccaggctagcagctgttctataaatcaacctcgtagctagcaatggataactcatcacttcagcttcttgctcatccaatcctacacgagaacctgtgtctgatctagcggcggccatgg

SEQ ID NO: 54404 - DNA, 798 bp, Oryza sativa
ttttttttttgttgccctccgctcgctctcatctttcgtgattcccggcgttcacgatggaaaactaaagttggcacccgtgttttccttttctgattatatgaggatttcgagaattctcttcccattgtattgtcactttcttgtctgctttccttcatcttttgggttgaatcgatcagttgatgtcgtgaaatggacggcatgaaaaacatcaatattttgtagaaaccagcatcaggcatcaggcatagcatcaagtgcacattctaagaaatttttgagaattctcctcccatggtcttgtcacttgctctgctttccttttatctttggttgaatggaacagtcgatatggtgaaatggacgccataaaacacaccaatagtttgtagagaccaagcatcaggcatagtaataagtgcactgcagattggttcaaactgacgatatctctgcacgaacatacagaatagctcaaggttctgatatgtacaactttcgatggcgtcaacgggtaaaggggaaatggggaactgtaaatgaggaaacaacagttatacaacattcctctttcgatgcagatgatattgttggtacaccactgatgatatcgtttaatccagaaggcggttctctgaataatatgtgcatgagcatcccgtcgcttgctttcacgcaactgttttacacattctgaagggaactctggtggccataggactggagccctggaggtgatctttctaacgattgattggttgcaccttacttgttcagaaaggccttcaaagaaaa

SEQ ID NO: 54405 - DNA, 1501 bp, Oryza sativa
atgccatattcttttttggaaattgctaaaaaatgtcgcgagttttttttataatttggcaaaaaacttttaaatgtagctatattaattatagttatagtgtaactacaatggtagacattgtaactatattataatctctatataaattagatataaataaagttacatatattattttaatacttatataaaattatattatagttatagtatagttatatggaactatattacaattgtactttagagatttgaaagttttttcccataaaaaaattgcggcaattttttagataatctcttttttgttaccttattccagacacttttttcatgtgtgattgctacatctcgtttcttttagatgtaaggttttttatgtttcttctatttccttttttaagtaggtcatcaattatttttatctcacttttattatattgtatggattagcaaaattgcatatgcaaatattttaaattttacaatataatataatataatttacagcgtaaacaattatatgtttttttttggagttgtgtgcgattggggaagggagagataggtgtgcatttatggtgtaccttctgcttaggcattttacaacgatttaatgacccggagattgtatttggatatagtacataaaaatagttgggaatattcaaggattatgatcgagtattgatgagaaaattttttattattattgtgctcactaaaatgtaacacctgtcagtctttcaaactaaaaaaagctcccaaatgggactactcaatttcaacgaatcttacgtaatgtgtagtcaattttagtagtctttagaattgtaacaaatgcaacattgaggagatagagccgtccatgttggaaaaaagtagaactgtccgagagtttaacggcttcatcgtttgctcctcttataagtcgtagataagatttacattttaaaacttaattttaagttgattttgatgtttttatcgtagtttatttttcaacatatattaacttacaaatcggtagaaacagatatataaaattttatgtacattttatcattaacaaatgtcagtcttatattcgatcgtatgagaaattataagactcgtcattatgttgctaaatcaacgtagtaagtttagtctctttatcatgctgatcctctatccacaccaggacaatttttccacttttttgtttttttctctaaacaaatcacacattttaatatgtctcccaggataagataaagtgatgtatatatccacattagcgtaaggtcggatttaatttggtacctcttaactccctttatttactactccagagacagatttagtatctcttattctcctataaattcttctgtccgactgtccgtattggaacaaatttgttaccgtcaaagatttttcgtcctgacaagaactgaagttgcaacctgcaataatcttgcctttgtcaaatcaaaacaccacaagtagtcaatgg

SEQ ID NO: 54406 - DNA, 1501 bp, Oryza sativa
cctaactttcttgtgcaacatggatttaggattaaatatagcccttagaaataataaattaataattatggggtttctggaaatttccgatgctctgttatcttggatggaatttgtaacttcatttgaaatagttggtggttaaagcagataatatggattgtatctaatctatcatgaacatgtacactgtgccagtattaaaaaatgcatctgcattccatttgtctagtcgcatgcacttgcatctaacgcttttgttttggtttctttcagcgatttttagttttgtgttggaaggcaatgccctgaaggctatagacctgacagaagagttggcacctaacttgctagagaatgatatggatttgcattttgatcttttaagtcttcacttcattgagttagttcgttctagaaaatggtaagtagctttatttttggaaaaaaaataactgtgccatgtattttggattaatctggatgttttgactgacagcacagaagctcttgagtttggtcagaaaaagttgacgccatttgggaaagtgcccaagtacgttgagaaactagaggtaacttttcctaaacctacatatgcttatattagacagttttcaggtcatgcaaattctgtcttcttgtcaggccatcaatttagagaactggcaatgatgttaaagaacttcactaccatttgttacccatacaaaagaggcaaaacaaaaatattggtcttgaaaaaactttcagtatggtgaatctagtttatcactatgcatgagatatagatttctattcaagtacttagctacttgcaaaacagtattggtacctggcacaccttcatttgccctatgttgccgccttgtagatctgatttgtcatcaaagttatgtcagcctgttttctgggctatcatgtattttgttatctttattaaatacatcagatttaaatggcagcgcggtttttgtattgcatttgtttagtaattgctggtgctatactgtcctatccaagtaccgatgctaggtagtccatcattatcaacgccggccattgggtattatatttattaaatgcaaaatatggtgaaaacgtttgaagtagaggtgccgcttaacaaaataaatatggaacatatggtgacatactttttgtgtattgaacttatgattggctgctttgtaatgctatgcttggaatactatgaaaagttaacttttgttttatatgtataggactttatggccctcctagcttatgaagagcctgagaagtcacctatgtttcatctactaagcccagagtacaggcagaatgttgcagatagcttgaatcgggctgttcttggtatgttctaagatattgttcttggtatgttctaagatactatttgctgtggtctcatccgctgatgacacgattgtgatctttgtctcatgatcaatgacagcacatgctaatcgaccagcatattcatcattggagagagtga

SEQ ID NO: 54407 - DNA, 1501 bp, Oryza sativa
gacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatatcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgattgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttatattctccagatcaaactaaactacatcttacaattaacactactgtctatgtctcaattcatactattatattctatgctctggatctacacatatgtgttgtgtgctacagatatactaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgtgcttta

SEQ ID NO: 54408 - DNA, 1501 bp, Oryza sativa
agacttgcattccgtccagtccgtaggcaacaaacttggaaaatttttagtcctgtgttgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctagaggcacccggaccccccttatatataagaaggagtccggattacaaaagataatctatgtccctaacggaatacagtcgtgaccgactaagtcttaaggtgtttccttgatatacaagttaggaaacaaacccaggatacatataagatattctatctatattcggtatcctatattcagtccaaatatcatcgccgtgtagatatgggatatccataatctccacagtagcccccgagacctttgcagtcaatcatcgtagccttctcaaagataataatccgagtgcttcaaacttttcatgccaaggcctgccgagtagcgaagacaaagactgtaaagggcgaaaagataaaaatatggtgcatcgaatagatgcacctaattaggtgtagcccccaactatgtgattagttaacgaactaaacatatagttgagagaccaaataatagcacaatcgtgcatcatatgacaaaagcacacacggcgcctaaataggcatgctagccgaccgctttttagccataatgaaaagagtccgagtggtttacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaataacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgcttttaaaagtattgggctgaagtactgttcaggcctaggcccatttgcacctccgatacccttaacaagaaatcccgagatccaagcgacgcttcgtcttccccgccggaactctcaccattttccccactccttgctacagtgtagaactgcgccggcgaactagggttcaccactccactcaaatccaccttcgaaaagtgcatcaaaatccttcccgtgatccaccgccttaatccctcatttctccctagccatccctcgaatcaaatcagcgcattcggataaaatcga

SEQ ID NO: 54409 - DNA, 1501 bp, Oryza sativa
gcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcaacgttcttcggtctcccgggcttggcgttgctcctccgtctcattattggccatgaaaacgccaaagtagagaggggtgtagttgtcatctaggcttccgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgctgtcgtggtggagacggccgctaaatcgtcggggagcttcatcaggactggtgggtaagccccatcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggat

SEQ ID NO: 54410 - DNA, 1501 bp, Oryza sativa
aaatatagcaaacgttactaatagtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccatgccagcctccgactcgtccatatcgttgcggatgcgacgagtcctcctccttccagccttgcctcggagcttcgatgggtcaggaatattgagtacttcatcgttagtctctgtaaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgtcgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaatttctgccaaatttgttgtcattattccatatctagcaccacctgtgtcatacgccttggcccatttctcttttggttcatgcagaatccactgagaaaatttccgaatctccaatccagttcttctaaccaatgttggactatccattgggagaggtcgaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgtttcatactcccaaactgcaactcttct

SEQ ID NO: 54411 - DNA, 1501 bp, Oryza sativa
ttctagttacataaaagttggataatataacactaaaatagccacctaatgcaccacctagtgcctaattgcagttgctacacggtgcctagcgctgattttagaacactgaccacacctttagcctcttccaagtcccagagcttgatggaaccatttgaagaaccagcaagcacaagcacctctgctgtatcaaactcaacagcctcaactgagccagtgtggcctgataagctctgcacaaacaataagccagaaacacggcatgagtcaaattcaacataaccaatagaagtgtccatcactgtgataggggcacaaaccagaagtggtgtctgtttgccaatggcccacaggttaaccttgcggtcgctgccgccagtgataaacacacggcttgacttcttgccgatagacaaggacctcacttcagcatcatgtgcgacaaattcctctaatttgggtttccatgttaaggagttataaacttgagcaatgcatgcttccaaaaagtagccagtaacagcttccacagctatgatttgtagtcaactaaaaaaggtgaataactgatcaaaccgtatcaatacatagctgtttttttcccggatgaacttcacaatttagttatagttgcttcggaagcaaattagacttggtgattcggaattggcgcattgctaacctaaactgggcactaaaggaaactatttgctgaacctgttgaaacatttagtggtagttcagttccttcttgaaatcagaaacgacttcaaccttggcgcagattgccaagaaagaaaaaggtggcgaaaattttctcgagaccaccactgtcgctccaagaaactacccacaacaacacaagactagaatttgagggaggggaaataatactccccctcaaccgctcgagcaaatgcctacccagattgctccggcaaaccacgattccttcctcctccgagccaaatcggatcaagaaccgggcaaacagaagggcaacccaacgacgcagtagcagcaaaaaaaaaaaaaaaaggatacggagcctgtagccgcgcttctcggggtccatcctcccgtctctccgcccctgctccgagccgctggggcaggccgacgcgctggcagcggagtcgtcgtgtcgccgtcgacgacgagaggggggagagggttcgggatccgagtacttggtattctgagcaggagaagggaagggagcgggggcgagagagatgacagccgcgtcgccttcctttttcctcttcctctctctctctctctctctctctctcgcagcaagcagtgaaaacgagaggtgtggagcggcgtgggtaggtgggtggggggagtgctgtgccggagtgagagagtggagtttttgtcgcctccctttctcccccttcgcctccctttgcttcgcttttgttctcgtttcttttcttttgtaccagagctggctaaagtaaggttctcttctctcgcgttccttgagaat

SEQ ID NO: 54412 - DNA, 1501 bp, Oryza sativa
gttgtgcccaccgcccgatgctgctgccgccgctccgactgtcgtggagttccggcacaccggcttctcctgcctcggagcatgcggcagtggcttggcgtcgacgtcgacgacgcccgcacctccacggcccactcccatcttcccgtcgcccatccccaccacccgcgccctcctccacctcactctgcctccccttccgacttcgcctcctcttccgccactcatctcattcatcccccaccgctaccgtcaagtgcgacgacggcgtgtcactctctaccgagaaagagaaagagaggaaggaagaagaaatagatggaggctgacatgtggggcccacatgtcagcgggctccataattttttttgtgtgaatgacaaatgagtcctacatacatgtttttaactctaatgccgcctaagcgccacatcaacgttatagaccaggtcaacactgccatgtggacgccacgtcaacgaaaccaccatccaaaaccaccgagggagtcaaattacaccggttttatgggccgcgatatccggtattgcagttcaaggatacaaatcagattcggacgccagttaagggagtcaaagtgaacttattccacacaaaaaaaaatcagctcagactgctagaccttgggcgaatgggccaataaggcaataacacactttccaggcaacacagacatcgcaaagagtccccagttcccgcacaacacaggagctgcctgctaaatactacctctgtcatatccaacgtttgaccatccgtcttatttgaaaaatttatgaaaaaattaaaaaaagttagtcacttataaaatattattcatgttttatcatctaataataataaatgtactaatcattaaaaaattttgcggaaaattggtagtgtcaggattagagccggactcccaatcttctggaaatcgatttgcgacaaatgtatttttttcagaagttaccagtaagattctacgaaaaaaaaacgcgtctttacccttaaaaagagcaagagacaataaacactcattttgcaaggattgatagatccgaactaatcaaacactcatttgcaaggatcggagtatctttctgtgatttgattgctgaggtagaggtagacttagggggtatttgggagacaggggctaaactttagcccctctctcaaaaccataagtccctaggagcttagcccctctattctaaatacccccttacccaaggcacccaagacggaggaagaggagaaatcggtggagtagctcgggagggtggagagatggggagaggaagaggataaatcagtggagtaagctctttcagtctctcttgctcctgtaatcctgtccggagaggcggagaggcggacgacaatggaattttttttattttccattttttttattaaaagttttacaaaaataattttccatttttaaaaatcgccatcccagagggcggcgaaaatgacgtggcagacggcc

SEQ ID NO: 54413 - DNA, 533 bp, Oryza sativa
tgataatttcgtgtctggttaatgccattggtctccaagatttctttcgtgatgattgtaaattgattagtcttgatgattggatcatgtttctgcaatcaagtgtatcaaactagagcaaattgttgccgggaggttaagtgcccattaactggaactgcttgaaatgatttgatatgcactactgattaggctataagtgtgtgtaaactagggcgcgagagtggcatattcagttgaaggcttgtagtagctactggggtattctctataacatcatgaccttcttgttgttttcaaagcaaaacatcgtctgctcttcttgtatgaaatcaacgtactgtactacagtagcttagtctgcatatcattgtcatctgatgtgcactagtttacgtaaatttagtatccctgtttttatgttcagtattgtgatatggtggatcacatgccttgtcttctggtatttctggttttaaactctgaaatgcatagttcaaatcaagttatttttctgtaacaagtttctcgtg

SEQ ID NO: 54414 - DNA, 983 bp, Oryza sativa
tattaataatgataatcaagcatgattcgttggtttggagtaccaaaaccttgccaagttttagcactagctaattaattagaatttgaattagtgtgagaaaaaaataatagcaaaccaaacatctatttatactatcattaaagttttcgaaattttgatacggcaaaaaaatcagcttcaatgatcattccaaacatacccgcaatctttcaagatcaaattaaccagatttaagagtaaattacatcagcggtacacaaactggctagataagtgtaatctagtgtatgaacttgtaaaatgctcgttttgatgcatgaacttatttggtgcgtgcgtacaagaccaaaaccgtacgacaatgttaatcttgctgattttgttattgattttaatgctatgtaaacaaatatcacgtagataaagatcaatttagcaaaacatataataatgcatattgattgcatgaagaaaaagataaaaaattgagtaacgatgcaagcgatagtaacaaaggaagataaagtagaaaccaaatttatacatataacctttctactatatgtgcaccacgcatgtcatgtaataatttataatgttcaacttgaaaaatcagccttgtcatgccattttggctttgggatgtacgcactaaacaagttcgtacaacaaaataagtgttttacaaatttatgcactagtagactgcatccactaagttgtgtatcgttgatgcaatttactccagatttaatctacagatatgagatatccaccaaggcccagcccattttgggcgctgaagcgagcactttccactacggcccagcccgctttgggatagcgaaagcgagaaccccagaagcccgtggaagcttcggaagcggcgcggcgcggcgctgggcgggggagaagaccagagcggcgaggaaggaggcggcgcccagcggggagagcgagcggctcgacgccgacggcca

SEQ ID NO: 54415 - DNA, 1248 bp, Oryza sativa
tcatcggcttagagtcagcatcggcttcgaagtcctaagattagccgatgagagttgtcaagtcgtcagttgtcggattcttgatatattcggttaaggaaattgatctactaaaggaagcttatccagaagagaccgagttcaaagagaatacggcatgacaagttatctattaattaggaataatttattagtttccttttatctttaggaacgtgtgtttagtgtcctataaggactttatcttgccttttatctttaggaaagtttctttcttgtccgacaaggacttgtatcaacccatgggtataaatatgtacacccagggtctatgtaatttatcttcacgatcaatacaatttggcgcatcgccaccttttaccttttctactttattttatcgtccggcgggacttggcacctgacgtgaggctgcatcgatgttcgatctccgactaaggggtaagtccaatgttccgccatcccaggcaattgtatcgtttacgtcggcgtcgttcaaggctgcatcagtacattcgacctcttggattgctctggtttggatgatatatttgcctacctatttatcatatgtctctgttaatctagtcttagcatatcaatttagctctatcggctgcttctcgttttagggtttctgccggtattggctaaatcgcattgctagattagattagcttaaacatccaccaccctgaaaactcagtcaacggcttgattgtttagatattatgtttcttttcatacttagtgctgcatcagttaagtttgatctactaagtcgtgcttagaaccataatctttagcctgctttttgattgccaataagggtttcatcggagtttcagccggtgagttatctggatgttgcatcggctcataaggattgcatatacatataagttggatttagccgatgacaacaaaggtttcactgtttaatctaatcttgtggatttcatgatatcggacctccagccgatgtgtgctttaatcttcggatcaatgcttattatatattgtttatagccgattggtttctactggactatattattgttatactttattaccaacagtcgattgcctttatatcatcatctacattggacatatagccgattacttaaaccctatcgctatcggcatcggctatcggctggaactactccatcggcttatcagccgatcggctgttttgatatactatttgcatatattgtcagt

SEQ ID NO: 54416 - DNA, 1501 bp, Oryza sativa
gattggagattcagtcaacataattatattgttacatacctaataaatggccattgtatattggagtattggactacttatctacacattcttggaaagtatggaataattctcttttcatatatatatagtgttacgaatttgcaatgaacaatagcagcagagcatcaccacaacaggttttctttatgacagggacacagtgcatcaaataactgatcttgtaaccagttattgcctggctaaacatgtttccttattctttttgcaatggaacagtcctagtcattttgttcagaaaaatagcagtcctcttaagccagtcttaaagcacaaacctcaacaagttgttgcattgcttctcgagcattggaaacctcatgttctgtcaagttctcaacatggacaccctttttagcatcctctcttatctgcaaatatagctaataatatcactttttgaaacattgagatgtcaaaactgtgaacatctcctaacagcttcttaaaacacaactagcaaacatccgaggacacacaaataagccatgctttttagtactctacctgcaaatttactgaattcggatttagcaaatcaaggatctgctcattgtatatctccaaaaaagagcatttgcaagtaaacctgagtttttcttctttccttatttccttttcctggaacagcaatgttaaaatattttggctgagaagagtacaccactgtaccgcacaagaatcaacaaataatcaaaacttgccttctggattcttaaaaacagatgttcaaacacccgaggcgtcataccacaattcacattgtttcttcgtgtgccattttctatatcaccaagcattgtgtgtgtcttgccactgccggtctaccaaaattggacacccttgtaagcactaagcacagacattgaaatgcaaatttacaacagtatgcagactgctaccctggaaacctaagtatcttgaaatgtcaagtagaatcagtagcttacctgaccataagcaaacatacagctgttatagccagccatgcagttgtccaccatgggcaccccagcaaccttgaacagattctcctatacatccagatgaacatcattcacacatctcgcaagacaagtagataaacagatcgaaatgacacggagaaacaagggcgtgaagagtgtacctgcgtgacatactcgtccgcaacgagatcgaacttgaaccgcgactccgggtggcccgtccaggtgatgctctggcagctatcctgcctgacgcatctcttctgtccctgcaccgatatctcgccgctgctcagcggccgaacacggatcacaacctgttgttgcacccgcggaacaattagtggagctcgaacaaggctaactaggtgctcggcgaaatgctccgatgggcacatcgcgggcggcttgggcctgagctacctagatcgagaggcactactcgaaggataagcttgcgactaggcgagaga

SEQ ID NO: 54417 - DNA, 1501 bp, Oryza sativa
ggcggcagccgcggcagcgagatctagggttttcggcgcctcgggggtggggagggagcgatggggcgtcggaaggtcgccgcggcggcggctgcgacgccgccgcgtggctcgtcgaaggccgggggcggcgtcatatccggtgagatcctcgccttcgccttcggtttcgatgcgtgcggtggcggtagtgtcaaggcattgcgggcttttttagatcggagcttgctgctactgggatgctctgtgaggttgggatcggaactatacgatgggagtgcgatttcgaatggcgctttagttttgtgggatttggaatacctataaatccgaagcatgagacgcagtgtatttgatcggattcagtggtggatcagctagctgactgtgacgtagcgtgtatatgttgcgtcatggttttgttctctcagtgtttaatgcgtgcaaagtctcagctttccccgcaaaaatatggctcccatcggatggcctaatcagccaaagaaaaagccaaaatttaaattttcaagcttaattttgagattgattttgagatattttcaacgtagtttcttttacaacattggctttaagtcacgaataacacatttataaaagttttacctataaattcatttttattttctaataagccgttttggcttattaggaaataagccaaacgatggggacctataccgtctcagctttaagctatacgcctagctggttgtgcacgtgtactatgtaattgagaggtgttatttctgtgttttatatgctatatcatgttgcatgcacatcaccaagaaatgcatgctgtctatggaaagttagtatattctgaactgatattggtttcctttggaatgtgctacaccaagtctgtatttgaggcaatacattaaattaggatatatataagagaatacttgaggtcattgttgtggccaatgtattgacaactgttcattcttcaatgtaatggtgcttactgatacagcgaatcgatgaatagctattcattaatctactggttgaactgcaaagtatatatgttacaactcaaatcagaggaaagctaatcaaatctccaattttgtttggttgcatgtatatacttttaccatttagagtcttgtaaaattgccgcactgcgtgcgccagttcctgaatcttctcccatcctggagcaatgaacttggcagtttaacattggactggttcacttgctgatggcagttccaatctcccttgataactagggatcctagtagggttcttgtgttactactttgatttttatttagctgatgagcaatggctggcaagacagtaaaaatcctctctagttaaggaccccaacatctgtgctttgtatgatctctttggttcaggacttagtcatttgaatattatctacattatacatgttgatgtagttaggtttgcctattatcagagctgtagactaaggtgctatattggaccagtcgatgtt

SEQ ID NO: 54418 - DNA, 1501 bp, Oryza sativa
aaaagcatccctggacggttggaccccatcccgagttccctgctggtgaagtagtacactcaaatggcaggcttacgtccaggttacagtctttcttctcaaactgtgacacagcagcaatccgtagcagagtcatgtcttcctttctcagttcaatactgctcttgtaatttgggctctatacaacccttttagcatttttttttagagaaggatattttttaaccggcctctacatttaaccggatatatacggccattgaaatagggaacttagccccgcaaacaatccaatctgaaattcgctccataggaaatttgaactcagaaccttggggtactactcagatcactacaacccttttagcatacatgacctgtaaagttacttaatgatccccgcaaaaaaagttacttaatgataacgaataatcaattaatcattcgtgatcaagttatattgaagtacacgaaaaagtgttaataatgctgccaaatgcagaatgctaatgccattgttctttatggactctgctagtaataagaaacaacagggtcagtgttcttgatggaacctacgaggtttggcatacttttgagttctcagtcaaggaacagcgagtgtacataacggccggcccctaaggaccagctgcaaacaacgaactcactccatttcatctttttctatttattattgaccgcggccacacatacagataagttattccccctctttttttataagaaggaaaataaacagctcgttttcttttcttttttgaacggaaaacggcacgagatagtaccttttcattgaatggagtaggagaaacagcttgctttatagtattaacaggtaataaaaccgaaacggtggatcaaagaacatatattacaggaaggatttacatcatcacataaatggaagagggtaaaataaacggagcaaaacaaggaactttcgatctcgatcggcgattattcctcccttttctacgaggtgggccatcacatcgatcacccaaaaaacctccaccaatataaatactggtttcccccatccgaacacaccgagcaatgatcatattgtaatccttcccgtcgccgagagattcccacacaggctaaaactatctatcaggcctgcaaatgcaatagggctgagaagtgaggaagctaggcaacctcaaccttattctaacagcatccaatcccaggctaacaccttgagccacgcgagctcggcctgtgcctggctggtccttgcaccgaattaatcgtcgcgtgcgtctttgccggcctcgcacatcatctctctcttttcttgcacataacaatttctgcaggttaacctcgtgtgcatgcgtgttttgatttctcgcggttttcgatagctttggtggtgtcgatatcatcgccttccttggcccttgtccttttgtcgccgtcgacgaggacgtgcatactttctccatggagaaaggcgggggatcgcaga

SEQ ID NO: 54419 - DNA, 1501 bp, Oryza sativa
aaaacattgggtttgttcagcaatcgtggttgcggttgcggcgcaaccaacatcaatagtgccacaagtagtagaggaactatggttattgccgccgcagccacaaactcgtctttccgaacacactcattgtttaggagcttgagcaagccacgataatccatcatatttagcatgagtcttaatatactatatctatgccatcgaggagataccacggttaaactatttttaaatataaatttggtatctcctaatacctctatagggttaagatctaaaattacgatatatcaaattatgacaccttaccaatgatactctatttttaagtgtgaatttgagaactaacacctctctaatgttaattaatatcccctaaagctatcatatcccagcatcttctcacaaggacatagaatctctctccaagtatacatcatgatacatattcatgccaccacacgtgatgcattttatagtacacgatacacacatctctcctccttctacaccacaagatctagcattgaacatgtgctgccgatccttgccggtctccgaattcgtaacacatctttgcaacacacagccgtaccaaagtaccgctgctatacctctccgtaccttttgatttttacctctttttttttcttcccctctccctgtggggtatgcagcgtgagagtgtgaggggacaccttttgttgggtgattggctgcaggcgctctgatgggttcttgtttgtgttaaaaggcggtagtgataggtctacatctctggccaggttttagttttttttttctcttgtgggtgctccctttctgggatctttcctttttccaaaccattgtcccccctcaggttacttaagggcaaagctaattgtttaacttgaggttagtcttatctactgaaatactccatccattctaaaaatatatagcacaactactttttaaaggtgtttcataatataaggcatgcatgcatgcatggcaattaattagcatctcttctctcctaaattattattttttaaatcatacactcactagatgtttaattctattgggtgcatgtattgtattaattggattgattcaaacaaagagatgataataattgtttcttgatctttgggttaaaggtggttatgccttatattttggaattgagggagtatagtcttatagtgtgtgtgttttttttccttataatacgctttatattagatgacgatatggtttgaggaaaagcagcgcagacaaaatagttgtaaaagaaagagcagctatctattctaggtaccaaattatacaatacttcctctgtcaaaaaaactcatacaatgaatctggacaaaggatagtccagatttgtcgaggaatgaccctctctagcgggagatcgtgagatcccccttttgtgagttcggccgggggaaaaggctcgcgtgtcgagatcgtgtatccgccctgagtgcttctagatcgcacg

SEQ ID NO: 54420 - DNA, 1501 bp, Oryza sativa
gatgtgaagtaaaataaataacatctccaatttataaagggtaaataagttatatatctagtaaaaggtcttggggaatagaaaatgataatcatatttgcatatggatctcttagaggaatagccatgaaaatcgattttcacatacgggtgtgagaccgtctacaaaattgacgatataaatgttggagatgttgaactaaaataataagagatatctcttccttgatcaagaaactcaatttgaggggttttttatataccggtaaatattcgttaccgtattcgttccgtctcatattcgctccgtatctatattcgataatattcgatttcatttccgtatccgagttttcgattccgattctgattccgaaaaaaaatatgaaaacgaatatgataaagctagtttccgtccgtttccgatccgttttcatgcctaccccatagtcacttgtttatctctattttacaagctcagacattccctttttagcattttattatactatgatttgatttgcttgatttcatgattcatcgtactattgtcttatttaattaaaaatcatgtactccctttgtccatgaaaaaccaacctaatactggatgtgacatatcctaatacaatgaatctagacatacctctgtccagattcgttgtactagaatatgtcatatccagtactagattcgtttttttcgagacgaagggagtagacagattctatactgctttgggatatgtatgcgtgaaaaagaatgaggtgagttaggaacctcaaggaaagaactcagcctaaaggaccaatgatatttgacctaccaagcatttcctatcctatgcataccaactgctatatgggtgtgttcggtggtgggtgttgggaacccatcacacacacggaaaacggagcgatctattagtgcctaattatttaaatattagcttttttaaaaaaaattgtatatatatgatttttttaagcaactttcgtatataatatttttgaaaaaaaacacaccgtttactaatttgaaaagcgtgcgtgcggaaaacgaaagggaggagttgggaactcctgtatcaaacacagcatataaacttttctaaaaaaaaaaagaactactgtatagacaatagacgatataacggcaattgatctttattttgtctgaccaggagtaatattcgttcaatgcaaggttacagacttgcaatcatactatgcggcaaacattgccatgcaaactattggacttgtttagttaacattgccatatacgggtcttgtttagttgtttggtgggccatgtttgaaacaattttttgcgcagattattcagatggattgtccacttcattaacacgaaacatttatattttatttagaaatgaaactcacaaatagattagaataagtggtctaaacaaatacactatataaaatatttttaataaagcatatttttattagaagtataaagcaaataacctgt

SEQ ID NO: 54421 - DNA, 1075 bp, Oryza sativa
aaccgggattgttctgtcgatgaagggatcatttttttttttttttgtgtgtgtgtgtgggtgtgtgtggtgccctatcttacaggaatgctaagttccagggaagcatggatagttgtccaatcagttagcacaatacaccaataccttgaatgcagtgctaccatattttacagagatattagagaagagatcctgatttggagggaagccagcatctttagagaagtcggctgagtgcctgccataaggcggtttctttttctaagttgttctcccctcatgtcaaaaaaaaaaagttgttctcccctcccctctgctcttgggtctcggcccagcctcaacagtttaatgtcgatcttgtaaaatttgtaacaccatctctcatcctaataaaattgggacggcctattcctttggccacctcggcaaaaaaaaaaaaggaaaagaagaagctaccgtatttgataatttacttccaataggttgctaatgtgtttattatttcatatctggaaccttataaattcacataacatgatggtaataatgaatcatgaagttgatcttgttaattatgattgcctttgtgaacaaaataatggccatgataaaaatatcgatacctctttttttttatggggaaccatacctctaaattgtgtgaaaaatcagatctaaagatctaacttggcaacagttttgagtgaattagtacattgatccatcatgacatgttatcctaatttcaggcagaattttatatgcctttgtaaaaacttagtttttctgatgattttaccttgttattactaagagtaaagcggctccgaactacatggttgatatgttgcctgaaatgttcaaggtgagcatggcatgttataatccaagtttactattatgcagtttcgccggctggcctttgtaaactgttttgtgttggttatgctattcttttcatatttttttcgcttactgtataaaactaaattaatgcatttttaatgtaatggttttttcctttgggtattatatgggagttttttttaccaatgttatatgagagttttga

SEQ ID NO: 54422 - DNA, 1501 bp, Oryza sativa
ggagcatgccaatgccggtgattggttcttcgtgcgagcactggcaccgtgactgtgaggttggtgttaaagacatcaccttgggtgccagcaacccatgtcgttctaacttgagcttcagcgagatcgtggaaatgttcaaggaacttccaatggtaaaccccaccataagcatggatgatgatgttgttttcttgctttctagaaccagtcccagtcccatggacaagttgcatttggtgtttgctattgatgtgaggaagaggacgctgcaaggattaaccaagcttgatgtccagccgcagaactccgtttgcatggtcaccttatgcaccagtgagatttgcaggtatctgaggaatattacaggtaacttctctacactggcaattcatcaccttgtgtttttacatgtgaccatatgtatgaatgcaatgcttgccatttttaagatctagggaattattgtttttgtacctttcttgtttcggtagggtctagagctaaattcaggaggcatgccttgtcgccttgatgacagtgtgatgcatggaagactattgatatcagttgttttgtacattgttgtcaaagttatatatcagttaattaaacaaatcatggcaattcaatagaaataagtttgtgaattgtgttgagctgaatctgtgtttgtgcgcaacccatcctttaaaatgacagcaaaactattatggtactattagataattccacagcttagttttcttttattgtggtggaattctgtcaagttggtagtgaacagtactttcaaaacaaatgctcgttgattgagtgaattgcaagcttggctcaacattttagtggcagaagatacgcagccaagaaattgtgttcagcgtgttcttgccataagcggcattttatggtacatgatattggggttttgcgtttatgatagaaaaagtccgtctggattttaacttcaataataatatattcgacgaaagcaacctggatactagtaattgtttcttgctttaaacgcctgtctttctttgtgctagttactgacaatcatgacttgttcttgttgattgaaaaatgcaattattgctgtttcttgttgattttctttggtgcagtcacaggcgaagcacttaatgaactggaaattagctcttaaattggccaggacaaagaagcgtgtcagatgatgcaacttgagcttgttgatttatgaaaattggccgtgtttagtttcacgcccaattttttttatacggacacacatttgaaatattaaacgtagtctaataataaaacaaattacataatcatccgcctataaaatgcgagacgaatctattaagtctaattaatccgtcattagcaaatgtttactgtagcaccacattgtcaaatcatggcataattaggctcaaaagattcgtctcgcaatttacatgtaaactgtgcaattgttttttttttcgtccacatttaatgctctgtgcat

SEQ ID NO: 54423 - DNA, 1501 bp, Oryza sativa
ataatttacaatgtggctaatgcagcaaacaataaaagataccaaccttgctagaactccagctatccgcctcggagaatgcagcataggcaggagaaggagcccaccttccactggtaaattgcaatatccacagtgttagaattcacctccaaaatcatactacatattcaaatgattaatcttaagagaaaactagtggatgagcataagaaaagctcagagacacacaaaggtagcgagcctggctacattttttttgttctcgtttcgttaggtaagggcagggcgacgaggtgcggaagaaaaaaaaaacgaaacaaaatcaagacgcacctgttgctggacgtgctggcgcagctggaggcggcgccaccgtcgatgcggcggaggaggaagttgcggtaggcgacgtagcccttcccgttgcaccgccactcctgcatcaccacccacccacccaatccaacccaattcattcattccccatggccaaaaaaaaaacactacgcgcgccaatgagggatctgagaagaacgagaggaagggcgtaccatacggtgttggagcgccgaggggggcttgcggcggaggaggaggcggcggagggcggcgtagtcgtcgtcggggcgggaggaggaggaggagggtgtcgggggctggagcacgcagctgaggaagtccgggtccgtcggccgggatggggcgggcgggcacgccgccgcggaggcggtggagccgccggccgttgcctccatttttgccccgccgccgccgcgcgcgcgcgcccgccggcgagaggatcggaagatgtggcggccgcgcgagccgcttcggatctcgggcgtacgggagaattagttggcaaaagtcaccgtttctttctcttttttttccctttttcttttccccgtgacgacttgtgtccggttctcgtcctgagtctcctgacgtcttcataaaaggcccatcttctgatgatccccccgacacttcgtaaaaggcccattgggcttcttcactgaaccctagataaaaattccctagcctcttccaactctgtcatctcgtggcggctggcgagcggcgacggacggctcgacggctcgacggcgcgggaggccggcagtctgcgccgcaggcctaggcagaaggggaagccaaggagctaaggagcaaggcaacaaaacaagaaaatggttagaaagagagaggcagaggaaggtcttggcatcacgaagaggtgatatatttgttcgatggtttagaattccagagcattgcaaatttaaaaatgtacaaatttgtgattgtgtaattgatgctaactctttgcatggagataatgtttcatgaggcacactttttttttttcgtcctccgcaactgcttaaaggcacatatagggctatgaaactgtgatggttttacaacggtttttactggttattgacccacatttggcattttttttattgtttctgtgtcagtgttggaaaga

SEQ ID NO: 54424 - DNA, 251 bp, Oryza sativa
acctcgtagttatagttattagtggtcgttttagtggttggataactcggtacatctcgcgtaggggacttgtggccgtccatcagtgggatcatacggtgcaggacagtgccaattgagcaccaggcgggcacgagtcggcttaaccaccgcacgcgccaggcgtgtgtgggcacatgtttcgcagccagcttaatctaatcagcgcttttaatttctttccacattgagaattcatccttggtctcagt

SEQ ID NO: 54425 - DNA, 1501 bp, Oryza sativa
caacgaacattgccccctatgccgctgtgagaatgagatggccttgcaccttgtagccacttgtagatacaccaagagaatttggcaccttgtcgccacttgggtgggccatctgctgctggatccggtgaattgggaggaagcccactcagtgcagtagtggtgggaaaacatggcaaacacgcgcggtgttccaaagaagggacttagatccctcatcctgttagtggtttgggagatttggaaagagaggaatcggaggatttttgaccataaagagatggcaacgagcttcctgctaacaaaaatcaaagatgaggttggcctatgggttctagcaggggctaagcgtctacgagagttcgccccataccttctatagtgtactgtaacagcttttctttttatcctcaggggttgtattttctcccactctattcaatgaaaaggcactatcttgtgccgtttttccgttaaaaaaaaaagaaccggatgcgcggcagccggcaagccagccagccagccgttgggcgcgagcacaagtacgaaatcttttcgaacagtgacgcggatgacgaatatattaccacgcgttacgataaacagataagaagattttgcttgggttatctgtgagggcaacgggggagcactgctttttctggccgagcaaacctacaaatatgccaatccaatccggatgaggaatcagtctatatgaaaacacatccatcaagctctgatcttctttaattagacggacaccatgaccaccagattcccatcgaagctccatccaaggtttttcctccaatatttttcttctggacaagccatgtgtttggacacttctggtagtagcatagtttggacaagatcacaaataagccatgttaatttgagtcaactgactaatgcgcatgctcatgtagtactagtgtgttttgtcagagagagggcacccacaaagccaccactgaccactcgctttgccaagcaatgcgtctttttccactgagaccaaggatgaattcacaatttggaaggaaattaaaagcgctgattagattaagcggctgcgtaacatgtgcccacgcgcgccgcgcgcgtgcgggggttaagccgacgcgtgcccgccgggtgcccagctggcactctcctccaccgtccgatcccacccacggacggccacgattcccctagccgagatgtaccgagtaatcaagccactaaaaccccagctaataactataagtacgaggtgggaaaaaaaatggagacgcgaattggaatataaatagaggcgcgccgcggtcaagtgctaccatccaaatcgaatccccgaaagcgttactaccttcctctccagatactggcaaattattttctttacaaatcattcgcagctagcttagctcgctttgcttgtagtggcgacttgtgaggcggaggaggaaggagatcgaggctagggagatggcgtcgttgaagtcgccggtgg

SEQ ID NO: 54426 - DNA, 226 bp, Oryza sativa
aaatgcatgtgttggaggatcaagtcgggtgcgatctgattcaggtagataaccgggcagtgcaatccttgctgccttacatgagcaagttcatgaaactgttgacttttgctctgaagatcggggcgcatttcattgtcgggatgggggagatgatacctgacctgagcagggaggtagtgcacttgctggactcgtcagtcatgtatggtgcaaccacatcagc

SEQ ID NO: 54427 - DNA, 1501 bp, Oryza sativa
cgatgctggcggcgacgcaggagttcgacgacggcgccaacacggggctggcggggagcgtgctggcgcagtgcgcggcgggccgcgcgccggcggactgcgtgcagtgcctgcaggactcggcgcgagcgatgccgagatgctgctggaacgcatgggggctgggagagagcgtcgctgtcgcgctgagctacgactgcgtgctccaagttcaccatgcacctggcctctccggcggcaagccttggtggaggagctctccgtccgtttgccctcgccgttggagcagcagcgctagcaataatcatgtagtagtagtagtcgtcatgttcgaatcgagtgaagacaatttgcagtaatataaccacctgtagataagctttcatggagtcatggtgctcgatcgagtagtagaaataaatggtcatatgtagtactagggattatgtgttaggataacagtagcttatcatgtgtgttttgtttgcaaaatgctatgcccagctagccgctagcgttacgagcgtccaccgccaacccattctgcagggtgaaagattggacccctttgtgcggcccatggggcggtgaacagaatcaccccgcacgacgcacacgcgttcgccgcgcgcgcgcgactacgcgaccgtgaccgcgacgcgggcatatttgcaaaaaaaaaaaattgtgaataaaacttttatatacatgtttttaccgatctaaaagcaaagactgaaaaataaatttcgataaaaaaacccctcaaaattaaatttaaatctaagatagaaaatttaagttttagctgataagtataagcataagtgaaaagataaggcttttgagggccagtcgtggtatcggggcaaggccgggatgtgccggactgccggtgcgccaccatacactgtgaaactaaaagaaaatctcacaattcacaactatacgttatgaaatagcctgcggctaactcggatgcgtaggaagcaatggtgaccagtttgcctttgccatcacaggagtgaaaacaataactaaaaatagaaatggtaaaaataaaaaaacgattttattgttctaccaaccgtttctttaatttaccaaagtctcatgaaaaatgctacatttataatacggtaatcaccgtatttttaaatatctcaatatttatcgtccatgtatctatgtgacccgtgacccgtagttttgagacccataaatatttatcaaatttctaatttgagtacaaggctagaggagagacaatattatatagtcatgttaagttaaacatcgagtttaatgttttcgatattcattactggtttccgatcgatattgacatggttttgttcatgtagtcacgttttcagtatttttgatatcattttgttttcagcctcatcgttatcggttcgtttccgagaaatatatgattacttaaacggctgatgcatgttgttttccaatcgtttcatccctagacatggcgttgcaa

SEQ ID NO: 54428 - DNA, 1501 bp, Oryza sativa
aggatactccaccggacataaccacatgaggctacccaaacctataggatttgcccacatatctctttgtttaggacttgagaaaactcaccacacttggctagacaagcccaccaaatacacctacatgcatatgaactaataaggcacaagatcatccacaagctcgcttcatagacccctcttgatagtacggcgcctatctagcaaatccggtctacaccaaacatcaagaccgggaaaaggctaagaaaacattcttagctacattatacctttgccttgcaaaatccatcttggggtcaagcttgagtcgagatcaacacttgtgaccatttgattcaaccatgtttataccaaggtatttaccatcatttgtcaagactttcttctcattacaagcttgatttcattcttaccaacatggcgatgtccttggcttggtgaccattaacccatggtgtcatccatcagcctcatcatagtgggacctattccttttcacatctcaaaggagaacattagtctcaacaaatcggttgtcatccttcacttgatgaccaaccggttgcatatgaaagatatggatatgtttcttgagtattcattaacatcacaagtgtcatatactcgtatgcaaccttaagtgcaaagatccgatataaataataggtgaataacatggatctagaacatgcacaataaatgtataggatttgccccccctaaatatatgcatacaaataaatatacaagagatgcaagtgtatgcataattagagaatgaccaatgggggtttatcctatacacatagagaaggcatatgtagtaaagatgtagaccaacataaaacatatacattcatgatctccatgttcttaatgtaaatgagactaaataagatacgactcgagtaaacattagtctcacacttatataacaataacatggaaatcatatatatgaacctatcaaaaagtaggagataagaagtggtacatatcgttttatctccatgcatttcatccttatcatgattaaggtccatcactaaagaatgcatatctaccacatctcatcatcgggaaataacctagttaacaacttatgaaaaagagaggttaatcccataaacatcggtttatcatctatcatcaaagcaacaattacacaaattgtttaatccaagatctttcaatcttttctctttttggtgatagataataacccgatataaacaatatagagagatgggatgaaagatgatttcaaatcaaggtagagatcttataataaacaaaatatataataagctccccctcaagatgtgcatacatatggatataaaggaatacatatgcacataatcaatcaagattaatgacggagctcacactatattttggatccacaagagagaccaagttagaatatgtgaagtttaatacatacctctcatcatttttattttcatatctaaacgagactagttaaagagaa

SEQ ID NO: 54429 - DNA, 303 bp, Oryza sativa
caactccactccagactcaactcttggagctaaatttagaagttggagctgtatcaaacaggaccttagaatcatagtacgcgttagtgttgctcgtacataggggttatgtaggatcaaggaggccgactagagggggggtgaataggcggttttaaaacttaatggcacttaaacaaaactaacctaagttgctaggcaaggtaaggtgcaaggttaactaagcaactaagttaagttttgtaaacctaggtgatataggctcaaatatgtctctatgaatgtaaatagcacaaatgtaaa

SEQ ID NO: 54430 - DNA, 1501 bp, Oryza sativa
atttatagaccacggtgcttcaggttgcagctgagtgatgatgcttctcgcggtgtttggagcttccaagttccaacccggccaccatcctgcgtgcgccgctgtcagcagctgatccatcggcgagtgcgtgtgatggatcggagggaaacgaataaagctcgatatatattcgtcacctttttaccttttcggattgttcctgcccttaacttcaaggcacgcaatgcctaatacaaccgtaacaaaagttcaatagtagaagtgttcagaattcagaaaaaaaaaaggccgtaaaagagagaacaatgttgatgccaacgttgaagctggtgaaagtcagaaaccgatggtcgtagggagtggattctaaattctcgagggatcacccctcgttgtttgcatgtcattcattgggagtatgacttacgtatattcatcttacatgtttgtagagtgacttatcacatattaatatatcttgtaaaaaaataaccatttaaataatatgtataaaaggaaaggatgtcctctcgagttaaatattttcccacctctaaatgcaatgtgaacggcgatcctagttaagcacttttatcttgaattcttcatcaaagatgaggcgatgagagattcgaccgcgacgtgacgccgagaatcgtccggcaggccggcgaaggaagctgattgcgagctcgttccaagatctcgaatcgaagcactacaaaccaaggtagctcgctggttctcgcggacactaagcatcgatcggagatcagcagatgctggtcgggttcttgtttctttcacaccgtcgaaaaaagtacagaccagattgatcgaccgccattgtcgtgagctttcggtggccttgctagctaggccaatttgccctccttttgggcaaatggaaatgatccggaggtgcagattgcagaaggcgatgtgctgctttaatttggcgatccggttaaggagagaacgtaaagaactcgctcgagctcaagcgtctgactttccgtctactaacccggttaattagcagaatttttgagagagagaacgaagatcaaacacgttttaaaagggaatcaaattcgagaatcagtactacttgctagaactagaagaccacacgctgtctcacttgttgcaaaatccagaaggattcttgtcttgaggaaaagtcacagtattgcacacataagttgaacggattcccctgcaagaaaaattccaaatacggtcttgtgggcaaaggccatcctggtcggagaaagagaggaatagtgctctgagattcgtgccgggacacgtgtcacgcagggaagtgaagtccttcggataaccgaaggaccggagtcccgtggaactttcttcgcaccggttcgggggcatggaggcggcggcggcggcggaggaggaggaggaggaggcggtgtgggcgtggagttggggcgcgggaacggacgggcagctcgggaacggcggcttccaggac

SEQ ID NO: 54431 - DNA, 1501 bp, Oryza sativa
ttcagattcaggaggggaaacacaaggtgtaagttatggtgctcaactacaacggtgataaatgatgataaaaactggagttgcaaatctatggccctccgcattatgagttcacgacatcaaaaatgcagcaatgttagaagatatcccatacagtaaaaagatactactaacaatgctaagctattgttaacgtttattgaactattcatgtctaagctatttccaataaaaattccacaaactaaaatggtgaattctctgaactaaagcggcaccagatgccaagcagcggatctctcccaagtgtgtattttattcaatgcaacctagacatacaagaatctgggcactgaggcggataacaaatttcagtaaatgtactgcccctggaagggggcgaaaacaaatgccgcacatttattaccttaatcctgagagagactgaacaaacaagaaatccccccccccttcctacacccacctaaaaaatgcggaaatctctcatccgaagcaagacgtgccttttacccctcctccgaaatggatttcaccagtcgggaccaagaaaacaaaatcggaagaaacccctggtaggaccagcagctgtcaatacgctcgtggggaagaagtagatttcccggatccgtcgatttaggtctcaccaatcggcgaaatggattaagaaaccctgggttccaagaaaaggggggaggtcaccggagccgaacctggtggtgggtaggcccttgcagaggcggtcgccgcaggagagggcgcccttgtggagccaggagtaggtgtcgacggccaccgtctggcccttgagcgcctccaccccgatgggcgccatgatcgacttcagctgcggcagcaatccctggatccccattgccgcctctctctctctctctctctctctctctctctctcctctctctctcgctctctctctctacttgtaggttttttcttggaaggggagaagtgaagggcgggaagcgaggggttggagggagggagccgagtgaaattggcggacggcctctcgttttttctcttccggcggtccccaccataaatctatccgaaccgtcggtctcgccatccaacggctgtgctacagtgttttgctccgtgcgagtaggccacagcctgagtgggttccagatccgcgattgtgagtgtccaacattagttgggccctaacggggttccttacagctacgtgcggcctgtccgtgttaggccggaacggaattcccatgggcttgcagcccatttaagttgggccgtaacaggatttccgccaacgtgcgggccgttggttttgggccgtaacgggatttccgccaacgtgtgggggaggggggtgggggcggactaattcgagaaaattaatttttcatttgaattttaatacctttaactcaaatttcaaacttttcatctaaaaattgaatactttcatatcaaatttcaaattttcaaatcaaatttc

SEQ ID NO: 54432 - DNA, 1501 bp, Oryza sativa
agtatcgagtccgcggagtcgaggaggtcgcggtagctgcggccgacgagctggcggagctcctcctccttggcggagatctcgcggcgcgtggcgccctccgccgcgcggatctccgggatgcgtctcgtgcggaacagctcctcggcgtcggccgcgccgccgccggagactgccgcggcaggcatcgccgcctagaccttggagctcgcggcgagatccaggaaggaagcgatcgggattgaggaggaggtagggaggagactgtgtgtactaggagatgcacgttcgtttgagttgggtagaggaggtgactgagagcggtgggtgcaggtggaccgaggggtcgtcagagggtgggcccagtaagtcagagacccgacaaacagtacaccgggttctgggagtgatcttgtgagataattgttgcgagttgtggcccgtgggtttaggttgtatttaggggttgtttggttgatgcgtaagcttatcataactaagcttaggtaagttgtggcatgtggcaaaagtatggccaagaaatagttaatcacaagtgtggcaatgttagctctagttatctgaatatgacatgtgggacctaagggtaggaaagtgtggcatgacacaattgtggcattaaaacaaacacacgcctagaaactgtggcatgactgaagtgtggcatggcaaagtgaagcaatcaaccaaacacccccttaacgttaaaattggaagtttgattgaaattagaacgatgtaacggaaaagttaaaagtttatgtatgtatgaaagtttttatgtgatgaagaagtttgaagtttgaagaaatattttggaactaaacacggcgttagcaaagttgctaaatgtccatattttcttggcttaaattaaacaaatctagaacaagatgtatcacgtcccatattatatttgtttattttttaggatggaggtacatagttagactgttgtgaatgcttgatgcatagtagtccataggtctatttgaaatattcttgtaatgttgatagtttaagtcactttggttgacaacttaagacttaagcaccttcattgttaagtgatacctctgcatgatcattatctacatactcagtggtagaagaagtagtagtacatggtatccatgcaatacttgcattaggcagttgtgcttgacagccttgactcatgcatggggggtgacaaatagacaaagcatgtcctaaccagaaaaaagcctgattcacttctgactaagcccaggtcaaaactcttattgggcccagtctgaggtctaatcaaccaaacgatgccggccttgtcaagtggggataaaatatgaaatggccatgtgtcttatttacttttttttattatcacaggttatttgctttatacttctaataaaaatatgctttattaaaaatattttatatagtgtatttgtttagaccacttattctaatctatttgtgagtttcatttctaaat

SEQ ID NO: 54433 - DNA, 440 bp, Oryza sativa
agtactcagcaagctatgggaaataagtgtttaatacaggcttcaaagaaaggctgttgtttttgcaattgattttatttgaactcttttctaaaaacaactaagtgagtgcttctcaaacgacacgggtgagacagtgcgtctcgtccggtcggagtatgtgcaatgtatcagtctttagaattgaaacaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacttcacatccgcccatgaccgtgggcacgactgttagaacagtttgttaccctctgcagagggggtacactttacccaca

SEQ ID NO: 54434 - DNA, 1501 bp, Oryza sativa
aaataaataaatgcatatttacttttattatagtgctttgaaagacaaatatatatatacgttgtcctttaaactaaatatttttaaaattattgatggtcaaagttataaaagtttggcctcggccttatctaaaacgtaaaataatatggaaccggatggagtacatgatagctataaagtgctacagtaacccatatgtgctaatcacggattaattaggcttaataaatccgtctcgcggtttccaggtgagttataaaattagttttttcattcgtgtccgaaaactccttccgacatctggtcaaacgtccgatatgacacccaaaaattttcttttcgcgaactaaacacaccctaactattttcgctgaaattgggtatcatgcatccactggcacaaaagctttcaaaatcaactagctatgctactgctagattaaccccgttacaaaagctttcatgatacaaaagtagatcatcatctgcttccaaaatcagcacgatgccttctaagttctattgacctcttcaaatgaacttttaagataagatgatatcttcaacattaatagaaccctagggaaaaaagataatatccaaattaatttcatgtgatgtgcagcagtaggaggtaaagtatgcttcccatggtagaattggcgccaattcttacctccctctcagatttttccctccaaaacacatctgctggaatcagagagtaggtgaaaagctgggggaaattaagcaacgaatctagaccatcccttatgtactcgatggttggatgatggatactgttaaagttgcagtcactactgatttgaatcctcgtgagagatgatgtgattacattacagacgcaaaatccagatttcttaatcgcgaatcatcaaaccgaaaccaactccaaaactctaatttcggccaaagagattccgcagaacagttcgagttgaccaatattatatagtttatttccccccttttttgttattactattccaactcgattatccaaacaaagtccatgttggatggatccagatcgccacaacactcccttgtcagttgtctgatcgactgatcgtctcatccctccctaacccgtctacttggccgataacccgtctcaccgccaaatcgccaatctcccacctcgtcacgcatgcgtgttcaaacgtgaactaatcaactctccgcgactccgcctccggccgtcccgtccccgtctccgggattttaatttcttggcacctcgcctcagcatattccatgtcccctctccatccgccccacgcgcccactttgaccgacccatcgatcgatcacgatatttagtagtagtagtagtattacaaatccagcaagcgatcccaatatcccattcccaaaaccccaatccatcctcggagcacgccaccttcacgaggaagagagaatcgaggaagcagagcgctcggaccagaggaggaggaggaggtgccagccatgg

SEQ ID NO: 54435 - DNA, 1501 bp, Oryza sativa
tcatgtacttgtttgctgcaggacttgagaaggaacagcggaccattgctccgcaatcttagtatcagctcaaagcagagtgatcctgagcgtcatgtcagatttgccgagcctgcatactcatttgttggaatgcattgcatctttgacgactgcaaagcatcaggtttgttgccttatagtcatggtgcacaatttcaaaatttcatctctgacggtaataaattattgttgttttagtgatctggataatatattaacgaaagtttgattttactcccggcagttacaatattgaaatttggtcgtgcaagttcagatctacttacatatggtgcttctgatggcagtttaacagtctgccaggtttctgacccaccaactgttcttcaaaaattaatagggcattctaaagatattacaggttagagtacaatcattacttgtttatatggttttatttatgtacctacgtggctcaggaaaagtgcttagcttctagtacaagggtgttactagggatgatcaaattgcatatgaagctaagtgcaaaaatcagcattgcaatgtaccctcaatgttactgggatcttattcgatgcttatcttaataatatagaatgatagttcagttaattgtgacttcccaatattttaaatgcctatcatgctgtttgtaacatcaatagtatctcctagtgctgagcatttacaattgctgcacatgtagtttttgtttgttatagccacaaaaaagttgcatgaataatttatggatttggatggatgctaattaaaacagaataattgagttgtacttatctattatttcaatgtttagtatttagtgagcttcgaattctaactgcattacagattttgatttttcatctaataaccagtacatagcttcgtgctccatggataaaactatgagagtatgggagatctcaaaaggcacttgtatcagggttgtatatggggtttcttcccagctatgtatctgctttcatcctgtaagtcccgcctttgcagaatgcatacttatcccattcgcttgttggcaccaatcttatttgcacttcgcattcataaaaattatttgtgtagtaaccaggatggatggtctactttatcatatgtttactgggttttctttcttctttttttttttgcaggtgaataataatttactgttagttggcaatgcaaacagggaaatcaatgtacgattcctgaccttttgctcccagcaattcatatactccaatattttgcctgctgattaatctgcgccttcccttgaatgttctgttttgtgatagtaatggaaaaatgaatgtgttattcttattctggttatttattcactaaagatgattttcttctgattaaattagaaaatatatcacctaatgactaccatttcccctttacattcttttgcttgtaccttttaatgtcgatggttgtgatccatatctctatctattataggcca

SEQ ID NO: 54436 - DNA, 1501 bp, Oryza sativa
aacttcaggtatgttcagtgcttcttctatttttggaatcttaaactttggttccatggcaaaggtaccgatgaaactattttcattcgtgaagggacatggttctccagtaattggagtggcctggagtcatggggaaaatttgcttgcctcatctgattcagatggtacagttattgtatggaagcgggcataaactaattagagcggattccacaaaacgaaagttgcttgtataatgaaggcatttttggcgcatgttgtacctcccatcatatattgtttgtaagacacagaagatgaatcagccttcaattgtatttctacaaaagtatagttctccatagagtgtacagcggttcttcaggtacatcttacatatatttttgttcaatactaaaggggtaggaggtacagtataattctctttttgtaaactaaatttcatgagtttaaatggagtagttgcaccctgggtcagattctgtaaggtgaagaaggtttgtgtttgttataatccttcgttttttccgtctacgaatgagccattactgacttttgtattagacttcctgtcttgagaattggcgttttaccggttgaccgaagatctgccaaagaactttttctgcctttctcagctgtatgtgttttacagcggcaatgcgggaaaccatgtattgcaaacctaaaaaccactgtagtataaaaagaatgagcgtctgagatttatcgacactgtaagtaaaattcggggatgacatggacaaatctcatatgtttacttttcgttcctacagtaatttctaagtgtttacattacatacgtggtttgcgccatatattttccccagcaatgcaatggaacacatagctctatctagttcccgaggtgacaatatggcatatattcagctagctgagcatagcattgcaaatcacaaagaagcacacaaccggctagaatagtgtcactgaaagcactagaaacatggtactactaagttgctaacatcaggcaaccattctacccccccagacagacattatttctaccactccaagcaccatgactccatcaagctgctatagcgatggttactgcaaattgaacgtgaatgacaggattattcctagtgctactccgaaggcgagggctaacagcttgcaagtcccatcacaggtgtctgacgtccgaggcgctggcgaagaagtcatgtcgaaacgcaggacgcagtcgtcgctcaccacgacgccgacgccctctccctgctcctcccgacgtgcctcccggaagcatctcggtatctctcgcgccgcgccctccaggcactgcacgcagtccgccggcgcgacgcccgcggcgcactgcgccaccacgcgcccggccagccccgtcctcgtcgtggctgctccgacgtcgatcgccagcatccgcgccgccacgccgttgctcatgtcgaggaacgtcgcgtacaggttgtcgctgaacggcaggacg

SEQ ID NO: 54437 - DNA, 1501 bp, Oryza sativa
cacgaaactccggtgcaattaagtcctatggcggcaactaaatcctagccaatggcggcaaacttcaacggtgctagattggtgggaggctaccgcaaacatgcaagagacacctaagaagatactccgcactttgatgttgttggtcgcctgggagatatggaacaaaaggaatcgcagaaccttccaacagaaggagctttcagctacctctcttttagccaagatcaaggaagaggtcaaaacttgggccttagcaggagcgagaagtcttaatagctggctttcttttagttaactcggaccaaaggtcctaactcctttcctttttttctttcgctttgtaaaattctccttctctattcaataaaattggcgctcgtcgattcgttcaaaaagaaaagtcctatggactatggtgtgtgctaccagtttaacaatttctcatgggtcaatgagttggggttgttgaaacttggccggcgcaaaacacgttgcaagattgttgtcatggggagtaagatggactaacgtgtaagcatgtttgctgtcagtaatatacattttttttcctttttgttctacctcttgctatgtgcataaactccttttattaatataacgccaagcaggccattccaaaaaccttttcccatgggtcattaactactgcaccttcccgtaccaagcattgctagcaattaatagcttgcaacgccatgtctagggatgaaacgattggaaaacaacatgcatcagccgtttaagtaatcatatatttctcggaaacgaaccgataacgatgaggctgaaaacaaaatgatatcaaaaatactgaaaacgtgactacatgaacaaaaccatgtcaatatcgatcggaaaccagtaatgaatatcgaaaacattaaactcgatgtttaacttaacatgactatataatattgtctctcctctagccttgtactcaaattagaaatttgataaatatttatgggtctcaaaactacgggtcacgggtcacatagatacatggacgataaatattgagatatttaaaaatacggtgattaccgtattataaatgtagcatttttcatgagactttggtaaattaaagaaacggttggtagaacaataaaatcgtttttttatttttaccatttctatttttagttattgttttcactcctgtgatggcaaaggcaaactggtcaccattgcttcctacgcatccgagttagccgcaggctatttcataacgtatagttgtgaattgtgagattttcttttagtttcacagtgtatggtggcgcaccggcagtccggcacatcccggccttgccccgataccacgactggccctcaaaagccttatcttttcacttatgcttatacttatcagctaaaacttaaattttctatcttagatttaaatttaattttgaggggtttttttatcgaaatttatttttcagtctttgcttttagatcggtaaaaaca

SEQ ID NO: 54438 - DNA, 778 bp, Oryza sativa
ctagctaaatgggcaacgcatacatgatgtaaatgtgataaatgtttattgaacatatccatggggatctgggtgcactagatagagtatatatagtatctcttcgtagttactccgtcaattattggcattcatcataaactctacgcatctctctacagggaccattttagttttaattaccatgttcacatctttaatttgtttattatacgtactgcaaatataacttggcctatacttaatataactaggcgattgtctcatgcaaattgcatggtgctagatttcaaaagtagaattagatttgatatgcaatactttaactctattcgattgatacaattgtattttctacctaatatattttttttaaaaaaaatagaattggatttcatatacaatttctaccttttttttctatagctacaattgcattttatatgcagatatattcatcaatctaaactataatgagctagaccccacgatctaatggtccaaacattttttttcccttttctccgattaatataggttttagcctccagagcaaatgtggtagcttccatttaagctatcttaataatacaatacaatatatatatagatcaactgtttgtagattaatataggtcaaacgctgtcactattacaaatgtatattatcagtacactttcagtaaatcattagtgccgcttttgtgctgtgtatgacaagaataactaaatttaaaattttagcttgttttcaattcgcttttctttataatgtaga

SEQ ID NO: 54439 - DNA, 1501 bp, Oryza sativa
gacggttttttttaagttacaaccgaaaccgcccaaaaccaagccctgacagtcgatcattgatctcaactctggccacccctttgggattgaggggaagagggtgagagagaagaatgaaactgctttcccccctaaagcccgcttgtttgattggcccacagttggttacaagggtgtcctaagaggcattaagcggatcggcgatctccactgatagggccctaacttcatcctgccccggggctatttccttcatcttcattcaaaaattatttgacgtcaaaggaaaacatgttggacaggtcctgtaggaagggatggattaggcacggataaagattagccgatgatcaagcttagaagtggggaagcagcttagccttagccttagaggaagtagacgcaatttcctcggtaacggcttcgacagacggagcagctcgagccgatggggacagctcttgcgctgctgaggccgataggtctatcaacgatgacgctttcaccacaaaagggaaagagacggattacaaaaaggccatgagggagataaacgtttttttgcgaatatgcaatgcaaccttgcgaatggcgtaatgaactctggttggtggagacaacgagagagaaggcggaatattgtcaactaacgcttcggcacttatcccagcaaaaccatcagccttggccctcttgggtgatgacccggtaattcctgaagagggatccttgtgtttgccaaaatctaggcgatcggtagccaaaaccccagtaggagtcttcatgaatgtttcaattgacggagcagaagaaatgatcggggagggcaatatcttggtagtccctctggaatgcttgagaacctgggcatagcaaattggccgatcactcaggctgtgtttcggtgccagtggttttaagatctgcagagagaaaaaagggagcaaaacaagttaggtcgtggggaggggggcataatctagttagaagtaaattgcggcctaccttgatgcggttatcaatcttggtaagacaatagtcggatggagcagagaagagatgttttgaccaatccgactatcaactgtagaaggtgacatgcttaaactgataaagggtgaagtcgccgatatcggctgagactgggaatttgcattctaacaatttcttcatggtatcgactgatgatacttcacatcttgagtctacaacttttagtaagggaagattgatgggaagctggccaagccccagttgtcttgcagccgatgttgggtgataaaactcataagagaaagattttcttccctgagacacatctgtaggaagaacgcaaggagagattgctgccaagtaattgcccctcaataacaggtcttcttcatcatttagcttgctcagatctaaatccattggaagatcaaactcggtgtaggcgtcataggcaaagagaacatcggcagcatcgttgttgtaaaatatgtcgaaccatgtctta

SEQ ID NO: 54440 - DNA, 1501 bp, Oryza sativa
tgccatcgatgctacagtagttatgtagtgacaaagagtgtacatcatccgtttcaaattactttatcgttttagttttgtttgaactcaaacattattaactttatacatatagtttaattacatgtgaattacatattatgaaagtttttctcatggtgaatttaaaaacacaaatattatgatgtgaaaatatataaaatttaagaaattgagggtccaagttaaaaatgtttgactaaaacaaagctaaaatgacgagtaacttaaaaagaatatgcaaagtcaaattcaccttctataagttaattaaaaaaacaaattatactcaaactagcatgtgcattcatgcttatatttattatcttttataatttatagagtcaaatttgaatttgcattttcatggagtagtaccgttttattttttaacatttttataattatttacataatatataagaaataaggtgagccgttgattgccaatcagggaatgaaaatacattccttacatactaattctgcctaaaataagttaatctagtactagttatatgttatatatatcccgtactagattaatgggatagaggtaatactgtgcttgcacctgtggcattgggacaacgttgagatttgagaaacatccaatctacctgttccaactctaaagtgcaaccgaattgaacgagttcagccgcatggcaccacacgtccacaccagcgaagttcgacgcggacaaacattacctgaggtgacattgcaacgcatatggaccggctatacggctcctcaatcgtctgccccgagagacgaaatcgagggtgcaaatttaattcacggagaaatgttaattagttatcccacaggcctaatcctgctaatcccttggatgcatgcaagaacgcatgatgagaacagcaccacctcgatcgacagaggacccaaccaccgccgcaccgcccggttcacgctgtcccgatgttcccatgtgccaaccttttccatcttggctaggaggcaaagcaactttccttccttcttccgcgctgttcgccagctagtaagtgcaagtacaaaggtagagatcggtatggtttctacattaattaaaggctatcacgttataatagttaagacaatacggtctctaaccattaatataccaaaatactccactttcttactagtcatctttcctttactagactcaatgcaacaaaaaatttcctaataaatgctaagagtcaactctatgctgttgtcatgcgtagcaaccatatttctctttctttctttttctctctttcacgtcaccaaatattcttgcatgacaataaaaagtaaccgctaataaagaccattgtacatgccctaacatcagcattgtgacttcgatcttagacatgagtccatgccacattgatcatcagctaaataaccagcctaacaaattacatttatgtattacagatctactaaagttaggcaggacgt

SEQ ID NO: 54441 - DNA, 1501 bp, Oryza sativa; identical to SEQ ID NO: 49173

SEQ ID NO: 54442 - DNA, 248 bp, Oryza sativa
taatttattttaggagaattctagaatcctatttttctatattttgccagatcaaacaccagattccgaatcagactctgactctcctatcgagtcctggtaaaactgagtccattttgcacttgaaaactgtttgttattaaaataaaatctataggtcttcattattatgccatccttggcaaacaatgttgtttctttacataacgttgagggccatggcggtacttttaatttcagatattaat

SEQ ID NO: 54443 - DNA, 328 bp, Oryza sativa
aaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcatccccagctggagctagcgtgttacctcccagagatggcacgttagtcctagtcagatatatgccaggcttcatcctaaccattacaggcaagatgttgtgtgaagaagggcgagcatgtaggttgctaagctgacacgtggtgacaagaa

SEQ ID NO: 54444 - DNA, 1324 bp, Oryza sativa
tacccgcacaaatgcagaacccagagatacagaggaccagctgtagtgttatttcatacaagggacttgagcatgtgcaaacttcagtaacctcagtggacacctggaaccaattcttcatacatactgagggacaactatacatgcaaaatcctttaaagtgtttcaaagatattcttcatgacacagaacaagccttaaatttgccttttttttgagacggagtcttgctctgttgcccaggctgcagtgcagttgtgcaatcttggctcactgcaagttccgccttccaggttcacaccattctcctgcctcagcctcccaagtagctgggactacaggcacctacaaccatgcctggctaattttttgtacttttagtagagacggggtttcacgatgttagccaggatggtctagatctcctgaccttgtgatccacctgcctcagcctcccaaagtgctgggattacaggtatgagccaccgcgcttggcctaaatttgactttttaaaaaaactttactgtgtaatgcaatttagcatacttatagagactttattggacaacaggtaagtaaaattatccttattttacatatgagaaaactgaatatgccagctactatttttgcattgaacacccagaaatgtggtgatgtaaagcaaccattttattaagttcacagattgttagtattggaattttggatagggtatagaaagaaaatcttgtctgtgctccacattttctagagcctcatttgggaagactcaaaggcaaggaatgactcagagggaagaatcatctggaggcatgttcatcagcatggctagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaaccatgtgcggggaaacaggaattagggagagaggtagggaagaggagttcaccaacagaaagctggtgcttatttaagcagtcatga

SEQ ID NO: 54445 - DNA, 928 bp, Oryza sativa
gtcgactctagaggatccccatgcttcccagatagtatcaaggaagtgaaacttaccagatcatggcatctagacaatgggatgccagagtcctcacccatcatgactgcttaaataagcaccagctttctgttggtgaactcctcttccctacctctctccctaattcctgtttccccgcacatggttacatttcttccctgctttagaaacccctaatggtagtcagttagggaagtgaatttgagactgatctcccatatcctcaacagcagcacctgattaaagccttcttccctggcaatacttgttgtctcagtgattggctttctgtggagtgaacagcaggacttagaccaaacctctggcattttggtaataaaatgatgctgtgcaactttcaaggatagatcacaaaaaatgatgcaacttctacgtggatccctgaaactctggactgcatgtgagaagccccactctcctgaggctgccctgctgtggaggaagccaggtcacacagagggggcacatggaggcaatccagcctacagacctgctcaggtcctagctgacagccaacatcaccctctagccatgctgatgaacatgcctccagatgattcttccctctgagtcattccttgcctttgagtcttcccaaatgaggctctagaaaatgtggagcacagacaagattttctttctataccctatccaaaattccaatactaacaatctgtgaacttaataaaatggttgctttacatcaccacatttctgggtgttcaatgcaaaaatagtagctggcatattcagttttctcatatgtaaaataaggataattttacttacctgttgtccaataaagtctctataagtatgctaaattgcattacacagtaaagtttttttaaaaagtcaaatttag

SEQ ID NO: 54446 - DNA, 198 bp, Oryza sativa
aaataccctcgatcggctaccatctgctagctctagctctcctcgatcaattcagattctcccctgatcgaggtgaagctagggcaacgcgagagctagcgccgccgacatggccgacgacgacgagatcgctcttgagccaggctacgtcttccacccttccgacgcggcctcatcaccctcttcctccgccccagc

SEQ ID NO: 54447 - DNA, 1501 bp, Oryza sativa
ttatcacataagtctgtgcttatgtttttcttctcgtccgatgaacagtaggtaattaagcttcatcgtttttctttcaaatgtacgtaacgtacagaatacttttttttcccttttccggcccacaggaggaaagcggaggaaagcattaccttttttaaataatacattaaatctaatggtctaaaatacagggttcaccaatttaagtgaaaatcgatggtgagattaaacagtgccatgtggcgatctaggagtgtttctaggaacgccacgtggcggcttaggagcgtttgtagggagtttaatggacttttagtatataatagtatataatagatagatagatagatagattggaattctcatcacatatgcagagttaataaaaaaaattatttctacatgcttccactgtatagtaaatagattttaaattaaatttattcagatgctatgtggaaagaaatttacaaattgtatactaatcaagttatgtgaagaccttacgatttacaatgtgaacatgctacaatgagcacaccactgttggctgtcagatgaacaacattggtataaaatttgtactttggaaatggtttcattggccttgaatgatctgattgggcaagcaaatgcctcaactctttttgctatagctaatcctatcttgccaacccgaagtgtaaaatccaaggtgtttttaattattattctgtgatgaacaattgggtattggagattattggttttgttatttggaatttattcacgaagtggttttggagatgattggaatttacaggtgaatctacaggatattgctattatttcatgtgaccggtcagaccgggcagtgtgtgccggtcagaccggcggtgatcgcgcggtcggactggccagcccgcggtcttaccggccgacgctgtgtcggtttcggttttgggttgtttgtttagatatctgtgattatttcatgattatgacttctagatggatactatatgtatgtaatactgttgtttgctactaatgagtcaagttggagatagcttctcggaatatggtttctttgtttatttcatgtgtaggtgactcgatgtctcgggagggtatttgcggtgatggaccgggagtcggcttggggataagacgacgtccatggtggtcagagatcatacgggatactaaggctagagttgatgcacatggttaatggagattccatatggcatacgatggaggtattgtgtgcgtatgggatgcggagtcaaatttggaaggagtccaaatttggtacgattggttatgtaaagtttctttcttgtactagagggtttcctaaggtgtttaggactcttagtatgagtttggtttgtggctttaggcttcctacatcgggtataaatatagggggagcgtgaggcttcccggtatcgcttttgagagcaattgagttgagttttgagtttcgagtttagtcgaaatttttgtaaggagt

SEQ ID NO: 54448 - DNA, 1123 bp, Oryza sativa
cgatttagagcttctttggatttttatcgatctatagtttttgccatggctactcctgttaggttttcaactaagcctcatattttcgatggaacggatttttctcattggtgtagtaggatgcaatcttacattatggctgaagatcatgatatttggagaaaagtttctcatacttatgtgattcctgaagctattaatgctgctgctgaaaaaactgcttttgaacaaaattgcaaagctcgcaatattcttttgagtggtatttctcgttcggattatgatcgtgttgcgcattttcgaactgctcatgaaatttagaatgctttgagtaactttcatcaaggaacaaataacattaaagaacttcgtcgtgatattttcaaaaaggagtatattaaatttgagatgaaacctagagaagctttggatgactatctttctaggtttaataaaatttttagtgatcttagatctgttgattcttctcatgatgctaattatccacaatctgagatttctcgtcattttttgaatggtcttaatatgtctatttgggagatgaaagttacatctattcaggagtctgttgacatgtctactttgactttggattcactttatacaaaattgaaaacacatgagatgaatgttccttctcggaaagttgattttaagtcaagtgctttggtttcttcttcttcttctttggatgttgatgcctcttcatctaagccttcttttcttgctgtttttaatgccacatccgataatcaactcgaacaaatcgaggaggaggatttggcttttgttgctaacagaattgctcgagctatgaataatgccaagaataggaaaagaggtggtccaaatcgttgctttgaatgtggttcaattgatcatcttcgttcgcattgtcctaagcttgggagaggcaaaagagaagacaaagatggtgagaagaccaacaacaacaagccaaagggttcatcccaagggaggaagctggagaatctcaggaaggcttttcaacaagtttgcgccgccttcgagccactaagtgatgtagatggtgaaagtggagatgatgataagagaaagaacatctccgatgtttgcttca

SEQ ID NO: 54449 - DNA, 500 bp, Oryza sativa
cgaggaggaaatagctgctgatggtaacgacgttgcggatgatcttggtcagatgttgcagcacgccagggaagactgcgaaagttaaaagtaggcccataaattggacaagatgttggaggaccgcagaacttcgttgtacccaggttgcgagcaggggcacaaaaagttggataccactatggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcttgctaagg

SEQ ID NO: 54450 - DNA, 314 bp, Oryza sativa
aaactattttaaaagcctacaagctaaaccctaattttctaggaaaattttcatcataaaaatgagctagataaaattttattaaatactatgcttgctcctctattttctagaattttctgggaattatttgagcaagggaagtatttttaataattgaaacaacatttcacaaattgttttatttaaaaaagttcaaaaaaccccttctttggtcattgggccgaattcggcccaatactctctctctctccgcgcggccgaaccggcccatgccggcccaagccgagccgcccgccccctcctcctccagc

SEQ ID NO: 54451 - DNA, 1501 bp, Oryza sativa
ttcgaccaccgttaaaatctgaattttaaaacttgatattagtgttgatctgaggtttttactatggtttatcttttaaaattggcttttaaactgcaaatagcatatataaaaaagttttaactatgaagccagacgatagggacttagacgttgtgacggtcgaacacacagtactggtttcgattttttttaaggaaaaaaaaacgtactcctacaatgctactgcctccgtcccaaattagtggttgctttaacatttttcttgtaacgtttgaccattcgtcttatttgaaaaatttatgtaaatataaaaaatgataagtcatacttaaagtactttagataataaagcaaatcataaacaaaataaataataatttcatattttttagaataagacaaatgataaaaattacaaacaaaaacttaaagcgacaagtattttggaacggaggaggcagtgcttaggagtaactggttaatgtccgatcgcaggtaaaggtaaaacaaatattcctccccactaagctacctttactgaccttggtgaaacacaaattaattactcgcccacgtagatggaatgaaaaatatttcctgtacctgcttttcagccaaaattattcggacgtgcaattttacagcaattatcagctgcaggccatacgatcggaacgaattctattggccgtttcactttatcgccacttttttcaaatttggtatggtaataaactaaacgctacctcaccacccccatataatcaaattctagtagtttcaaaaccattatcttataaaaacgctaccaaattttgaaaatgcatcaacgctactaaaatctaataaaatcaggctgaatttggtaataaagcgaacaaaccctaggtttcgataataaaaaaacataggtgcctagaaataactggtccagttaaaggaaaaacaaaatattcctcctgcgccaccaagcttcctttactgaccttggtgcaaaacaaattaattactaacccacattaaaggggaaaaatattttccacacctgctttaataaaagccaaaatgcgagtacatgagcatatgatagcacatccaaatcccactcccactggcctaccgtttccaatcatccacgccgaatactttggtggcgagccgggggggcccacgcgtcagcctcagctagaggccggaggcaggtgccagtggaacagaaccaccaaagtcgcgagaatggttagagtgaaacatgtcaccttcaccggctaccaaagcagcagtgtacgtggtgcatcgcctcatctccctcgacttgctgctaagctttcctctcgtctttgacgcccccatctttccctagctcgcttgtcctaatcctcctctctttctgcaacaagaggaaagtgagagctcctcttggctcgctcgctgcacgaatcagtagtccaagttggattaattaagggaggtacgtaaattagttcgaatccatcca

SEQ ID NO: 54452 - DNA, 782 bp, Oryza sativa
cgatttttaaaaatcgccctcccagagggcggtaggcgactatttccgtcaattttcaaaatggaaaattatttttgtaaaacttttaataaaaaaaattataaataaaaaaaattcgccttccatgtctctcgccctcttctagacttctacatgttggttggtttgttggcccagctcagtatagagcacggcccacttcccaggttggcccatattggtagatgaacagcccatacaaggcccagtaatatatttcccaggcttgtgtccggtcagatgtcactgtgttgctctgttttctttgttgttacatggcacatcatcccagtgcaatttaatcaaaatgaatcaaattcttcgtccacaatgaagatatataaattatttccatattttaaagctgagattcgagtattcgtcggtccatctgtaagttccaatcatggacaccgaatatcgcagggttaatcatcagttcatcatggaggggcccactcgtcaaccacaggaggaaaacttaacaaaatacaaagccgcgggaacggggtgaagtgaaacatgtcacgtcttcaaatgtcaacctcacggatagctgcttagcagtagcagcagcatcgcctccagctagctctgatcatttgattctctcgtcctaatccacattttgtgctgccgattaaccacaggaaagtgagctttgcttgcaccacaaaacctgcaaattgaactatattcgaagcttagctaggtgactgattcttgctgcgattcgatgtcca

SEQ ID NO: 54453 - DNA, 347 bp, Oryza sativa
ggataatccatcgcctatagctagcactagcagatcgtctcgacgtgccttccatatgagcatatacagtcataacatactgctactgcaaattcaatcgacgaccatgaccgggattattcagagtttcagaccaatcgatatcgatacaatgccgggatttgctgagcacaaggtcttcgatccacaaaggagacaagcggcataatcgcataatctcagggaggattattggctattgcagaacgagacgagaggaagtcgtcgttcatcatgtgcgatttactccgtagccgccaacctatgaagattatcataatagtagcttttctgctcgaccacgacca

SEQ ID NO: 54454 - DNA, 1501 bp, Oryza sativa
tctccgtcctcttcgatctcctctgccgtcgatctcatcggaagagagcgccaagcaagaaaggtaaccatagtgttcaacgttttgtttttctttggtacttttctgctgctttctcgaagcatttcttgcctcttgttgtttttatcccctcgtgttcttgatttcctagttcttgggctttctcgcacactagttttagcctagagtttctccacctgatttctgatgatgcgtctggagtcctgacctgtgatgtggtgatgctctgggagtttgtgttcatcagatgacgatctgtcaagagtttttcttgagtggcaaagcatcattcggacagagattctgaaaataagtgatgccgtcgaatcatccgctgggatgcgaacaaaagaattcttggaattgtggtctgaataaacaagttggatgatccgttacttatgaggtgtttgaattgattggggaaaagaagtggatgataatggtttaagacatgctgatactcccatgaaaatatgcatatgtacaagcatacagattgaggcgagtggaccatggtgttagaagaaatcaccaaacttcagcttgctttggtgattgttcttggcagctatgccatctggccgtttgctttgcaaatcatgtgaactgttcagtggatgaggtgctaacctagtatttacatgtgccatacatggccattggatccagtggaacatctggtatattcacctgagattggagctatgtggtccaaatgcacctggcatccccaaaattttgggtcatgtttcttttcatcatgagaatcgcaagttcacaatcatggcaccgattaatcagttatcattgaaagcttgccagtatgaggttcttttgtgctttaatcatgaggaatgatggatttaagatctaattgtactcggtttcaaaaaggagatttaattgtactccagttcctgacctactctagtacaggctaatgtgggtggatctgcatctacctatcagttctaacaagaagttttgcgcagacttctgtctaaagagagtcatgtcctactttttattttcccttttctgtactatatatccaaaatatataaaatgtacaaatgaactcaatttgcaactctctaagtggttgtttcgcaatgaattcctgcagaataattattcctgaagattcctcttctgcatgttgaagtgtacaagacagccacaacaactgaggatatgagctggtggtgttgcattccaaaatccaagaaaggagagaatccttactctcatggcgttagcggtacgaactgtatttgcttgcaaaatttatgctgaatttgcatagcagccaacagagtttatgaaatagaaacatgtatattgtccctatcacagattcgatcatattaggctagagaatgccagtactgaagctccattttaagattccatgctttacttaactaaatgtaactaactttcaggtattccgcct

SEQ ID NO: 54455 - DNA, 216 bp, Oryza sativa
ttatttggttgttaccggcaatagcacaaatatcaggtattaactactacctcttcccacaatgcttactactgggtagtaggcttgaaataaatgcttgttacctggttttttgccacattgtggttgctcttagccgctccacatgtttgaggtggtcccacatggaaggggagagatcccgtggatgttgggacgtttggtgcagattgaaca

SEQ ID NO: 54456 - DNA, 1501 bp, Oryza sativa
gttttcacaaagaaattttctgaaaaaaatggattaatacctgacctctaaatccaaacagttgtacacatgaaaagaaagtaaactgctttaaatttatattttaactctatgtggtcacaaaatcattcatctaacccgaacaaaaatcaagccctaattagagttaattaacgcaagttaattaatactactacatgatttaactcctcgttttaagtgagctcctgtgttttcttgctgttggcttaggtggactggtgacgagtcaacgactgacatccgctgctatttcctgttttggttttggatgattgctgccttcttgtcaaccaattatgctctgttactgttgatgttcacacgtccatctggtgtgatctgatttgttttgaaggagtctacgccacgatcatccaattgccctattgttgttgttactgtataagactaatgtgactcgtcagaagcgaagagctccatatctctgacggcatcgtataaaaatagtattatgtgttctctcctgttgtgtttttgttgtgttgtgccaaactactacttttcagcgtgacctaatcctttcgtcacaggttgtcaccagccacgagcacgaaatgataatgcatgtcattgatccttctcataaatcaatcgtatcttaaagtctgaaattaacgttttttttatttactactactcagtttaagtgagggtgatcactacctttgtcattacatccattggtacagcacgcgcgagagcgaaaacttttacaaaccctcaattaagcctcatctaaaatgaatacaatgggattttgtttatgaaatgaactaatttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattccccgctgctgacctcccagcgttgatggcgatccagccatatcttaccatatatccccgagcatccctgctaagagcaaggataatagt

SEQ ID NO: 54457 - DNA, 1501 bp, Oryza sativa
gttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtaagctatatgtttatctgaaagagaaagataaacaaaaaaatagggagtattggctctcatgcaagagttaactgcacacaaactccaagaaatatgcattaaattcatggtgagagaaagagagaggatgaagaaaataatgataaacttatagccaatttactatacatgttagctttagacattgactaatagtaagtagtgagctctactattaaacttgctctaatgctgccaatggcaacactgttagcttccataattactgcgcattatactgcctcatttgaccgtggattttttttctctgcatttctgcctcctgttcgtggccaaaaattcagacaacgctgcatcagacgtgttatagtactcttgttatttagtatttgacttgaaggtcatctaatctaccggtagagaggcacattcgtatgttgctcattatagtggtacacttgttggttagtggtaatgctatccagtgggcaggcagtggcatctccattgcttttcgccattattatcaccgtgactccagctgcttcaccatgtgatttgctgaccgtcatgttggtgcatgcatcaactcttttcccatgtgtttcttttcacataaattgatctgacgatcttcaagttgcttgcagtaatacgtacagttcgtttggtaaaattcagagaggtgtatcaatagtaggagtagaatgaaccttgtgttcagcttccacgcaatgtcctccgacatgacaaatgacagtttatgggactagatcaaacgattatctatttcattatctttaaaaaaatcgacggttcagtcaaaaagtactgcatttcttaggataaattactcgttattgttcgtcgcgatgtgcagatagatgcagtttagtttggttttgcctgcatccacggatgataggtacttgacagaacaacgagcactatgcgactaagttggatgcttcagttttacaggaaaaagagcagaggactgatgttgattcaacctgcagtacctgaggccacaacactttgcctaagtcatgggtcgttgacatttgatatctataattttctttaatctatagcgtcttttactaacgaaataagattttttttctctgcctcaaaaaaaccaagtcaaaaggtttcaaagatgccatcttgcaaccaggtgccattccatgagggcagcggccattcatttttcacgagcttcactatttatgt

SEQ ID NO: 54458 - DNA, 1501 bp, Oryza sativa
cttcttggaatgttgtttgggattcaaatatttaaatgcaggacaagttggataaagtattagcgaccatttctcatctggagaagcagtctctgatggaaatacttaaacgtatgaatggaagcacacgctttcaaagtaaaatctctgatgaggattacttggcttgtctgcatttgatctgaaaaatccatgtagcttttgtggctgttttagtgtgggcggctgcgcacaaaagtctagggtcaaaaggctgggagagatgacaattatttggagagttttcaaccgatacattgtcaaaatcatcccatttctcctctttgaatagttccattttctctctttgactctggaatggagaagaatctttgtctctttcttttgttagtttaccctgataaggtagataaaatcttgcagctgctgttgatttcttcagagagagagagagagagataaaaagaagatttcttaagagcatcttcaacagatgtacaaaattagaaccccaaaaatcccagacaaacgcgagagatcatcttcgattcttgtactggcccagaaatgatgtgtacgcgggtggcccaacttgttcagtccacacggcctgacggcccgcgtgcgagaatagcccagcggcgcaagggagcctgggataacggcctagtacgcggggcgggggatgttccttgatgggccttcgcagcttctcatctcggcctatggcccaccgagcatctaaggccgaaagccgccacagctcacaggtgtgcaatgggcccggcactgcgcttctgcacgatcagatctgcaaaccgtaggtaaagtcgcatcgtcagggtcaagctatgggataagtgccgattcgggtggcttccatttttacgattctcacaaataaatactccgtacagtatcttgccctatctctatgcactgctgctaaatctgacgtactgctactacataggaagaagtcacatccagctacatgaatctggataaaaggtagtacagatttattgtcttagaaaaaatcacatccccagctacatgaatctggataaaagggtagtacagattcattgttttagaagaaatcatatcccctccaccatttttttttgggacgaatgaagtacttgtcacaagcataataaattttatatatctggataagtttttttaagctatttcccttgttttaaaatgtagattcattatattataaaatatcgtatcataataacattttaaaacaggggtaatatataatttgacattaatagtactcttacgtatgaaaaaacttgtctaaatatctctaattttattttgaaacaagccttacttgtgtggacggagatactccctccgtttcgaaatgtttgacacttgatttttagcacatgtttaaccgttcgtcttatttaaaaacttttgtgagatatataaaattatatgcctacataaaaatatatttaacaatgaatcaaat

SEQ ID NO: 54459 - DNA, 319 bp, Oryza sativa
atagccttcacccgttgtaacacacggacattttttccagtaaaaagaaaaaaagggaaaaataattcttcggattgggcctaacgtatatgagggccatgctttctatagcacctaaattagcccaaaaggaccgatcagttctattacgaacggattagcgaccattaattaagagagcgcgtgacggattaagcgaagcgaaccacgcaaataatactacacacgcgcgtcacggacaccacccagtcccctccccacaccacgcgccgcccaaaacctccgccgcgtttcgcaccaccaccaccgccgccgacca

SEQ ID NO: 54460 - DNA, 1501 bp, Oryza sativa
ctgacgaatgtgcatgtttattcacaggaagaagaagaagaagaaagagcctgacgcggcgccttactctagtactccgtattagctaagcacgattaattaatctgacgaaagaataatcaagctggactgcaggtcggtctctagctagctacttagctttaatcatctctgttaattttaccctttttttccttttgattctccattggctcagatccaatgtgcattggggttcatcgcggtcggcgcggctagccggcgaggatcgcacagttgcaaattgacttgttgaaatcgtcgtcgtcgcaaacgtggctccaactccggccaacaccatgattgattgattcctctgaaatctgaatctctgctggtttctaggtaacgcgtgaagtgaactgctctccacgtaattccatccgtcgatctcgtcctacgtgcgggcacagcaccggagtgcagcatacagctaatataatgttcttaaaaaaaaaactaacaaaggaggtgtttagatatagggatataaagttttaaggtgtcttacatagggtgtcgtatgaggtgtttaagcactaataaaaaaactaattacatagtccatcattaaaccacgagatgaatttattaacctaattaatccgttattagcagatgtttactgtaacacaacattatcaaatcatggaggaattaggcttaaaagatttgtcttgcaaattagttgcaatctgtgcaattagttatttttttagtctatatttaatatttcatacatgtattcaaacgttcgatatgatagggtgaaaaattttagggtgggatgtaaacatggcctaaggctgtatttagacaggggtataaagttttggtgtgtcatatcgggtatacggacacatatttaaagtattaaatataatctaataacaaaacaaattacataatccgctagacgaatttattaaacctaattaatccgtcgttaataatgtgtactggagcactacattgtcaaatcatggcataattaggcttaaaatattcgtcttgcaatttacatacaatttgtgtaattaattatttattttttatttttaatactttatgcatgcgtccaaacattcgacataacatggtgtaaaattttgcgaggggatataaacaagccttaacataacacccctaccatgaacctttgcgccttcgatttctccgacatccgctgctagctgcacgcaatgcaattattttgcctaatccatactacagtatcataactctgattcactgtaactattatatatactctgatttttcttttaaagaaaaactctgatttcaatcttcacaggtacagcacctaagttttttttttcttttcaactccaccacggaaatatgctactctttccgatcaacgtttaggataagatttgattgaagttttcccaataagttcatttaatgtggggagtacaaaaccctcccatcaaaaccc

SEQ ID NO: 54461 - DNA, 319 bp, Oryza sativa
cctctttggattccttccaccttttcagcagcaagtagtagtagcaagtactagcaactaacccacccaacctccgatcgatccacggaagaacagaagcatgcacgcacgcacgaacgctaatgatctaggctggaatctaatcagtgcgaactaaggtggtcttctctccaatgaagaaatatattaacccaaacagagtgcagatagaggatcgaatcgtagctagctaaggtagccagaacgtgcagtccctgtttctttaatccagtgcaaggttggtggtggctactgacgaatgtgcatgtttattcacagg

SEQ ID NO: 54462 - DNA, 1501 bp, Oryza sativa
agtgtgctgctgaccgatcgagctggctggtcatccagccgggatggatccacgccagccaatcccagtggccaagatcactgtacgatttacactgtattctgcatgactactagaggcaggagcagtacgtccacggtccacgtacttcgtacactaggagcatgcatgcatgctggtagactggtttgttggtacctagtagtacatgtagattgctcgggtgaaaatgatagacgatcaaaatccccaccaatcgtgtatctcgttaagttaaaagtagtactgtaacgttttctttatcgttttgttctagctatgtgtaaattctgtttttttctccagttttttttagtgtcgtattgcgctaaccaatagctaaacgattttgctagatatttatcatcaaatttctccccctaatatttgtcagatgtaattacagtacaattgtagtgtaacttgcatgtaattacagtacaatcgtagtgtaattacactgtacctataatgtaacttcgaagaatctctcgataacatgttatttcagtaaaatagaggtcgtgggaacaaatcctttcacatatgtgtgtgctgtgatttttttcttcctcactagaacaaatcttgtaacagatctaacgattcaaaattacgtgaaacttacatacaagttacactgtagttacatacaagttacagtgtaattacatacaagttacagtgtaattacattacgattgtactataattacatctgtcaaatttttagtagaaaatttgtcgacaaatgtatagttggtcccatagctaaatcggatatgaaaattttcaactgaccgagaattgttgagttttttttcgaacgcgcaaaagaattgcatgccaatatattagtagaaaaaaagagtgctacgcactcaggccccgtttagttctccaatttttttttctaaaaacatcacatcgaatctttggacacatgcataaaacattaaatatggataaatgaaaaaactaattgcacaattaggagaaaaatcgcgagacgaatcttttgagtctaataagtccatgattagctgtaagtgctacagtaacccacatatactaatgacggattaattaggctcaaaagattcgtcttgcggttttcaagcgagttctgaaattaattttttcattcgtgtccgaaaaatccttccaacatccggtcaaatatctgatgtgatacctaaaaattttcttttcacaaactaaacatactcagtcaattgttgagtagaaatgctatccttccgaccgttttcatccctgaacgcatgtacgtctggtgcggtgcgttgctctgctcgtgtggccagaggcaagaggcacgcatcgcgaaccgtgtgtacagggctagctagcttagcgaggtggtacaagttgaggaaagcttaacgcacaaggagagtatatctcgctgcgtcaggcgcgggctccaccggcggccgcccgc

SEQ ID NO: 54463 - DNA, 1501 bp, Oryza sativa
catcccgctgttccggctgctgttcccgccgttccagcggttcgtgacgaaggggttcgtgtcggaggcggagtccgggaagcggctggcgcaggtggtgggcgacccgagcctgaccaagtccggcgtgtactggagctggaacaaggactcggcgtcgttcgagaaccagctctcgcaggaggccagcgacccggagaaggccaggaagctctgggacctcagcgagaagctcgtcggcctcgtctgagtttattatttacccattcgtttcaactgttaatttcttcggggtttagggggtttcagctttcagtgagagaggcctgtcaagtgatgtacaattagtaatttttttttacccgacaaatcatgcaataaaaccacaggcttacattatcgatttgtccacctaaattaagtaattaaccacttgtttaggggagccaaaataaaccttaccaaattttggcaatttgataatattgtcaagttttgacatgatttattttatatttaccaaagtttggttaaaaaactaaatgaatgcgtatctttgttaactttacttaagaaaatagtatggtttgaaatgacattaatacgatccttaattaatccatacgaaaattagaaacaggatggtgggctccaggccggatgcaaggcccagtacccaatccaaccggcccgtttcttcatttaaatgggccgaccagcactggcccattaagccacttctcacgccatgagcgctgtcacaccgtattcgtcgccggaagtcgtcgacgtcgaggggacgaggagcccaccggcgagcggtggcgccacgggggaggaaggcggcgagctgggcgtcggcgagaactcgaggagaccgacgagaggccagtccaccaccgcgcagccacacaggcacggggaagagtggcgcgcgcggccgccggaaaaggctatggcgtggatctggatgctcatggcggcgggggccgtgctcctgtgggcggtttctctggggcgggtgctctcctcctcctcgccggcgtgtctgcctgccaactccaccttcctctcccctcctcgcggcgacaggatgagccggaatgtcctcctcgttctcgcccaccccgacgacgaatccatgtactgcttcttcctcctcatgtctcttatcgtttgcgagcctcgctgtgtaaatcgtggggctacagttccagtaaccgctaacaatgaagcttaataggctaactcctgtgcacggtacctgctcgatgaaattcctgaacaagtgaacagtttttttttttttgagctaagggagcattctccctccatttccatttaacagaaatgaaacaaagttcttacaaaagcaggatgattacagaaatgaaactaagtgaacagctgaactttttattattttgtggaactgtttaggggaaatcttgtttatagtatttgttttggttgattctgattgattgtcatgttgctgata

SEQ ID NO: 54464 - DNA, 1501 bp, Oryza sativa
gaggaatcgacgccggacttcaatgatggcggcatccggtggaggagtcgacactgagggctccggaggtgacaacgttcccaggcgattcctgaggttggcggcgtggtgacatctttgctgcgacatagagccggttgtgcgcgcgaggtcacccgccacagccacagccggtatcatcaacaacaacgcaggtggatcgaggcaatggtgacttgggaagggccgcaagtgacacagtactctgcgccacccctcccatcttcgccgcgcgcgctccgcccattggttgcccgccgctcgcgggtcctatggctcgccggagaagagagaaagaagacagaggtaaggaagaagagaagagaggaagaggagcaatttggtcacaccgtgtaaaaatgtgggtcccctctcgccttgtcagcacaaaaatactaatttagtggatgcagtgtcctgttgcaaataactatatttacatagtgtattccccaaaaattatttcgtgtggtgtactatagttaaaaccatgaagtcgagatatcctgtagcaaaatttatctttttttataacttctataagtcgaatttaaacttgtatgtttattgagtaatatttttcatataatctattttatcatttttattttaaagtgatattccctactaggacatctttacttctatgattgattctacatcttgcattgtgtcattgtgtgatgtgtataaatatatatttatatgttagcaatctcttttccaaaaaaaaaaaatctatgtacacgcgcatgtatagatgatccatctctttgtttccgtcactaatttcctcgtaatatatttcgcacaattatgatccggcgcgccgcgtgagaggggagcaggtgagggcgccggccgaggctaattggctcgaacagtacccgcgtacggcgtaccacggtgacgcaagccgcccgcggagccatggcgacgccccacctgcagacctgcagacgcttttggtgtgagcgatcagctggagacctggagtgcagcagccgcgatgcaacctgccgcgcttggcgccgatccgaaggcgaccgtgggcgagcgagcggagacgggtcgtggtgacgcccgcgcgctcgtgcgcgcttggacggagaggagacgagaaaagcaatccgctcacgctcgtgtgggctagctatgcatgctgtactgccctgccctgcgggcagtgcggctagcacgacgtgagggcgtgaggcggtggttggttgcagacttgcagtcctctgcggcccaaaactcgtgttctctcggggtatccgatcatgtacaccacacagctagcgcgagcaatactacactagacaagctggtgaatcttttcaggataatgcagaatcatttcgtttggaggagggactaatctcagcacccgatcaataacagagcctcgatcaagcggaagtgggcttttgtccctcgaggtgacatctatagatggtca

SEQ ID NO: 54465 - DNA, 1501 bp, Oryza sativa
aacgacgtaagctgtagtcagagtttcagactatgcaatggtattgtcgcaatttatttgaactatggtggtatttggatacatgtaagctttataagcccaagagctcacgccgtctagctccaccgcattcaccaccccgatccatggctccattgtttcacatggaagctctgcttccgagctcgatctctcccaagctcaattccattctccactcccacatctacccgcaggtcggccatgtcttccgtgccctcgccaagttcaagtcgctgctcctcgacgtcgtccgcaagaagagggcgccgacgagaggcggcggcggcaagaagtacgccatcggctaccgctcgagaccggagaagagcaagaagaggatcgccagcttcatgaagctgctgcgcttcaactgggccgccgccgccgccgtcacgccggctcgcgccaaggatctcgagctgcactaccacccgtactactacgactacgacgactcgacgtggaacgtggtggttccggccgacggcgcggcggaggagctgcgcggcggcggcggcgacgacggggaggactgcgggtacctgtgctggctggaggaggagacgtcggccggtgcattgccggctgccggagaaggagaagacggcggcaacggcaacggcgacggcgacggcaatggtgcggtgaacgagatcgacaggctcgcggagaggttcatcgcgaggtgccatgccaagttcttgctggagaagcaggagtcgtaccggaggtaccaggagatgatggccaggagcatgtgagttcctttgtccatggaggattcactgcacagcttggttttgtgaaataactctctgtaacttctgaatttgatcgacgacattatgcaagtacaaatgcagtgttagcagtgggcaagttcatgttgcagcctgtgccctgaattgaatttagagggttgcttttcgatctggaaggcatacttgcgttaatggtggggtaatgtaaaactcgagttaggatagcccaagaatttctgtcccgaaaaggcaacaattatcaatcagattgtaagtagtttgttaccatcgcaattcacaagcagtgaattgttttttttttcaagaaatcaagcagtgaagtggcagacaatgagaaactacgcagtgaggaaatctcgaaccaaaattcgatctacactgtccaatacgaattgtggcccaaagcccaagacgtacacgacatgacgaagacaaagctctcctcgagatccaataaatatctgactcggtggaggcccaaagcccaactaccccatatgaaccagccgttccctacgtctctcctctctctcgtcgttaaccctctcgattccgcggctggtcgcttccccttccgcttccctccgccaaccacgagctagggtttcgatctcgcccccgaccggcttcccctcccttccctcctcctccctccgcgcgaaggctcgccatggagg

SEQ ID NO: 54466 - DNA, 1501 bp, Oryza sativa
gaattattaattctcataattattgctattaagtcaactgtacaccgccatggagtcatggatatgcaatgtgatattcattttactgaaaaactggatcaccatggataagaatagtgcaatgtttcttattctgtgaacgatgttaatcaatactgcagtacagtattttggactgatatgccagtataaaaaaagctacaaaatatactctctccgtttcaggttataaaacgttttgactttggttaaagtccaactgctttaactttgaccaaatttatagagaaaagtagtaacattttcaacccaagacatatttattatgaaaatatatccaattattgatttgatgaatctaatttagtattataaatattactatatttgtctataaactgttcacatcaactggaagacaaggccttgcgagcttctgtttgtaatttctatctgtaatattgacatgtttcccaaattagccatgtacacctaatattcattcttttctgaaacgtgatgatgacatggaatgcttagagttatgataacattaactctgttgatttttaaggcataattttattttaaaaagtcttctagatcaaatttcgaccgttggtttgtctaaagtatttctttaatagctataaaaccaattttgtgtgaaagcattttcgaatacaaatctatatgtataacattcatacaataaaatatctcttcttaatgaaatagaaagcacagttctccttcgttttcgagaaaaaaaatacttctaaggtgatacttttcgatcttgtaaaattcaacagagggagtacatagttctcctgcatttttgagaaaaaaaaaacttctttggtgatacttttcgatcttgtaaaattcaacagagggagtacattacgacatcatgccctcttgtcaccaatgttctaaaaattggcattagtcggggctaggcagcgattcggtactagagacgtgcagtgattcggtacaagtctggacttttgtggtttatttatggaagcatggctataatggtttagttatgcgaaatcaggaaacatttctaagttaggtaggctagttaaccttggtatgcatttttgttgggccaattatctattatgagtttgctccatcttgattatgcaagacttggagccttcgtgtgaccatactagtcagaaacaacatctgaagttcatgctagatgccatagatcttccctgcttttatttggaacaataaaatgacacaaaacattttaccagtacaaactaatagctaaaatttatgccaagcaatgtaacttttgaatgtttaaactttctaattataattacagagatttagtgtttttagtattagttatctcaactgtttggttaacattcatagtgtcaaactccttgtttaacattcactcctttatgcactttaacaaatggcatattttctattcttctgatccttatgtcttcactgcagc

SEQ ID NO: 54467 - DNA, 619 bp, Oryza sativa
cttttttagaagagtatagattagaaaaaatataactcccatcttttattatgtttggtaatataagtagtatttacacttcttctctttataggatccagtaaagctaagacctctctgtgtcttgatgcataatgtaagaactcatgcttattgcaatctggttgaataaacaagcaattgcacttattttcacacttaaattaacaaaatgcataaatagcaaaacacaaaaacagaaataattttctgagattttagttacaaatttaactcatctttaatcttttatcatgctgagcatgaaacaagcaaagatttttctgatataaaacatattatcgtttctacagacagtttttttgtatgtaggaagtgcctccagtaaaaataataatttttttgaattcagataaaatttgttcaaattcaaatttgtcagaaaaaatcattcaatattttttcatttcgaaatgtaaaacctgtatctatctatgtcttcttgattatactggttgtagacaggtaaattgcataatgctaagtgctaattgttcacttccagttaaatgaaaagtttatcattcttctatgcacatcccataacaattacttctat

SEQ ID NO: 54468 - DNA, 195 bp, Oryza sativa
ctaatcggctgccttctattgacggatgttggccgattgtaggttagatatcgatattgccaaggattatgtaggatatatgataactcgacgaaatacataaacaagattagagtgtcataaagatggaagcactaatcctgagaacgcaagccgccataacaagttttacctcttgttgaagatcgaaaccga

SEQ ID NO: 54469 - DNA, 283 bp, Oryza sativa
catttctttcatcaaagagttgggcaaacccacataagtcaatcaactttaaattggacccaaatcagcttgcaatagtttgaccttaatgaccaggaagaagatatcactctagcagagttagagcaggcgttcaaatctatccaggcacagaaagctcctggacctgatggttttattggtaaattctttgaaactgcatcaagcttgacctcctaaaggcagtccaatctttcatcaatcataacctaaaccaattggatgatctgaattatgctcatat

SEQ ID NO: 54470 - DNA, 1501 bp, Oryza sativa; identical to SEQ ID NO: 52360

SEQ ID NO: 54471 - DNA, 1501 bp, Oryza sativa
ccattttttttcttaggccaagtgctcccttagaaactgttcaagccagtctcctactcaagtatagcaaaccaaacaagtctggatcaaccaaaatccaacaaaccaaactcatcccatatcgaagaagaaaacaaaaagaaaaaggtagcacaagatctgcaactaggaatcacgtgtacaccttgtcgtcatctgcctgctagcactagtagccacaagatagcacattgtatggaaaattaattcaaccgggtaggttaggaggccgatgttttggtgcgtacgtacaaggatgtcaagcttgccgccgaacatggcggcgaccctgccggcgatcgcctccgggtcagcgcgcacctacgcgtcggacggagacggtgacggcgagcttcttggctctccactcctccagacacctgttcagggtagcctcgttccgggcgcacgtgtgcaccgtggcgccgaagctcgccagttcctccacgatggcgcgcctggatgatgcatttatacatgcttaatcagttaatctgctgccatcgatttaactagcatctactaatacgccgaagcaacgattcgatgacttggtgaacttattcatagtataattagatgttaaaagttaattagaatcaataacaatttaacactggctgaagagctagataattaagagcacaatctgaagagatagatctgtttcactcttcaattctgaaaacagatcgatgggaaagcttggattcggcgaaggaagacgaattaattacccgattcctttgctgccaccggtgacgagagctgtggcgccggcaaggctccaccgcccgacctccggcctgctgcttgtggacatatcggcgtgcctccggtttgtgcgtcagacttgtgtgttagtgagacagcttgcagttgcagcacagggtcgagtacttctaaaggcgtaaagcattagccgtctgcactaggtgcttgtctagtccgctggccctgtccgcctccttgtgtccatctcatgaatatctttgacgtgtatttgttcagatttttctttaaaaaatactattttttatgggaaaagagagtatagcatatatcggcttgtcctgagttatccattgactttagacttgtttagttctctgagacaactccgcatccgctgtccactaaagaaacgggatcggttatctgtaatgggtttaaagcatcatctctttcggacagggcacccgtcactaagcaaagatcagtaatgtgagaaaatatcttaatcgggcatccggccatcacgaacgaatgactctcatctctaatgggcctaagctatagcctgtcacggatgactctcatctctaagcacccggaaagaatttttccggtcggtcacccattccgaaattgctctaggccaagcacgcttaatctcatagtttttttttaagattggattccgaaaaagaaattgtaacttgttggcatgagtattctatta

SEQ ID NO: 54472 - DNA, 402 bp, Oryza sativa
ctatgatatgtacttttggatagataattgagaatgcagggacggatgttgatgatattgatgtctttgaacgcacacatcgacatgcaaagggcaagggacagtatgccaacaagaaagctgaatagttagcggtatgtgttctgcttattctagtttctagtttcaagtttggcaatcaaaaaaagtgaaatcatctaaaaccatgcaatggtgccactacatatcttaattaggtggtgtataatgatcgtgtcaaggaaggagaaaacaatcaagtcaacaaacaacatgtttgggtgcagctcactaaaggtagaaaacgtggaatgtattatggtctttcaggaattatagatagaaaccatgttggtaattcagcaagtgcaccatctggtagca

SEQ ID NO: 54473 - DNA, 1501 bp, Oryza sativa
atgcaattttttatcctgagttagttttttaatgagggaatatctggagtttgttttgacccagccacatcccactccctgaaaaaaaggatgttttcccgtacttaaaaaaaaaacctgccagccctctagaaaaaccccgtcaactcaaaaaaaaaaagaaaaagaagggctctctagctctcatgaaaaaaacccccaagtcccaatccatctttttccttcccgcgattttctggcattccccccaaaatcatcgacccccattatcccatctctcccactccccatgtttgccggtctaattgtgatttcctcatctgattggagagatttatttgcccctccgtgagtttgtagcacccaattttcttcatttgttttcttcctcgcatgatcgctaacaatcccctgccgcgcgcttgcctcgacgcaggttggcacccccgtcgcactccgagccatcaggtgcggcacctcctgtagcccggtgcctgacacccaggcccagcactcctacctcgtcggagtgtgccgctctgccgtgccccgatccttcctcctcaggtaacatcttgattaatgtgtgcctaccagctgctcgatggaattcccctgtaagaattttgtcatgtcctgtgattttcatcttttgtgattgtatcccatgagcatctcaactaatgattttgaaagaatgttcatcatccttttggtttcttctactctccttgctccaggatgttggatattggattaatttgtttatggtttaagtaatacacactaaaatttgctctctaacttgcacatgtatgactcaagttcctgacgatgcttgtgtttctaattctttagttgctcgctactagatatttttattgcccaaaaattacgagtatctctagtagatatatattctatcatcagttcttcggattagaatatacaggtaggaattattaacatagtttaatttatgattggtactgatctcaggattgttttaagtggttagaaaattcaggtctcctgaaagtacggtggaatttgaatgttaataattgtgcaatctcaggattgctttaagtggttagaaaattcaggtcttctgaaagtacgatggaatttgagtgttaataattgtgcaatctgatagcaaaccattggcatgtgtgcaaaaattcagtaaattaaacaagctaagacacatgttgtttattcttttggtgtattgaagtgtagacagagtaaacaaattatagagaaatatgtactacttaatatgttcaagttatcactaataatgatttatctgggagcaattattttttgtatttaaaagaagatttgctattagtctacatctaatctttcctcttcttattttgataaacttcctttacataatctttcaaaatatgcatccttaccatataatttcaagtgtagggctagccattatttgcatgtcagaatagcttgtttagtgtgagattaa

SEQ ID NO: 54474 - DNA, 1501 bp, Oryza sativa; identical to SEQ ID NO: 52256

SEQ ID NO: 54475 - DNA, 1092 bp, Oryza sativa
tgtctactccacacatggtaattttcagtaaatcctttattgcaaaggtgcatttgaactattcttttgtcatgcagctgcccattcttgcacttcgtacaagggcatctaacccttttcttgcctgaccttgaactttgatacagcgtgtgacataaacctcttaactcctttcaaatactcatctgaaatgtatccattcactacccttttatacatccaactacggtcctcagccattaatctcacactaaacaagctattctgacatgcaaataatggctagccctacacttgaaattatatggtaaggatgcatattttgaaagattatgtaaaggaagtttatcaaaataagaagaggaaagattagatgtagactaatagcaaatcttcttttaaatacaaaaaataattgctcccagataaatcattattagtgataacttgaacatattaagtagtacatatttctctataatttgtttactctgtctacacttcaatacaccaaaagaataaacaacatgtgtcttagcttgtttaatttactgaatttttgcacacatgccaatggtttgctatcagattgcacaattattaacactcaaattccatcgtactttcagaagacctgaattttctaaccacttaaagcaatcctgagattgcacaattattaacattcaaattccaccgtactttcaggagacctgaattttctaaccacttaaaacaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaagcatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcatgggatacaatcacaaaaga

SEQ ID NO: 54476 - DNA, 1501 bp, Oryza sativa
aaggcggagattgatcctagaacagagcaagaatcggctgaagtccagatcggctacgattaggatcggctgggtctgagtcggactaggtgagccgattcagccgattctgatagtataatttggtgtatgacattgggttgaatcgaggtgcttcaagatgattgccgcacattgatagagtcctgagaaggcaattgtatctattaattacgatgttttatgtaactttcttagagatatgtttgggcaaaagtctgccgcaaagacttatggtatcttagagcttgttagagatagtggtcgtgtccggtatggacatatcttgtaattctcgggtataaatagacctcgagccctatgtaattggtaacacacacgttcaatacaatttcggcgcatcgccacttttttgctttagttttgtttcgacgagttcttgctttcgggttgagctgcattggtttcgatcttcaacaagaggtaaaacttgttatgacgacttgcgttctcgagattagtgcttccatctttatgacactctaatcttgtctatataattcgtcaagttatcatatatcctacataatctttggcaatatcgtcatctaacctacaatcggctaatatctgttaatagaaggcagccgattaggttaaatagcgacgttgtcctagattatataagatatctaccactttatgaaacacccagcggcttgattgtctagatattgttcttcttttcatacttaatgctgcatcagttgagtttgatctattaagtcgtgcttagaatatcaatctctagcctgtcctctggttgccgattagggtagcatcggagtttcagccgatattatctgatttaaccatattcaatctatatgcttcaatgacatgttaaatctgccatttatgtcaggatcttattgcatttaagtatattaagcttttgtttggtatattatatttgttttgatatctttatataaagtagtatcggagtattagcggatacatgctagatctatctgattggctatgctataaacatatataatcctgttattaatatatatttcgatcgaagtgatttattctgtctcggcatggtggccgatctaccccaatcacttgatttaagtatatattaatataagaactatatatcgttaatatatacagccgatcgaatagatttagtttcttactatctatttataaccgccgatcgattcacatatgacatcggctcaaagataaatgatgtcatcggcacctagccaatcggctatcatttatagatttaaccacgaattctttgtctctatttcttgttgattacaggatcaaatcaactggcacgctcatacattcgaaggcgagctttggacctgcactggagttaagcagatctcccaggcctcatgttttctatcaacacgcttttggcacgcccggtgggacaaattagaagtcagcaagcaattcttcctca

SEQ ID NO: 54477 - DNA, 1501 bp, Oryza sativa
catcggtttcgatcttcaacaagaggtaaaacttgttatggcggcttgcgttcttgggattagtgcttccatctttatgacactctaatcttgtttatgtatttcgtcgagttatcatatatcctacataatccttggcaatatcgatatctaacctacaatcggccaacatccgtcaatagaaggcagccgattaggttaaataccaatgttgacttagattatataggatatctaccactctatgacacatccaatggcttgattgtctagatattgtccttcttttcatacttatagctgcatcagttaagtttgatcttatgagtcgtgattataatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctacttgctttaatatcttaatatagagtggtatcggagtattagccgatacatgctagatctatctgatcggttatgctatgaacgtatatagactcattattaatatatatttcgatctaagtgatttatattgtctcggcatggcgatcgatctatcccaatcacttgatttaagtatatatcgaaataatgattatatattgttaatatctacagccaatcgagtagatttagtcccttcttatttattaatgactaccgatcgatgcatatatgacatcggctcaaagataaatgatatatcatcggcacctagccaatcggctacatttatagatttaactgcggtttctttgcttctatttcttgttgattacaggatcaaatcaactggcacgctcatacattcgaaggcgagatttggacctgcactagagttaagcagatctcccaggcctcgtgttttctgtcaacacgcttttgatatatatgtgcccccctaattttacaatgacaaaagcattgataaaattataaaacaacgaagggcgatataacaatatcggccattgtacatcggcaaaccacaaccgattacaccatgaaaaacaactatgggcaatataaccatatcggccattgtacatcggcaaaccacaaccgattacaccatgaaaaacaactaagggcgatataaccatatcggccatctcaaggcgatgcaaacacatcggctgtcatgcatcggcaatactagccgatcatgcgttaactcaaacacttgggtaatatttcttcaaatacttgccattgagcgcttgcccatagacttcaccatcaagcccttgcaacatatatgctcccttagacataaccttataactggagttaagcagatctcccaggcctcatgtttttatgtcaacacgcttttggcacgcccagtgggagagattagaagtcagaaccgcaatagcattctctca

SEQ ID NO: 54478 - DNA, 1501 bp, Oryza sativa
aagaaatagaagcaaagaaaccgcagttaaatctataaatgtagccgattggctaggtgccgatgatatatcatttatctttgagccgatgtcatatatgcatcgatcggtagtcattaataaataagaagggactaaatctactcgattggctgtagatattaacaatatataatcattatttcgatatatacttaaatcaagtgattgggatagatcgatcgccatgccgagacaatataaatcacttagatcgaaatatatattaataatgagtctatatacgttcatagcataaccgatcagatagatctagcatgtatcggctaatactccgataccactctatattaagatattaaagcaagtagaatatactaaacaaaagcctaatatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattataatcacgactcataagatcaaacttaactgatgcagctataagtatgaaaagaaggacaatatctagacaatcaagccattggatgtgtcatagagtggtagatatcctatataatctaagtcaacattggtatttaacctaatcggctgccttctattgacggatgttggccgattgtaggttagatatcgatattgccaaggattatgtaggatatatgataactcgacgaaatacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaggtagcgttgcgccgggattgtattgaacgtgtgtgttaaaagtaacataggactcgggtctatttatacccaaaaatcacaagatatgtccataacggacacgactactatctctaagaaactctaagataccataagtctgtacggcagacttttgcccaagcatatctccaaggagattacataaaacatcctaattaatagatacaattgccttctcaggactctatccatgtgcggcaatcacctcgaagcgccttaattcaacccgatatcatacatcagtatgcattgtcaaaatcggctgcatcggcttacctagcccgactcagacccagccgatcctaatcgtagccgatctggactccagccgattcctgttctatttctgaactcgatctccgcctccaactatgcttcgatctaatcttctttcccaatgccgatattacaaaatttggttgttaacacatgccccccaagtccggaatatttgataatttttcggatttgctgtaaatcgactctgagcaagtttcgcactttgccgttttccgaccattactgc

SEQ ID NO: 54479 - DNA, 1501 bp, Oryza sativa
accaggagggagaggccggcgggaggacggagcagctagctgcagtggacggcagtgtgcgtgaggccgcgcgcgtgggtatcagtgggaggccgggggtgacggtgagctggaccctatggtggcggcacaaaattggcaacgacgatgggtctcccctctttgcctggcatgccccttcttcccctagtgctccccctcctttagccgttctgtctccagatacggtcgtggagagctctagcgtagagatggtggtggtgcctagcactggaggtgttctactcgcctccctcgttgcttcatgttgtagaattgggacggtcggcgtgcggaggagccgatgagggtcgtcggtgcagtggtgctcccggtgcgacgatggccagtcgacggaggggcatcagtgtggtagagagcacatgctagcagaggtctgacggtggcaggacgtcggtgtcataacaggaggaggagatcggctataggcgaaagccttgcttgacaccttgtctgggcaaacaacgacaatgtcttcaacgtttcaatccctcctaagggcgttgttgagaggcctacctctccctctagcaggacctcgggtgaaaaccaagtcctcttctggatgggcggctctgttgcctatccaacattcgatctttcagtcttcgacaacattcttggatgttgccatccggtttgctcgtgggaggagtggatcttcttctctctcgccctctcttttggcaacccttctacgtggcgatggctcagagcctatggggggatcttttggttggagttggcttagaaaggtcgtttgtgaccccttcgtggggctagcggcatccaatcatgcatagcggaggccggcttgatgctagatcctttccggggagtgtgtgcaggtgcagttggcatgtgttggtattgctttggtgttttttcccttttcctgattattgcctcccaaattggtaatcttgttaatataaaacttgcatcgtccggtgcaattcgttcaaaaaaaatatattaaattgttcttagacagctaaactagttctaatagttttttcttatactacttattcaacatctccggtgcaattaatcaaacaacatcctaaacatatgagtgagtttatagtctatgagaaggtaccgaaaaatatcatattttctactgtaaaatttggacctctcggtattaggaggtactaaatttacactaaatttttttatacctttcacggctataaaatttctttaaacatatacagacttaccatagctaaacaaccaaacaagtcacaattgtattctcacatctggttgatgctagcctgggcatttcttcttttgacccggtcttaccactatcaagcgaccaaacactcccaaaagaagggtaaataatttaggcatgcaagtatggattaaatctgctagaaatgcaggcaatcgatcgctattagatatgacttaatttaaattacct

SEQ ID NO: 54480 - DNA, 1501 bp, Oryza sativa; identical to SEQ ID NO: 30852

SEQ ID NO: 54481 - DNA, 1501 bp, Oryza sativa
cccgcagcccttgacgccgtgccttattggcgctatggcgaagggcgtgggtggacgaaacctcttcgcccgcaacccttgacgccgtacctcattggttcgatggcgaagggcgtgggtgggtgaaacctgttcgcccgcaacccttgatgccgtacctcattggtactatggcgaagggtatggcgtgtggcgaaacctcttcgctcgcagcccttgacgccgtgccatattggcactatggcgaagggtatggcatgtggcgaaacctcttcgcccgctgcccctgacgccgtgccatattggcactatggcgaagggcgtgggttggcgaaacctgttcgtccgcagcccttgacgccgtgccttattggcactatgtcgaagggcgtgggtggacgtaacctcttcgcctgcaaggccatgcgccataccttattggtactatggcgcagggcatgggttggcgatacccgttcgcccgcagcccttgacgccgtgccttattggcgctatggcgaagggcgtgggtggacgaaacctctttacccgcaacccttgacgctgtacctcattggtttgatggtgaagggcgtgggtgggcgaaacctcctcgcccgcaacccttgaggccgtacctcattggtactatggcgaagggtatggcgtgtggcgaaacctcttcgcccgcagcccttgacgccgtgccatattggcactatggcgaagggcgtgggttggcgaaacctgttcgcccgcagcccttgatgccgtgccttattggtactatggggaagggcgtggcgtgtggcgaaaggtgtgcagaggctgtcacgccctgataaattcatcccgaaataaaaattattttctaaaaggaataatagaattaattaaaattcaaaaagaaattgacaaacactaaaatacctgctagaaaaattcgaatgtggtccggagaatttttgttaaattctccttggtctaaaaggagccctcaaattttacttgaattttcagagcaccgaaaatatttattaaacaacaacaattaacaaagtttattaaaaagaaaaagctaaaaataatccccctcctccctttgggccaagtctggcccaaagtctccctctctccccctcggcccacagtccaaatccctctcccctctctttgtttttctctctttcctcccgggcagctcactccctcctcctccttcctctcggcctgcctcggcccagcagcccggcccaagccaggccgagccaagccagccgcgtgcacgcgcgccgcgcgtgcgctgactgcgcgcgctgaccgcgtggggcccacgcgccggtcgtcttcctcctcccgcacggcctcctctctctcccgtgaaaaccctagttcgttcctccctcgaaaccgcacgatttaagcattggattccaaaattaattggggggaattaatcccctttccttcctctcccttttccccctaatctcccctttaa

SEQ ID NO: 54482 - DNA, 726 bp, Oryza sativa
attcctgcagccccatcgacaagtgtatgtaacgccctccgcctcatttccatcccctcctcccccgtctcgtatcccggcactgcattgcttggctcgtgctcgtgtgcgcgtgtgtgttcgcgcgtgcgagtgctcattctgccttgcgtttcgattggttactcttcacattgtaatttgatgctgatttgcggtgaagtagatggattctagcctattttgtgtttccatttttttttggggtctggttgttttgtgctgtgcgtgttcggttgcttctagtttttctccctcaatttcgtgtgttctggacgtaaattagcctcgtatcgtggccaattttttcgggatttttcgcctccccacatttgatatctgttttgggctatttcctgctgatcgatgtgtggcatgtgagagggctggttcgaatttatccccattttcagtcaattttacccgcgtttggtggaactcgtcggaattcgcccccggctagttcaaacatgtggggttctgcccattagttgaaccagttgtgttttggtgaacttgagtgtatattagttgaaccagttgtgtacttggagggtttagggtttaagcttgagtccctcttgtacttttacgatttctggtggctccctaattctagcgagttcaatattagtaagttgttttggtgtgatcctgacttctccctgggtttcattcttcatatgg

SEQ ID NO: 54483 - DNA, 375 bp, Oryza sativa
atcctgctgggctgggtgaaacggcccagtagtaattattcctcccggaggagaagcccaataacaagacgattccagaaggcccgagagcctcaagtagcccacctcgccgcacgcaacgcaacgcaacggcacaagcacaacaccacttcgagtgtgtttgtcgtctcgcctctgctgcttccttctcctacaagccgccgctccgacctcgccgtcgccggtcgccggccgcctccgcctacaggtgaggaaggttctctccgccgcagcggcctccgctcgacgtctttgctagggttttggggtgatttttcggttgggttgtctcctgatcgcattttgacgcaggtgcggggggtctgtgtgagcaga

SEQ ID NO: 54484 - DNA, 1003 bp, Oryza sativa
gtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccataataatccatccattccatgttcaggtgatgagaatattcccaaagtgtagagttgtaaaaccacctaatgttgcctaattaaccagcgaagcatctacctaaattcatactagtggttaccatgagtagagtgcccactagttggggttttgtttattctagggtgaacaaggtattaatatcaataacaataataataaggtcataacaaaggtaaataggcatggctaaataaaacagtgataacgcgggaatttaagtaaagtggtaatgcaataatttaaatcaaaataattttataaactgggattcaatatgctcaaggatgatgtgacttgccttgctcactttcccaaacgtcggcttcaacctccacgaagagcggatcttccgaagctgcagcatctacacgaccatcggaaaagaaaatgattttactctaataaactccatataactagcaagaacaaagcacaaaaatgggttcttgacttcttaaggaaaaattagagacttaaatgatccaattccgagttcaaatggccaagttatggccatttgaagtttatatgctctttaaatgaatatttgcgaatttcttcatttaaattttaatttaaaaagggtttattgcgtcacccaaggggaaggggcgcgcggaccgggtccacggaagtggggcccatgcggcagcctcacgatccacggtggatcgggtgcacccgggctcacaccggccggcgccgtgggccccacgcgtcagccgcacccgagggcgcggcgggctgacggccgggccccacgcggtccacggtggcggcacggctcggctcaccttaggtcgatggcgacga

SEQ ID NO: 54485 - DNA, 875 bp, Oryza sativa
  unsure (1)..(875): unsure at all n locations
aggtggacgagatcggcgaggatgcggcgaagccgaaggagacggcgccgagctggnagcgggtccggggcgatgacagcggcggaccggagctcggcggcgacggcggagagagagagcgacgtcgcgagctcaaatccggcgagaagaaaggccggcgagaggcgaaaacgtacgaagnaggtgcgggggagggtttaaatagggttggaaggggagagagcggccggaggggaaggaaaccggcgcggcgctctcgggctccatcaatggtgccggcgggattaggggagggtttccaaacgaatccaagggagagagggagggaaaattggggggaaagggagaggggatcacggggagtgattccccccactttattgcacgcgaggacggcgggaggtggcgggattcgcggcggcggcggcgctagggcgcgtggaaggcggcgggagcggcggaagaaaggggatgacgggtgggccccacccgtcagtgagggtggcggacgggcccgcccgtcagcggcgcgcgcgcggggagggaggccgaatgggccgcgggggagaggagagagagagggggagggagatgggtcgaactcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgac

SEQ ID NO: 54486 - DNA, 995 bp, Oryza sativa
aatcaattgaagaacaaaaagcaaggctcaaatcggctatcaaaaatgttgctgacctaaccaagtccctgaaagtcatctctggaactgatgctcaagatgcccatgctattgtagaagtagaacaaattaggcaaagggctattttggctatcctatgatacttgtctcaataacttttgtgtaataggacttagaaattttttgtaatcagctaagatgctctagtactttactgtcttgacaatcctttgtgccgattaatatgactttgaaattcgctcaaaaaatttgcctcaaaaaatttgcattgcattttgataatatcggctcagaaattcccctagggggcatgtttcgagtttgcttataccattaaaccgtatgcgactaataatcaagctgagtatgaggcagtgctcaaagggttgcaattactcaaggaagttgaagccgataccattgaaatcatgggggattctttgctagtaatcagtcaattggcaggagagtatgaatgcaagaatgatacattgatggtttataatgagaagtgccaccacctaatgaaggagtttcggctagttactttaaagcatgtctctcgagaacaaaatattgaagctaatgatttggcccaaggggcatcagggtataagctcatgatcaaagatgttaaggttgaaattgcagcaatgacagccgatgattggaggtatgatgtgcatcagtatttgcataatccgtctcaatcggcttctaggaaattgagatataaggcattaaagtatactctgttggatgatgagctttattatcggacgattgatggagtgttacttaagtgtttgactgccgatcaggctaaagttgcagtcagcgaagttcatgaagaaattttggtactcatcaatcggctcataagatgaagtggttacttcggcgtgcagggtatttttggccaagaatgctggaggattgttacagatattata

SEQ ID NO: 54487 - DNA, 1501 bp, Oryza sativa
ctcgttccttatctttggtaaccttagcaagggctcataaacgcgattgaaccaagtcctccctctcatcggccataagattataatactcatcgactgtcaaaccgtcttgcaattctatccttctatagccgattctaacttcccatggcaaaacagcttcatgtctataaacaagcttataaggaggaacttgaattgatccatgacaagccatccgataagaccacaatgcttcggccaaccgggtatgccattgccgaggataataagaaatcttctgcttaattaattagatcaagctcttgttagatgcctcggcctgcccattagcttgtgcataatatggtgaagaattcaacaatttgatacccacgctgtcggcaaactgaacaaactcatcggacatgaagattgaaccttgatcagtcataatagtttaaggaataccaaatcggtagattatatgttcttgaacaaattgagttgtatccccagaatcaactttcttcaaaggaatggcctccacccacttggtgaaataatcagtcgccaccaatataaacttatgtcctttacttgatggtgggtttatcataccgatcatatcaattccccaacctctgaaatggccatggcttaagaataggattcatagtcgatgccggagctcgctgaattgccccaacttctgacaatcttgacaccccctataatatctgtaacaatcctccagcattcttggccaaaaataccctgcacgccgaagtaaccacttcatcttatgagccgattgatgagtaccaaaatttcttcatgaacttcgctgactgcaactttagcctgatcggcagtcaaacacttaagtaacactccatcaatcgtccgataataaagctcatcatccaacagagtatactttaatgccttatatctcaatttcctagaagccgattgagacggattatgcaaatactgatgcacatcatacctccaatcatcggctgtcattgctgcaatttcaaccttaacatctttgatcatgagcttataccctgatgccccttgggccaaatcattagcttcaatattttgttctcgagagacatgctttaaagtaactagccgaaactccttcattaggtggtggcacttctcattataaaccatcaatgtatcattcttgcattcatactctcctgccaattgactgattactagcaaagaatcccccatgatttcaatggtatcggcttcaacttccttgagtaattgcaaccctttgagcactgcctcatactcagcttgattattagtcgcatacggtttaatggtataagcaaactcgaaacatgccccctaggggaatttctgagccgatattatcaaaatgcaatgcaaattttttgaggcaaattttttgagcgaatttcaaagtcatattaatcggcacaaaggattgtcaagacagtaaagtactagagcatcttagctgattaca

SEQ ID NO: 54488 - DNA, 924 bp, Oryza sativa
acatgtttgtggtgtttaaattcacatgattccactcaataggggtttaaatcctggtgtggtgtatgccaatattacatatatgagtgtgcataagaatatcttaggaagaacatgtaactgtttttctatttcataacaaattaatagagtgcacaacataacccttaataatcaaagaattttagtgacagtgtaaaaattacattagttgatggtttgaatattataacaacgaggctgtgttcgggaggcgaggttgggaaccttgcctcctgacacggaaaacgaagcacgtgattatagtgagactaattaagtattagcctaaaaaacttgaaaaatggatcaatatgatttttttaaagcaactttcatatagaaaactttttaaaaaaatgcaccgtttagcagtttgaaaagcgtgcatgcggaaaacgagagaagtgagctgggaaagaggggtaaagaacacagcctaagtgatttcgcgtacatagcaatgctattgtaaatgattggagaattggagaggcgtattctcgttgcatgactggtttgattacactcatgcatgtttgtatataatcataacaagtcatcagatttagtagctgtacttcttttgataaatctttttggtaaattttcatatgatcctactcccattgttcctagcttattagcccaaagctttcacatctgaaaaaggcacaccgagtcaggggcgaaggcaggcctggaacaatttgagcttgggtcctaggtttgcctctacaatgatgattaaattctcttaattcactatgtaattttttttaggaaattaatactctattagttaaaccctacttagccctaggttaataatttctagctccatcattgcaccgaatggaacttcgcatatctgagtgagagcca

SEQ ID NO: 54489 - DNA, 362 bp, Oryza sativa
aggaaactttactatggttgtgtaccaaacaatacaatggattgaaaacattgggttagagtggattatatttttctttgttttcccataaaagtggagggatagaaaattttcatctggtgcattcctttgaacgaacgatagtgcactgtccattccaaggactatatattactgtacttttccttcacaataagccctagcagtgcaagccacgcttggcttggcgtgccttcagcctattccaacaaggattttggaccaaaattcatctctaggtcacccaccccacagtgctgtacccacgtcttcctcctcatcctaatccccacgccgcttttctcggcttttcatccccacac

SEQ ID NO: 54490 - DNA, 430 bp, Oryza sativa
ggtggatccttagggatattgtgcttttggttgagggtgttcgaatcccctaaagagctacacaattttgtctctttttttttacaaggcgcaggtggcctgcggctagcccatgcggaaaatgggccgggcccagctgaagggggaaagcgtaagagggaggctgggccgagcccaagagaaggagagagtgtgggtgtggccatgtggggctgcaggacagccagaaatggcccaagagagagtgtagtttttcattttttaaaaaattcatttgaacctcaaattcaaatccttttcaagcaaaacaagttttgaaatgccttttgattatcttcacactgtgaagattttaaaatcacacactgtgacgatctggataaaaccatcatgagttagcgggccaagaataaccactggtgcacgtcca

SEQ ID NO: 54491 - DNA, 209 bp, Oryza sativa
ccgggactaaagatcccgggggggtctgacaggtcctgacagcattcgaaccgggactaaagatgatgtttagtcccggttggtaacacaaaccgggactaaagatcaaatatgcccgtttcccttttgaaccgggactaaagatcatctttagccccggtttttattgcatccgggactattgtggaaatcggccgaccgacgaaaga

SEQ ID NO: 54492 - DNA, 952 bp, Oryza sativa
gggagtaaagaaaagatatttacttccggttgttctcaacaaccgggactaaagatatctttagtttcggttgttctcaacaaccgggagtaaatatcttttcccgctatttcgaaattctttttaaacccggttagggttaagacccgggactaaagattatagcgctgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 54493 - DNA, 743 bp, Oryza sativa
aaagatattacaatcctagcatctgtcataagacactaaaccagtaacaaaccatatatatatttgttaacttagatagctatatcattttagtttcttgatcaatttcccctgccgacttttttgtattaggagctggagtacgcagcttggggacgaacattggtgtcgcatcgaccaacggtactgatctaattaaaccacatgagacgggcgtccagttctccacttgggcccaaaaagagaacgtaaacatacagtaatattgattggtattgtgcacacaagactccagagattacacaccattatccacaccaactaataaatttaccaaaaaatttaaaaataattttacaagtacttccaatagtattgtacttatgtataaaatcttaacatcaaatttattatattttagacgtaataaaaaaaataaaaaatttaactgttttgagagtataaatatgtcataatttatcttttttgttgctctctattcaatgaatttgaagatgagactttagaagaggtgtaatactactgaaagttcatgtacaatttgtttggaatttacggttatattttttagttggtgggtatggtgtatataaaaaggcttgtgtgtatagaaggattcccagtatttattaacctagctactagtacattctcaattaatttctcaaatcctggcctgtttattttgttaattcttcagggaaagcaacacatggaagctc

SEQ ID NO: 54494 - DNA, 1442 bp, Oryza sativa
tttttagcttcatgtaaggttgtaaatggatataaaagaatggcatgaaataaatatcatttcttgttttcattcacaatactaaagttttaatcctaaaagtggtaatagataaatttgagcagtcaacattaaactcgcatagtatgagctcctctcatcctaggtgacttggtgccatctgattaaaaaaaaaaagacatgcctagctccaaaatagatttgctccacctcctacctccttgattcaggacttctctgtttccccccacatcaatgtcttcttctatcacaaatagtagtcaacatagcacctgacggtgtatgatgaatcttcatagccaaaaaatgatattccagcacaaatgatcttccatctctttacaaccagcaaattgcaagcaatgacaggttgatgattagccatggcatgagaaagttcataactggtactgaccggccagggttgacggagctctagatcggcgtcgctgttgaaggtgggaaatgggattgttgcagtgatctatagccaccgcagtgggggataggcagctaaggatcatgcaggaaacaccatatctgatctaaaaagaaagagccatgctcagtgccaccaactgattagtacatgcttgcttactgatcacaaacaacggaaaatctcataaaatagcagcactgaagtcaccaaaactgaaagaaaaattgcatccacggtagttctcgttgagcaggacatccgctcctcatccagggtcaagcgccatccttcgttctgcaaaaatgagtaaaaaaaatcaacataatatagcacaaaactaaatatgactcaagtcaatagtacatatcagttccgcaaccaggatctcaagcacaaaactgaatactaccctagttagttcccttcctattcaatcaccattcctattcaatcaccattggaggcactgagttcagctaatccaattatatgaattcagggtaagagctgcctacatgtgcatcaaagggaagtgctatcaataacatgtttaacataaatgtaccaagtttcacccacgatgactcaaaatgatgtaattaattaagcattgactaatcacaagtttggataaggttatgttatccttattgtaacattatataatgagctttgaaggagaattttatctcctgacctagtagtaataaataaataaattatgacaagattaaaccaaaatatacatccatacatgccaaaaggaaaatcgaactttaaagattcctagactcgtagcattcgatcagtgatgaccttgaaaaagaatctcccaagaaatacaaggaagcagatgtaaaatcaaaggtgtttttgattattattctgtgatgaacaattgggcattggagattattgattttgtatttggaatttattcacgaagtggttttggaga

SEQ ID NO: 54495 - DNA, 1501 bp, Oryza sativa
tatcagagacctttctaacacaagtgttttggcttcatgttaccagttctaccagtagacagattacatcttgtaagcagtatggatcactgacttactagtcaccataataaggtcacataatatcatagtggccactacactactagtattgaaagagaacgaacaatggggcaagacctaagtttaagagtttattaataaagaagtttatttacaaagccgagcaaagaaggaaaaatgacttaaaagaagaaaaccaaaaggataaaagatcttccgaggatacactagacgctgatatctaaaggggtgaaaacggtcgggaaattcctgaccgaccgacactcgcttctgattttattaaccaagctatatgaaaatggtaatcggtgaaaatagaaatagtaaacaaaatatagaaagtggaacaattttattgatatatcgattgtttctgtattttttttattcttgtgaaaatcaatgtttttataatgtggtaattagcaactttctaaatataccaatatccatagtccatatctctatttaatacattgttgagaggcctaaatcacttattctcgtgcgctaacttttcattctagcttgcaagtttcgctttaattttttttctagtttgatattttaatgtgtcaattccaattccattcatcacacatgtacagactccagagatcatgttgatatttgtaaacgagtaaattctaccggcggttcttaaacttataaaagtaagtttcacctaaatccacaaacttgtaaaacacgcatcaagatccctaacacatggtttattgtatcatcctggtccaaagtcccatttactcataggcttgactaacatgccacatggatgatgacatggccaaattcctccttttccacctttttttctaccattcttcttcacttcttcctccaccactagatgcactagcggtgacggtacaggcagccgcaacaccaaagtacaggcagccgcaacaccaaaggcaggtggagagagagagagggaggcagtgagagcgacaacgctagtaatcgggggcagaggcgctggtggcggggtagacccaacagcagagcgaatatcagagcccttagctattgttcttgagaaatggccgggtctggcccattcctcaaaagatgtttttactagatccctatccacaacaatttatacttctggttctggcgaacaaatcagcattaagtctgggggcaacgatgacctcagaccggttgtggtttgctctgatgggatttgagctgggaggagtagagggcctgagccaacggaggaggtcgcgaccagagaagatgggtgtcggcaaaagcttgcaccgatgggtacggtggaagcagaggggaaaaaaaggagaaaaagaaaaaaaatttcatgccatcatccacatggcatgccacgtaagaccatggtcaaaccagactttggataaggatgatacaataa

SEQ ID NO: 54496 - DNA, 251 bp, Oryza sativa
cgtagcgtttagcacgggcatattactagtcttgtaattgctcatttatatctgtaatcttgctttgataacatatcacctgaggtctagggtgctgacatggctgtccacggtaaccagcatcttgaattttagcctcctttaaaacccaccatggtgataaatttgcacttagcccttctctctcaatttgtctccgatctgactcctctcttctctatctcccctcttttaaatttgggtggggaaaa

SEQ ID NO: 54497 - DNA, 1501 bp, Oryza sativa
atgactacctccgtcccaaaataagtgcagccatggttttcagcgctcaactttgaccattcgtcttatttgaaatttttttgaaaaaaattaaagacataagtcacgagtaaagtactatccatgttttatcatcttataacaacaaaaatgctaattataaaaaaattttaaataaaagaaacgatcaaagttgggcgcggaaactcatggctgcacttattttgggacggatgtagtattttataggttgaatttcttttcagtagaaaatctagagcaatctgttaactgatcaagttttggggagtagtatagatgtttttcttttcctgattgacaaaaggatccagccatgcgaattgatgcaatgctaaagtgaagctccataaggagctgatgtgtacagtgtgtttactagttccaatagccaatcacttatacatgccgcaagtaagataaggacagaatcatgttagggtgctttcaatttcagtagtgcatttcataggattactactagctatgtgagcattcattcattcgtccataagaccataacatatagccatcatccaaccatacatagcaagtctcaattgaactagaaacttagaactacaaacagataataaccattagcagagcacatcaagttgaacaacaggagcagtctatagtcatcacggttggttcatagaaacatcaacccataagaagagaacacaaatcgtagcacatgagaggaagggggaagaagttcacctctggaatagataaccaaccgtacgccacaggagttgcgcggtgctcagcaccggccatctcggcggcggtagggagtcgcagcagcagcagcagcagaggaggaggccagcggctagggttagcttgggaccggattcgcggggagctgcgggaccaattctgggtggcggcgactgcggggtggttgttgggggggggggggtcgccggagtggggcgcggcagccggcgcttgggagagcggcggcgttgtcggcgctgccggaaagcggcggcgctggagtctggacagaaggatgggcttttcgagttggaataagttcactataggtaccttcccctatttgtcccttatttgtcgggtcttttaactatttgccactcttacgatcggtgcttaacgatttaccactaggcccacatgttatagacacatgagggcccatatgtcatagatacagtgtggcaaatcgttaattgtcatgtcacaaaagtggcaaataactgcaaaaccgggtatgacatgtcccccaacttataaaaaccaggcaaacgtggtccctcagcagttttgaagtctgttttggctgacatggctcatacgtggcttgtttgactaggtctccgtcccacgtggcattgacggggcgcttacgtgacaattatatctcagcaaaataataaaaagtgtggccccacatgtcagctgcaaaaagaaataattttaaaatggt

SEQ ID NO: 54498 - DNA, 546 bp, Oryza sativa
atttatcttgttttgcgttgttttccaggattcttccatgcagaaaagcctatatttatcacatatgctgccttccaaatctttttttttccttctgatatgtcattagtatgttctggtttcgaactaattgtcattcaatactgtaaaataaagaaaacgtttagtgaccggccgtctaccagctcaaatgggaagggacggtttcttttgtctttttttttttattcagcaccaatttttcatgatttcaggaggtattccgttcaagtgaactagagtcgatgctttcaaaaatgttaacttttatttgttttgcagaaattgcgttaattagcaagccataaactcatacagcatagaagttcactccaggctgcaaaaatcaaaggccttgattaatggagattgagatcatagaagttcactccaggctagttctgttgcctttcgtttcacagtttgttgctgcgagacaacattgatagtactatttaacagtatatttctaattatttgacgaaacccgctcttttgatctgcagg

SEQ ID NO: 54499 - DNA, 1501 bp, Oryza sativa
aacggatcgaatatggtcggaaactagctctatcatattcgttttcatatttttttctcggaatcgaaatcggaaacccagatacgaaaacggaatcgaatatatattgaatacagatacggagcgaatacgaatcgaaacgaatatggtgacgaataattatcgaaatatcaaggcccctcaaagtaagcttcttaaatcgaggaagagatatagccattagttttcagaaacaaaacatcaatattttaaaaatggggagatagaaaatgttgtgtttactttccatacaaatttatgttatcatgaaacaaataaattaatgtgtatcactgaaattttcgtaggcacattgaaatatttgaaaattggttgaatattttaaattttgggttgaacatttcaattggagttgagaatttcgaaattgaattaaacgttctagaatttgagtagaattttttaaatctgagttgagagttttgaattcgaactgaaacttttcaatttttgaattaaaagtttttaaaattttcagaattgaattgaatgtttttgaaaatttgagtggttatttttcagaattgaatttttccatttgtttgtatgttaattgctattccttgtttttttatatggtttgttttgttctacctaagtagagaaaaaaacatgtttttgcataagagtactggatatccgatgaaaaataccggatagtatcttaccgttatccgattccgacagatcacctatatcatattcgtttacatttccgaaaaaaaaatatccgaattcaaaaatttttggatatatccaactgaaactatccgaatccgaaaaaatgtccggtggtagaaactatcctaatcactttcaaccctagttttagtgatgtgctaagaacataacgcgtagtattgtcacttactagaggttatttatatcatctcttcttcctactcagtaggccggtacaaagtggctatatatggtcccgtactcctgtatcgtcgtaatagacaataatctcaagttgccgtgtgcctgccaaagtcacagacttgcacaatcaaatatttgttctgtttccccatcaattaaaacaggtatcaaagcaacacacatatgtgcagattaacagtagcttcctgttcattttattctccaccaatatacaggcgtacagcaactggagctgcagctgcatatatgcatccaaatctgccagtctggagaggcttggtcttggtgattgaccaaagtaattaaacgccgatggcgtcaacggagactaattagtctacctcctgcctaattaattccatggttcgtacatgcttgccactcatgtccaaatcaacacttaatctgacagttcagtttcccggcagctagcgtcgccgctcaacaatcaacagtcaaacttgaatcgactttctgctatacatacgtactcccaatatattctctgctactatatgcttctccaatatttcca

SEQ ID NO: 54500 - DNA, 1501 bp, Oryza sativa
aatatatactgatgcccatatatattgctgtccagaacagtaatgtgtccagaatgtatcaatatatacacatttctacatatatattgatgtttgaactgaacaacaaagctaatgcaggaggtgcatccagaaagaagcgcccgtcgttcacctatcaggtgagggagctgcagtctgacgccgccactgccccgacgtcgaaatgttattgaaagcggcgtattttgaagggcatcccaagttactcacctactactcagaagcatatcatcatggtttgtcttgctttgcataactttatccgtgatagcaatttacgtgataaggagtttaagagatgtgatgctgatgaggactacttactagaagatacaagtgacacggcggacgatgagagtgaagatacagagaatgataataccatgaatactattcgcactaggatagctgatgctttgattagaacaagaggaggatagttattttgagatatggtatcattgtatgaactgtttatcttttgctctgtttatgtggaccatatcactttgatggatgaaaagctaatatattttgatgaaaaactttgatggatgaaaaacttataaatgttttctttccaaatcggccttttaaatatgagatattggacatattaggtttttacgagtaatttgcatataaatagtcctacactcctaatggcttttaggggcattataggtatttcttctagaagctacagtttcaccgctactctaaccaaacgggcttctgcttttcccacaactgatttttcacagccgcttttccacagcccatagctcacaacagcttttccaaaagccacagctcaaccaaacacacccttagactgtgttcttttagaggggttgggaatcttcccctgactcataaaacagagcaatagattagcttaaaaatagattaatataagtttttaaaagcaattttcaaacaatgcatcgtagttttgtgactaaatcaattctaaatcggtagttttatgataattttgttaccaataaatatataattttatgacactctatctttaacgtgtagtttttttataaatttaatgttaaatctatagttttttaatagtttggtcataatatttgtgagatttttatttcctccaaaataaacctcttccattcaggaaattgaaccgtccatgggtcgtgaaagagcccccacagtagcggaaatgttcaaaggccgacggttaggtcatagagccgcgaccccgactccccgaagcactaggccctagaagcggggggcacgcggcgccagagccaccgactccgccggcggcggccggatccggcgagcttgcggcgccaggctagggctcctcctcgccgtcgtcgtcgaccggcggctaatccaccagcgcctgggtgatcggtgagtcggctcttcgtttcttgccgcgcggtgcccttcgcccgccacctgttcgacggaa

SEQ ID NO: 54501 - DNA, 1271 bp, Oryza sativa
cccacaacgccacgccgcggccgccgtcgcacgccggcgcgccaaccgccgcctcgatgccgccacaccgccgttaacgaacgagaacgagaacgatcgaacgaacgagagcgagaactaacagatgcatgtacgttgccgcgacaacgtgaacgagaacgagaacgatcgaacgaacgacagcgagaacgagaacgatcgaacgaagacaagcgagaacgagggaacgaacgtgaatgaggacaagcgaacgaacgtgaatgagaacgagcgaacgaacgtgaacgagctagagaacatgaacgagcgaacgaacgaggacgaacgttaacgtgaaatgcaatatatatatatatatatgtatatatatatatacatgtatatatatatgtacatgtatatatatatatgtacatgtatatatatatatacatgtatatatatatatatatatgttacttcgcatttatcctaatacattttttttatcttgcagaaaagacgtgttgtcggagtcgtccgtcaagcctgagtggaagaacagcttgagtggaagacctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcccgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacacacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 54502 - DNA, 1501 bp, Oryza sativa
agctagtatgtcagataactaggatgtatgtatactatgtactccccccgtcctataaaaaacaaatctaggaccagatgtgacatattctagtacgatgaatctggacatatatgtccagattcatagtactaggatgtgtcacatccgatactaggttggttttttatgggacgtagagagtatactagaagtataggaatatattcttttctattttctttccacttggctgtaacatcgtgaaaattcccgacaataaaaaaatcactaaaattttgaactttttaaaacttgttgcatcatgctggatgttatggttgctattgcttgccaaactataaattgtcacaatgaaacattaacttaaggatgtacaattcgctagaatattctatctatcgattccataaatattatgcaggaagctaaatgaaggaaaagttaattattaatttgtatggtatgaattacaaaccaaatattaaatattcaaaccatgttgatagcttggtttcatatttaacaaatggaaacagtaagattaaatggaattcatctgaatccaatctcacgtgaaataatgaccacttcattacaatgatcccatctataaaagagtgtttcgctggaatatttaaattaatatttaaaacactttatcaagcccatatggtgtagaattcactcatataaataaatagagtaaatacatcactaccattataatggtcacattagaatattttaattaatatcaaagcctagaagttatattggataatttttggataatctaatggaaagcaaattcgtttgagaactaatgaataaataaataaatattcaaatgaaatatttgaattaccaaaatccaaaatgtgtagagctacatttcaattccaaatccaatcttagccattttgcagtttagcccttccctttttccctctttctccttttctcttattttccaccggtactgttcattgcgcaccatgtgctcgactcggactccacccggtcgaacacccgacgccgccttcttcggtcgcggatgtgccgcacgcccacttggcgtgaccgtgcgccgcaccgcgtcacgccgcgccgcttgggcccgccgcccgaccgagccgccggattcccgcataaggctgcgctgccatgagcgcctgcgtcaccctatcccgtcgcgagtcgccatcgcatcgccatatcatcgcccctagctgagaccgttggataatgcggcgtttcttccccagctaggactaaaactagcagactataggctataggcgcaatgatggagccacagaactttaatggagaaggagatgaaccttagccatgtcatccacctcattgctcttatccgatcgccattagagctccagctcatccaggccatgtgctggcgatcttatccccatggtttccttacaccctaagctaagcccccaataaaatccccattcttctcagctttcttcccgaa

SEQ ID NO: 54503 - DNA, 1501 bp, Oryza sativa
tcggtcgcggatgtgccgcacgcccacttggcgtgaccgtgcgccgcaccgcgtcacgccgcgccgcttgggcccgccgcccgaccgagccgccggattcccgcataaggctgcgctgccatgagcgcctgcgtcaccctatcccgtcgcgagtcgccatcgcatcgccatatcatcgcccctagctgagaccgttggataatgcggcgtttcttccccagctaggactaaaactagcagactataggctataggcgcaatgatggagccacagaactttaatggagaaggagatgaaccttagccatgtcatccacctcattgctcttatccgatcgccattagagctccagctcatccaggccatgtgctggcgatcttatccccatggtttccttacaccctaagctaagcccccaataaaatccccattcttctcagctttcttcccgaatgcatttcatcgaacaccttgcgatcactctctcaccaccactagagatcaccattgcgaggcttcccggccagagctggaggttggagggagtggaggaagagttgtgctcctgccgtcgccattgaaggacccgaggaccgctggacaccgggaaccacgcgtcgaacactttcgggcgtcaccaacagctagccgcctccacttcgtccgcaccgcagcacgcgtcgccgcccttcgccgtctctccatcccggggtaaaacctcgagcccatagcatcctctacacctctaatagctagcgccggctccagtttgtacgattaatgccgatggctgtgccgccccgaccgccgttccgccgccgacgagctcaccgtggataggccatcccgggtgctctccctcccatctttctggagaaatcgaacgcccatacaccgtagatgctcctacgcccatcaatttggcaggagaccgtaccaatcacccaagcaccaaacctcctcgagctcggtcatggcagccgtgtcgtgccacttgcctaggcgccgccgcacgccgcattcggtaccagagggtcgcctgagctccaccgcaccttccctagccaccgtcgggtcgccctcggccggctctgccgtgcgtgccgtgttcccctgctgctcccgcttggtcgggaggaagaagaagacgaaggttgaagacgacctttagccgtgccactgacgagccgtccccactcctcctatttcctttagaaaattaatcctgtgaaaaagaaaatcaaagctttgaccccacatgtcagcagctgttagggataaggatagatttcggattaaaataaatcaattaggaacagtaacttttcgctatttcttggattaattcaaatttgggtctttaaactagcataacctattcattttaactccgatttgagtgaaacttgaatctaaattcatctaaattcataagctttccaatggtatataattcactatttaataacatatattcatatttataaaataattaatgtt

SEQ ID NO: 54504 - DNA, 342 bp, Oryza sativa
agcatcactgtagcgcgctgttcacgcaaccttatcgaactttggctgttcgatatgtccctgtctagcattgtagtgatactgttcatgtaattttttatttatttttggaccacctaccctgtcgaactgacgcagttcgacatgtacctgtcgaactgtggttgttcgatagatatccctgtcgaaccgcggttgttcgacagggtgctaaacttgcgatttcgtctaactgacctatagttttgtgattttccattaaaatcatattgcttttaaaaaaaattagagcagagacgatcttcatgctaattaagtttacttgatatattcctgtacagg

SEQ ID NO: 54505 - DNA, 978 bp, Oryza sativa
ttcgtctaactgacctatagttttgcgattttccattaaaatcatattacttttaaaaaaaattctctctgctcttgttcccctttatattttactagttttatacggaagtcagcacgagtaaccataaaaaatgccaatcaatcacgcgtatatatatgtataaaagaatttcaatgtgattacgaataaaaccgaacgattaccatacgcaaataaaaggaaattcttttatacaaatatgtataaaaaatcaaagtgtttaaaagtttaatacctgtctagttcaaaactagaattattttcaacctcacgaagagtattttacaaatttcacaagtatttttatatttaattttttcgattacgtggtagacacttatacgtatataattctacactacgcgcacacacaccatatgcattgctgggtccacaattattgctttctcttatgcatggaaccaaattaagagctcaaggtggttgatactcctacagcatggcgtatacctaatgcaacaggaaatttccgtatatgtacacatgtagctacataaaatatactccctccgtcccaaaataaatgcagttttgcactattcacatttaacgtttgaccgtttgtcttatttaaaatttttttaatatttctattgctattagatgataaaacatgaatagtactttatgtgtgactaaatatttttaaattttcacaaattttttaaataagacggacggtcaaacgttgggctcggatatccacggctgtacttattttgggacggaggcagtactactcaccaaggcaagcacaatatatatatagataggacaaaatagagctactaattaattaaggagatctaggcagtagggacaagaagctacttaatgcaaataacatggtacgagagcatggattcgatgagcgcctaagctagctattggagaaacttctacgcatggatgcat

SEQ ID NO: 54506 - DNA, 1415 bp, Oryza sativa
taatattcatttataatatcatgtttgtgcaaagaaaaatacttgtggtgctatttattttgctcatatgtatctagtataaagtatatagtttgtgttttttcaggatagtaacttcagtttagcactatgcgatcactggatgtttaattactggatatttgaattattatgcaagttcatctacattattttgtctatattactgttaaacggtgtgtttcgtacgaaaactttacagcaacttcagtttagcactatttcgatccgcccctgctggtttcatgctgaattatagaaaacatctgcactgcccatctgtcagtaaaataaaataaaggtctcgtttccaccacaaagagtggataaagttttgaatattcgtggcacgcttttcaaactgttaaacgatgtgtttcgtgcgaaaactttctatgcgaaagttgttctaaaataatagattaatctatttttttaagtttataataattaaaactcaattaatcatacgttattatcaccttattttacctgaaacactttatctttatcttaatcttcaggagatacaaacaccaccaaaatatgagtgccacctgttagcaccactctctttctttccccaacttctctctgcctcacagtcaccctgcgacaagcacgagctaaagctccaccatagggactttaggggcgccatcgtttcgctttttttctaataagccaaaacggcttattagaaaataaaaattgaatttgtaggtaaaacttttatatatgtgttctttgtgatttaaaagccaatgctaaaaaaatctacgttgaaaatatctcaaagtcattctcaaaattaagtttgaaaatttaaaatttggttttttttcttattaggccatccgatgggagcctagggaggcagttgtgtagccagaggttgccattgcaatgaattttctcaagctagctaaagaactgttgctactgtgtttgcacatgatgctagtctacgtgggcaagtattttctacacccaggtgccataacatttaagtgtatgcatgtagttcaaatagttatataaaaaattcataaaatttgataagataaactatgacgatataagactctatataaatatgaagtctaaatttgatctacacatgaagaaaaaataataaattttatctgcgttatacaggttctatttactatcagtttctattatttttacactactacaatagatatttttgcgtgtggttgttttgatttttgcgtgcggtagattcgcccgtttggagcgggctgtctgggaaaatcgtgattttctcgtgcgggtgcttatgtcacccgcacggaaaaataaaaatctgaaaaaaaaataaaatttcaaaaaattgaaatcctaaccataga

SEQ ID NO: 54507 - DNA, 1501 bp, Oryza sativa
aacacggcattatctccggccattgcaatccagacgtcttctaggtgatagtgctgctacaactgctaacttgtcatctacaccgcactgaagatactgagcttggaagatagcaagatactgaagctgcaagctgagaaagatcctattgtaatcagattatggcgcattttgatcttccgaaaactgtacttagacctcgtctatgtgaaccgaaatcgagtgaacaaaggacattttttatcttctgaattctgctagcaacctcgtgccatgcacagagtcctgtttgttatggaataagcatggcacaactgtagtggagaattgtttaatgctgtgtaaaatgacagaataatatatgtatgccctttgttttagctgccacaatgcttcttgatctgaatactaatcttctatagcatgatatactatagtccaatcgcaattcacatgctcatctttaaatacgatatcgtccgtaaacaattaacaatctgttccgagcatgtactgcatgtttaaatacaatatcgtccgtaaacaattaataatctgttcaaagcatctactgcatgttataaggtttatgcacaagcgaaattgcatccctttgtacagtttctccctctcttattataaaaccagcaaaagctggcttaggtttcaaaataattgcatccctaagtaaacatggcctttgctgcagggcttgactacttgtctccatatggagtaatatactaatcactcgccattctcctgctcgtttaatatggctggtcgtgtatccagctagcttgtgacatggctagctattcctgaacgaataatgcccaatctcaaagcaaatctagtttgacatcctcacatatttttggatagagcatcccaagctggaacagcagtagagatttattggattgaaggacacatgagacaagccacccgaaggggaaaaaaaagggccttaaatcagcctttttctcattgactggaaaatggggaaagaaaggaataatgcgagaatgtttagagaaaaggaagctacaaatcatcaaataattattcgtttccaagatgatgagctatgatgctggggtttggccagtgcaaaacacatgggaaaattgttgtcacgaggagtaaggaggattgacgtgcaagcatgttacagttacacatgtacagttttttccttacttttagcgtttggatgtataactaaacttccctctattaatataacgccgtcaatctgattagccgtttgaaaaaaaaactcaattcctgaacaaaatatctgaaagttctgagtttaccggtcgatacccttaatcagctggaaatttgaatttagaaatacaaaaacatttgaattgggcgtcattctgatttcaatttttcttttggcatcttctcaagcttgctttctcattgcaaaattataaagcttgctttctcattgcaaagtttgcaaccactgcaaagctgaaacaga

SEQ ID NO: 54508 - DNA, 1501 bp, Oryza sativa
ctgttagtattggcgatgattttattgatctcatcgatctttgattttgatctgagtcttttttttggctcatcaattttttttcattgatggaaccgagttggacacaacgaactatgcacacggttcacacaacttgctcgggacatggaaacagacggacgaacggaaatttgttctttgcctcggcagccagattggatgctcgtcctttgaaaatttgtgacttttttttttggaacctttagtgcttacccgattggctctccatggctattatgaagatctttgggctgattcgatcacaaccggatttgccacatcgtgaggtgttgcaaattaaggtgaaagattagttttttttatggatttggtatttatttatgtgttttggcttgcacctttataatttttgtagcatcaaccttgtgtttgcattgtgttattcaacggattcgattatgtttttttttttaaaacaaaacaatggaaaactaattatggtaagtgtttatgtaagattggatgcttgggatttttgtccgtgtataataattataattaatgattgtttgaatggatttagattgatactttaattttgtgtcttgtaattcgtacataacgaaggctatcaccagggtcctgtttggatctcctggtaaaaattttcgccctgtcacatcgaatatttggatacatgcatgaagtattaaatataaacgaaaaaataactaattaggcatattgcatgtaaattgcgagacgaatcttttacgcctaattgctccatgatctgacaatgtggtgctacagtaaacatttgctaatgacggattaattaggcttaataaattcgtctcgcggtttacatgcggattctgtaatttgttttgttattagtctacatttaatactttaaatgtgtgtccatacatcagatgtgacacgccaaaactttacacagcctagatcggacggacgaaaagtggatgtgacagaaaaattactacaggcctgtttagattccctggcaaaattttacaccccatcacatcgaatgtttggacacatgtatggagtattaaatataaacaaaaaaaactaattacacagattacatgtaaattgcgagacgaatcttttaagcctaattgcgccatgatttgataatgtggtgctacagtaaatatttactaatgacgaattaattaggcttaataaacatatgctaatgatggattcattaggcttaataaatttgtctcgtggtttataagcggattatgtcatttgttttgttattagactatgtttaatattttaaatatatgtccgtatattcgatgtgatacgccgaagctttacacccatgtcgtaaacacaaccacgttgatttggcaatgcctcttcggattctagcggcctgcgcttcggaatcggactcgcacgctctccgatctcgagttctgcttcttctcgagttcccaaggctttttcg

SEQ ID NO: 54509 - DNA, 1501 bp, Oryza sativa
ggagataaactttagtgagaaattttgcagggagataggtctgtagcaatcgacagtgttttcttttcccggctttcgtgttagaacaatgaaggctctataatcctctcaaggttagccccaaagttgtaaagatcctagccaacctcattacatcctctttgatccagctccaagcagcacggtagaaactaggtccaaatccatctggtcctggcgcactagttgaattcatacctttaattgaggttaggatctcttcttgagtgatctgcagtccttgtccagctagaaggttcgaatcactttcttcgtctgtatatagttgttgtagatcaaattcccaagaaggctggcccagaagttgattgtaataggagtacataagttggaattttccattatggtcagctacctctaccccattatgcttgatcgatcttattcttgattttctaaaatttttagaggcatatgctttgaagaaagcaatattgtcttgtcccagcttcaggtgtttcactcactacgcctcagtggcggatccagaaagaaatagcagtggggtctaagtaaactagatagagttatagtccctctcctatctacatatggtaaaaatttttagtgtgatctttgtgggggctctcatagtcttcacgccagtagtgggggctcgagaccccaccgcccccatgctggatccgcccctgactacgccagatcctcacacctctgacgggatatctatgacgagcaaacgatttggtcactgatgaccgtcactttttttttgaccggaattactgccaggactttgcccagcagtgtaattttataaaactcgaaaaatatttacaaagttacagaagaagaaactgaataaaactataaagcttgtaaccaattaaaaacaatttgctttaagggatccttcattctgcacatatgcaaaagaacttctttcacaaaaagagatctctaggcttggaaggagggctgaatgctcttaaagattaaaccattcctcttcttctaaatgtgccaggctgccaaaaagaaaacctccaggaagcccctttgagcaaacttgagtcttgctagagcaatcatctgaaagaactccaaattatgattccactcaattcctaggtgttgaccgtcacctttgacgggtcatacgggatgtcgtcatcggtgaggcatctggctgcggtctgtcacaggtatcaccttatctgtgatgggccaaaagacaaagctgtcataggtgaggcagtgacgggttttccctccaacccatcactggtatcacctcacctgtgacgggccgcgtaattataagccgtcacaggtgatgggccgccacctgtgacggatttgttttctggccagtcacaggtaggtcgatacttgtgacgggcaactcaatttaagcccgtttgaggtatgaacaacacctttcacgggctttgtgtacctaacccgtttgaggtgtgtt

SEQ ID NO: 54510 - DNA, 347 bp, Oryza sativa
aggtgggtgcgtgcatgttaaggtgtggcgacgatgattcatgggtaaattttcctggtctgcgtgtgatcaccggtgactaatttgggcgggctaagatgaggaaaaaaaatgcgtgttctttatggcttagatttgtgatcccatttggtcttcacgggttgttttgtgggggtcgaacttgttgttctggtgtatggattgctgcaagctggatccttttcatcagaaagtgggcattttcacttcctttgtggaggtgtaaggacgaagggcatgccaatcagaattagggctcttgtggcgttttggttggatgatcttgtgacgcttgtgctgccctgcgg

SEQ ID NO: 54511 - DNA, 1501 bp, Oryza sativa
gcgtggcctgagcttgacgaaggcgagagatagtatcagtagagtggccaagaagagatactgctccatgtttctctgtttcagctttgcagtggttgcaaactttgcaatgagaaagcaagctttataattttgcaatgagaaagcaagcttgagaagatgccaaaagaaaaattgaaatcagaatgacgcccaattcaaatgtttttgtatttctaaattcaaatttccagctgattaagggtatcgaccggtaaactcagaactttcagatattttgttcaggaattgagtttttttttcaaacggctaatcagattgacggcgttatattaatagagggaagtttagttatacatccaaacgctaaaagtaaggaaaaaactgtacatgtgtaactgtaacatgcttgcacgtcaatcctccttactcctcgtgacaacaattttcccatgtgttttgcactggccaaaccccagcatcatagctcatcatcttggaaacgaataattatttgatgatttgtagcttccttttctctaaacattctcgcattattcctttctttccccattttccagtcaatgagaaaaaggctgatttaaggcccttttttttccccttcgggtggcttgtctcatgtgtccttcaatccaataaatctctactgctgttccagcttgggatgctctatccaaaaatatgtgaggatgtcaaactagatttgctttgagattgggcattattcgttcaggaatagctagccatgtcacaagctagctggatacacgaccagccatattaaacgagcaggagaatggcgagtgattagtatattactccatatggagacaagtagtcaagccctgcagcaaaggccatgtttacttagggatgcaattattttgaaacctaagccagcttttgctggttttataataagagagggagaaactgtacaaagggatgcaatttcgcttgtgcataaaccttataacatgcagtagatgctttgaacagattattaattgtttacggacgatattgtatttaaacatgcagtacatgctcggaacagattgttaattgtttacggacgatatcgtatttaaagatgagcatgtgaattgcgattggactatagtatatcatgctatagaagattagtattcagatcaagaagcattgtggcagctaaaacaaagggcatacatatattattctgtcattttacacagcattaaacaattctccactacagttgtgccatgcttattccataacaaacaggactctgtgcatggcacgaggttgctagcagaattcagaagataaaaaatgtcctttgttcactcgatttcggttcacatagacgaggtctaagtacagttttcggaagatcaaaatgcgccataatctgattacaataggatctttctcagcttgcagcttcagtatcttgctatcttccaagctcagtatcttcagtgcggtgtagatg

SEQ ID NO: 54512 - DNA, 1154 bp, Oryza sativa
gtctcgcaatttacaggcgaactgtgcaattggtttttttcgttcatatttaatactccatgcatgtgtttaaacattcgatgtgacgtttttggaagaaattttttgggatctaattaaacacaccctgatatatatactgctccctccgtttcacaatgtaagactttctagcattacccacataaatatagatgtcagtggcggatccatgatttatgtgatggttattcggaattctaaaataacagatatatcgataccgattgacatatattgactgtacgatacatcattttgatgcataatctttactacgaattgtgcgcatatataataaaatatatagaaacatttataatttcctataatcagcatcaaacaattttctattgatctaatcatctaagtatgagtgaagagtaccaaagaatttggaatttttggagattgtatagcataggtcgatagctttatgtagcaaagatattctgatttattgctaatgaaggaaaacactcataaaccacgaagaaactagtagctagcaaaggaatataacttatttcggtaggacaattgatatcaattagacaacaacatgtagagaaaaataactgagtgggcaatatatatatgtatatacaatttgcaaagataactattccctccgtttcataatgtaaaactttttaacattgtccacatttatatagatgttaacgaatctagacacaaaatcttacattatgaaacggaggaagtaggcattaaagtaattgcttattaattgccacaaccaaaatgtaaataagaaaatcaaattagcatgaatatattacaaaagaaagggagggactaggaagactattgatcttgttgggctgaggagagctagaaaagggtggaattgaattgttagggtataaatatcacaaatcaagatagactatgggggtacatataaattatggtcaatatatattagatttgtgtccaaaaataaattatgtgggatccgcccttgatagatgttaatgaatctaaacacatacatatgtctagattcattaacatctaaatgaatgtgggcaatgctagaaagttttacattgtgaaacggagaaagtagtagaattattgtcaagaagaac

SEQ ID NO: 54513 - DNA, 1501 bp, Oryza sativa
tctcgagccccttcgcctaggaggcattccgtcgaacaggtggcgggcgaagggcaccgcgcggcaagaaacgaagagccgactcaccgatcacccaggcgctggtggattagccgccggtcgacgacgacggcgaggaggagccctagcctggcgccgcaagctcgccggatccggccgccgccggcggagtcggtggctctggcgccgcgtgccccccgcttctagggcctagtgcttcggggagtcggggtcgcggctctatgacctaaccgtcggcctttgaacatttccgctactgtgggggctctttcacgacccatggacggttcaatttcctgaatggaagaggtttattttggaggaaataaaaatctcacaaatattatgaccaaactattaaaaaactatagatttaacattaaatttataaaaaaactacacgttaaagatagagtgtcataaaattatatatttattggtaacaaaattatcataaaactaccgatttagaattgatttagtcacaaaactacgatgcattgtttgaaaattgcttttaaaaacttatattaatctatttttaagctaatctattgctctgttttatgagtcaggggaagattcccaacccctctaaaagaacacagtctaagggtgtgtttggttgagctgtggcttttggaaaagctgttgtgagctatgggctgtggaaaagcggctgtgaaaaatcagttgtgggaaaagcagaagcccgtttggttagagtagcggtgaaactgtagcttctagaagaaatacctataatgcccctaaaagccattaggagtgtaggactatttatatgcaaattactcgtaaaaacctaatatgtccaatatctcatatttaaaaggccgatttggaaagaaaacatttataagtttttcatccatcaaagtttttcatcaaaatatattagcttttcatccatcaaagtgatatggtccacataaacagagcaaaagataaacagttcatacaatgataccatatctcaaaataactatcctcctcttgttctaatcaaagcatcagctatcctagtgcgaatagtattcatggtattatcattctctgtatcttcactctcatcgtccgccgtgtcacttgtatcttctagtaagtagtcctcatcagcatcacatctcttaaactccttatcacgtaaattgctatcacggataaagttatgcaaagcaagacaaaccatgatgatatgcttctgagtagtaggtgagtaacttgggatgcccttcaaaatacgccgctttcaataacatttcgacgtcggggcagtggcggcgtcagactgcagctccctcacctgataggtgaacgacgggcgcttctttctggatgcacctcctgcattagctttgttgttcagttcaaacatcaatatatatgtagaaatgtgtatatattgatacattctggacacattactgttctggacagc

SEQ ID NO: 54514 - DNA, 1501 bp, Oryza sativa
caaagcgattcaagatcttctccacataatgggactgcaagagtgtaatcccattatcacctctaattagcttaatgcttaagataacatcagctactcccaaatccttcatatcaaaattttgagacaagaatgatttaatctcatttatcacctcaaggtttgtcccaaatatcagtatgtcgtcaacatagaagcacagaataactccctcacccccaccatggcgatagtacacacatttatctgcctcattgactgcaaagcctacagatgtcaatgttttgtcaaatttctcatgccattgcttaggatcttgtttcagaccatacaaagacttcaacaatttgcacactttgccttcttgaccttcaactacaaacccatcaggttgatccatatagatctactcatctagctctccattaagaaaagctgtcttaacgtccatttgatgaacgagaagaccaagtgaggctgctagggaaagtagcacgcgaattgtggtcaatctagcaacaggtgagtaagtgtcaaagaaatcttcgccttctttctgagtatagcccttagcaacaagccgagccttgtactttttaatagtaccgtcaggcctaagcttcttcttgaacacccacttgcaccccacaggtttacatccatagggtcgctctgtcacctcccaagtccagttagcgataatggaatccatttcactacggacagcctccttccagtagtctgcatcaggagatgcctatgcttctgaaattgacttaggagtgtcatccacgaggtacacagtgaaatcatcaccaaaggatttagccgtcctttgtctcttactccttcgaagagcttcactgacatcctcctcagtgacatgttcatgtgtatgttcagtttgttatggtggtgtgattgaactgggaattatttcagagggttggctcgaaccactatgtgtatcttcattgggaaaaagctctcgaaaaaggtagcatcacgagactccataattgtaccaacatgcatgtcaggtacctcgaatttaactattaaaaatctataggcaatgttgtaatgagcatatcctagaaagacacagtccacagtcttaggtccaagtttgcgcttcttcgttattggtacattgactttcgccaagcacccccatgtgcgcaaataagaaagtgatggttttctcccaatccatatctcatatgaagttattcaaagcaagacaagccatgatgatatgcttatgagtagtaggtgagtaacttgggatgcccttcaaaatacgccgctttcaataacatttcgacgtcggggcagtggcggcgtcagactgcagctccctcacctgataggtgaacgacaggcgcttctttctggatgcacctcctgcattagctttgttgttcagttcaaacatcaatatatatgtagaaatgtgtatatattgatacattctggacacattgctgttctggacagc

SEQ ID NO: 54515 - DNA, 1501 bp, Oryza sativa
ggctgcgtttagttccatccaaagtttggattttggttgaaattggagatgatgtgactgaaaagttgtgtgtgtatgacaggttgatgtgatggaattttgcaaactttggatccaaagtttggatctaaacacacccacatatcatcaaattgtctactccctctggttctatattaattgacgttttggacaaagttgaggttaaacttttatagctttgaccatcaataactttaaatatagaccatcaataactttaaaaatatttagtttaaagaaactagaaaaacatatatagatttgtctttcaaaacactataataaaagtaaacatgcatttatttattgtatatattataatagaaaaataaggtcaaaggtatatcttgtagagcgtgtcattgtccaaagtgtcaattaaaatgaaaccggagggagtagttggcatctcttgtagatggtttatatcaattcgtgttgtaaatgcatgccctccgttgatagtaaaaatgtgacctgaatcagcgtcaacaccctcaattttggtctcgttgtgggccacgggtgaaaacggtacataaactttccggattccggacctattttcgaaaacgaatctgtcgatcggaattttttagaaacggaaacggattcgtaaatatttcctcggaaacagaatcgaaaatgataagggtagttttcgtcggaactcggaatctgtcgaaaactttccagaaattttctcggaatttccagaatcacaaaatatcctgaattatttttttaagcactgaatagtgaataccatgatatttggctattatttttttaaaaaatatttgttatgcaaatctaaaattatataagaatatttttttacctgcattgggatttatcaacagcattactaatttgcttcatatattgtgttttgtgatgtactattaatacttaacaatttgacttatatgattatgttttatgttgaattattgaccgttgagacttgagaattggatttatcagtttgaggggtttttttattccgataaattttcgttaccatattcgcgccggttcgttttcgctccgttttcgatttcgataatattcgattccgttttcgtatctggggtttccgattctgattaaaaaaatatatatgaaaacgaaagcgataaagatgatttccgtccgtttcccgttttcacccctagttgtgggcattgtttttctcattttctttttcagtggcactcaggtctaggattaactgatagctctaggctctagcattaaaattggctatcccttgccatgcggctactgcagcctgccgggcaagtacggtccacatgttgaaataaacagaaaaaattgtgtgcacaaccacatgcgctagctcgttccccatataaattgatgagcactattttttctggtgtagtatctgcttgcacgagaacatgtacagccacacgatcgagcagagctcaaa

SEQ ID NO: 54516 - DNA, 865 bp, Oryza sativa
ggatctgcccactcaaggagttcccttctagagaaatcacctgaagattgtgcagatgcagcaacaactctggaggtatctgaccggagagttggttgctgcctaattcaagaacctcgagccttgctaggtttcccaggtcaggaggaatcctaccagagaggctgttttcacctagacagagatgtctaagacggcgtagcttgccaagatcagctgggatggaggccgtgaggttggtgtcggtgagcctgaggaaggagagaaacgagaggttaccgaggagaggagtgatgggtccatggaggggcgtgtgtggcagcgacagtccagtgacacgacgatgtcggcggcggcggctgcaggtgacaccaagccagtggcagaaagaggtgctggtgctccagttgcttgtcagaacgccgagggggtcggtaagctgggacttgaaagccagcagggcggcgagatcggtgtcgctgctgccattggcggtggtcgtcggacttggagaagaatagcatgaggtggacgatagcactactactagtacagcaatggaaacgcatgctgatgatgtagtagccatttgagctctgctcgatcgtgtggctgtacatgttctcgtgcaagcagatactacaccagaaaaaatagtgctcatcaatttatatggggaacgagctagcgcatgtggttgtgcacacaattttttctgtttatttcaacatgtggaccgtacttgcccggcaggctgcagtagccgcatggcaagggatagccaattttaatgctagagcctagagctatcagttaatcctagacctgagtgccactgaaaaagaaaatgagaaaaacaatgccc

SEQ ID NO: 54517 - DNA, 413 bp, Oryza sativa
gccacgcctccaccatggaggacggatgcagaggaggtgcctcaaggggaggagatcgggagaatcggcttgcgggcgtcggggaggaccagatgagcggtgtggactcagcgagaacggaccatgcgaaaacccagttttacccctccacttgtttagggcgtgcgggcgggagaaaattgtgattttgctatcgcaaaagaatggtttcgctggaatactatcccttcaaagtgattcattaaaatgctatcctaaactaaggggtgttcactgaaatgctattttggatctttttgtttgctagaaatgattttactctattttaagttttgttctgaccaaaatacccttgtgtccttatcaccagttcgaatcgatctctccagccgtccagcaccggtgttgactga

SEQ ID NO: 54518 - DNA, 1501 bp, Oryza sativa
tagttggttttgatatttggtggattattgtcgaagttgtgctgactgtgtgggacccagtcaaactggcatgcggtgcatgattagaccggccggcccgatggtctgaacggctggctctgtaatagagtcggtttcgagttttttaattggatactcgtgattatttcatgattactatacttatgcaatactgttgtgttgtgtgttaatgttgagtcaacaattgttgaaaaacatgtgctcgcatatggttttttgtttattcatctgtaggtgtgttttgatacctcgggagagcattgctggtgatagattgggaggcaacttgagagaagatggcatccagatgattaggaataaatcatgtagtatacttaggctaaacaacaaaataaatatggtggtgaagatttcatgcgtcatacaagagggtcgtgtacatgtagaatgcagagttgaatttgggaggagtccaaacttgggaaggttcaagtttaaattgaaaagaaataagttagatacttgtacaggaatgttttctagtggattaagactacttgtacaagtagtattcatggctttgggccaatcacctctaggtataaatggaagagggttgaccctctcggtatcgattgtgtaagagacaagataagagaaaagttagggtttagcctatattttgtgtttaatcgaatgttgagagagtagtattttttttacactttgtaaacataaattagaagcaataaagttgatttgctttcagagagttctttgattatgtttttcttgatcttggcaattagaccaatgagaaaccggcggcatctaggcggttgcatcagcatcttcaagaggttgcggtggcaaggagggtaataggaccagccaatccacaccggttagatcggcagctagggtgcagtcagcccagtgtgcacacagcagtcagatcggactccgttgtggacttcgttgtgatgacccgtgccgtcattaccaaaatgacttcactagtccatggattattatttgccatagccgcgctttagcgaataattaatgatccacatcaaagatagcagtagaataatagctgtaaggtttagataacattacaataccatgccacgcagggctaaattctgaaacagggcattacaagttcacccatttaataatacaagttctaataagcagtagctatcagtactttagtcattacatgcttcattatcccaggttctctgacatagctaggatcggagtagctactagaagtaccactcccctgcataactcatcccatcctccataatacacatcacatccccttgattttcagcacaccaaggggcatagcaccgatcctccaatctataagtatcatttaactcaatggcttgcccaaaattgcttgcgtctaaacaaggaaggttaatagcaagggtgagtacaattacttagcaagcagtattaatagcaaggatgtatg

SEQ ID NO: 54519 - DNA, 1501 bp, Oryza sativa
cattccccctattttccctccctttctcccttggattcgtttggaaaccccccctctaatcccgccggcgccattgatggagcccgagagcgccgcgccggtttccttcccctccggccgccctctcccccttccaaccctatataaaccctccccgcgcctccctcgcccgtttccgcccttgccgcaccgtctcctcgccggaatcgagctcgcgccattgccctctctctcctccgtcgccgacgacctccggccggccttctccgctcgccgggaccgtctcccgccccggcgtcgcctcctccggcttcgccgcactgccgtcgaccccgtccaacccctcgtcgagcccgcggaccgccggaacgccgtcgacccagacgacccgagccgcgccgccgccttcctccgctccggccgcctttttcgtcgtcgccgtcgacctaaggtgagccgcggaccgccgcctcttttcccccttcccttcccctctctcggccgccgctccgccgtgcctatggccgccgccggcgaccataggggcgcgggcgccgcctcccgccggccacgccgagtggccgccacgtggggcccggccgtcagccgccagggccctcgggtgcggctgacgcgtggggcccacggcgccggccggtgcgagcccgggtgcgcccggtccaccgtggaccgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgtagacgttgcagcttcggaagatccgctctttgtggaggttgaagccgacgtttgggaaagtgagcgaggcaagtcacatcatccttgaacatattgaatcctagtttataaaattattttgatttaaattattgcattatcgctttatttaaattcccgcgttatcactgttttatctagccatgcctatgtacctttgttatgaccttattattgttattgttattattaccttgttcaccctagaataaacaaaacaccaactagtggacactctactcatggtaccactagtatgattttaggtagatgcttcgctggttaattaggcaacattaggtggttttacaactctagactttgggaatattcatatcacctggacactatggaatggtgggattattgtggaattggattcacacctccccctctattcaaaaccctcaaaatggttttaggctgggctcggggtgcatagttttgacagtagcacctcggccatataaggaccggt

SEQ ID NO: 54520 - DNA, 1501 bp, Oryza sativa
  unsure (1)..(1501): unsure at all n locations
gccgacgtcgtcgtctcgcggcgccgcctccgtcatcgtcatcgcagcggcgtgttccacgtcgtccccgtctccgtgcagccactgccggctgccctcgtcgcctcctcgccggacccggtcgtcgncgtcgtcgtcctctcgtcgtttccggtcgtcgtggcgttcatccctccgtcgagacattctcgtctgccgcccgcgtttcgtcaagtgtgcagcagccccgtcgtcatcttcgtcctcagctccgcgtcgtcaagccttgtgccggccgcgtctcgccttcgtccaaggatcgccgccgaagtcgttccctcgccgttcgcctccatcgtccctgagctgtctccgccgcgcccgttcgtcgttgtcgttcccacgcctcgtcgcgtggtggtaaggatccctctccctcgctgccctgtcctcgtcctttcggtgtcgctcgtgcccgttgtgcggttgtcggccccggtacccgtgtatcggtgtcggcagtcgttcgcttgtgcgcgtggtgaccgtgttagtgtgtccgctcggtagccgcgtggtttccacgtgtgcagctcgcgtggtgtctagtggagtccgtttgtcggctactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgattaattaggcaacattaggtggtttcataactctagactttgggaatattcatatcacttggacactatggaatggttggattattgtggatttggacgcacacctccccctctattcaaaaccctcaaaatggttttaggctgggctcggggtgcatggttttgatagtagcacctcggccatataaggaccggt

SEQ ID NO: 54521 - DNA, 1501 bp, Oryza sativa
acaagaggtaatggggggtaaaggagaggataggggaggtgtggaggagataagtctcatgggattggtattcatagtttgttacgaatttgacaaggtggccattttttaattccaaggcattccaaggcagaccttgcttgcaaaaatcagatttttacatatgcacgtctccttactaggcttgcttacaaaaatagccatacttttacatatggccgtcacaggatgaccacttgtgaaaatcaagtttcccaagcggttcttgacccgggatttctatgcatttttacaaacggatcttattttttcccacttataaaaatggagggtgtctataaaaatcattttctggtgcttttaaattgccaagaacctattttgacgctgattatagccaataaaatactaatatcttgacattatttgaactagcaaatacaacaggattacacatatgacaaaatgctaatgtttagacattaattaattacggtctccttgtcacaaaaaaatcgttcacaattaaatatatacacacatgtgtatatttctacgtataaacaaacacatcttcgtgcacattatacacagatatgtacactctagctgatttgtatgaagggatatatctaataatcagcaagcgggtttatcgatgaattaatgcatccgatggtcaatattcatcgttataacgattctaattaattaaccgtctaattcatcactaacaacgaccataattatcattgatagcttataatgatgaacagttgtagactaactaggaatttaggctcaaaagctgtgactggattactacgtagccgcaaaatcactgacccaatgtatctaattaactgtttttttataatgacctaacgtttaactgttaagattacacagtattatttcgaaccattaattagtgatcaagtttgcaataaatatgtatatatttgagtgatagatctattcaagatgcaagagcccattaattgagaggaactcccatgagaatgcagatataatgtgtttccataaaacaatgacccaagctatagctatatgccaaatgtgtcatatacataaccaaattaaaccatattagatatggttggcagaactgacaaacatatacctgttatacattgattacaacacagttgactcaaggttccacacgcaagtaactcgacaccaatgtatttccatgggagattaggaggggtcaacaagacttcattcttcttctttcgtacagtaatatatacatcaagtaaacttatatagcatgaaaaccgtccaggatgtctctgctcttgttcccctttatatgttatatatatggagtagttaattagaacgagtaaccaataaaaaatgtcaatcatcacgcgtatatgtgtgtgtgtatgaaagaatttcgttgagattatattacgaataaaactgaacgattacgtgcacaaataaaaaaaaatattttatataaata

SEQ ID NO: 54522 - DNA, 1501 bp, Oryza sativa
ttggatatgttagtagatacatggagaatccaggtgctgaacattgggctgccatgaaacatattttgcgctatgtggcaggaagtctgaatattggtctcaagttcagaaagggagaagagaaatttcctcggctagttggctatagtgatagtgatatggctggggatgtggatgatagaaagagtacaacaggggtgttgtttaagctgggagaaaacttaatcacatggcagtctcagaagcaaaaaatagttgcattatcatcttgtgaagctgagtatattgctgctacaactgctgcctgtcaggggatttggttagcacgtttgctgggagaactgcaaatgaagaagccctgttgtgccatgttaaaagttgacaacaaatctgcaatcaatctctgcaagaatcctgtacttcatgatagaagcaaacacattgatacaagatatcatttcatccgtgagagggttgaaagaaaggaggtcgaagtggagtacacaagttcagcagaacaacttgcagacatactgacaaagcctcttggcaaggtccgatttctggagctgaggggaaagctgggtttgtctccagtgtgatgcgtcaagattagggggagaaattgttggatattttgtaatcttgagcattttatatttctgttttgcatgaacgtagtggctggctgaaggttgttttggccggtcggtagaatagctatttccttctgcatgttgtcagttttgtttagctgccgaatgacctggtttcagatcgtgggatggcgcggtcagtagccgatccgggttgctcgttccgttcagttgtgcatgtaacaaactccgttttggtggaggagaatatagagtgaaaacagaaaagcagcagaggttgcgctgcacaaaaattctactttgttcttcagttcttgacgtttcccgaacttcttgaggttactatcgttgtccggcaattttcagagtgagcgagtgtgagcgatttcagagtttgctctttccgttttgctgacagcacttaggccttgtttagttcccaaaaattttctaaaaacatcacatcgaatctttgaaaacatgcatggagcattaaatatagataaaataactaattgcacggctatgatggaaatcgtgagacgaatcttttgagtctaattattccatgattagtcataagtgctacagtaacccacgtgtgctaatgacggattaattaggctcaaaagattcgtcccacggtttccaggcgagttatgaaattagtttttttattcgtgcccgaaaacctcttccgacatccggtcaaacatccgatgtgacacccagaaattttcttttcgcaaactaaacaaggccttaaggatacccttctaaagttctctaatgccactgggttaaaagcacagtgattaccctgaatgtcgatcagaacaaggagttgatcttgtcaggactgctacagtgcaaactggaaaaac

SEQ ID NO: 54523 - DNA, 1501 bp, Oryza sativa
tttttatttttcttagaaaaataaaaacttcgttctgtttttccagctagctagtccgtgcacaaaatctttttttttttggttaaaaaagaaaaacttctttctgtttttgcggatagcaggagaagtgtccagttcgtgacttgaggtctctttggacttggaagtacaagattctcatagaaaaaagaaaatagaggattgcaattccttggaattttttttatacatgccatttgaaaaagggatttgagctcaccaaattcctatacatatgctaatagtattacaagtagaaagcaaatgaattttgtatgaaatgttgtttggaacacatggttgtcctgaacacaaaatttagattctatcctacgccagctagtgaaaaaataatgttgaatgttcagaaatccttccgaatttatatgtttttatggaaatcaaccaaattcctatgtatgattctcatattcttgtgggattcggtagcatatgacattctaaggattcctttggaacaaagaaaaaaaatagaggaaatctaaagtgttaaaatcttatggaaaataatcatacttgatcctctgtaacaaaggataagcatacgcaaaatcctttgaaactcccattgaatgactcatttcattcatgggaaatttggaggaaagcttgtaagaagtatagcttcatgttttcccttgtgtcttagattcctctaagtttcaacagagcaagatattctgttagtagttttttttttccaaatcctgtgtttgaaaggagctaatcctacgttgttttctattcccttgaaagaaagggaaaacagaggaatttcaaagaatttgaattcaatgaaaaaatttcctatgataccctttggaatagaggattagatctttaaaatttctttgaaattcgtatggaattgctgcttgtaaattttagaggatttatatcctatggaatagcatgtttcatgtgaattttagaggatttatagtatgggctccaaaacctcctggaatttttcctttgtccacctcttccaaatcctgtgtttgtcatgtgctccatccaaacagcttcctctgtagttttcctatgttcctcgttccttgggatttaataacagttgttacatggctaaaaggattgtgattgtgatgttttagtgcacttgttttttctgtcccaacaatccaacatgcatgcctgatgcctggttagcatgcatcatcaaagccccatgcagtccagatttaaaacgaggtgatcaccaactgcgttggagacttggagtctttaaagtgaagagaaaaagcacaaaggccatcacaggacactggttagcagataccagcagccatcaggcaaggcaaagttcctcacaaataatggggcggctaccgaatttgttcatggcattaaagcaaggaaaacatcccgtgaaaagatggacaacttcaacatttctgttcaaacgggcaggcttaggata

SEQ ID NO: 54524 - DNA, 1501 bp, Oryza sativa
ttggagtagattttttttgtgtaagttagccaaattttaacttagagagccatttggctaggctcttggagatgctctaaggcctataactacaagatcattcagaacgatttgatctccattgtttgcacttaagtttaccagtacgtcgttagaaattgaatttttaagttgctcaaagtatatgtatataaaatttacacattattttttcgctattaagcgttgctgcttatccaaacattagcattgtttagataggtgttgtattcgctcggtcttatctctattctaggtttcggcaataaacctactaaatatactttaattaaacgtatagagaaaacacctctagaactatgtatttacggttaaagacttttgtcctacttgctagcgactcaattacatttataaccttcctagccactttcctcattttcccctttttcaacatttcctcttcctctcccctgagggtgcgccaccctaacccgatctttccctatctccaggtcacctccatctccctaccctacgatgccactcaagctatcctgttaacatagaaccatctcgaaattgcttcgtagtcatcacgcgacgtgtgattcgttagaatcgctctttgcagatctacctctcagtgtccaaatccgatctgtttattggtgtcaaattttattgtccactgcaacatgcagccttgactggccggtggtgggggcggttgacatcgttcggccacatcgtcgtcataccgagcaatcttcgctgaccataccaccgtttttctcgtgatgtcatatcttcaggttccacttacctattctcatcttctcttttaagactatcctattgtgcttgtctcttggacctcctagtctcttcccgagacaacgttttctctgtaggacatgctgataccgagacacctcatccctttcaccgcggtatcaaacccatgtaaaaataaaaagcctatataggagttatattgccggggaaactttttttcttaaagaactacacgagttgtgaatgtaattattatagggtcacattgctggagatgcgagtttttttttttttacttttagaactttattacgagttgtgaatgtaatttagttcaagtcacatggtcttttcaccattgacacggcacccacatcgaaccggagcgcgtggaagatgggaatcgcccctccgcggcacgagtccacgacggcaagaaaaagcgcccacccggcccacgcaaaaaaaaaaacaaaaaaggtagcactccatctgggcccacctgtcggcaccgggcgcgtagcgcgttcacgcctcatcacagtagtatcagtagagagaaagaaagaaaagaaagaaaaaaaaaaaggaaaaaagccgacgtaatcaatgggggacagcgcgatcggtccaagttaccgtcgttaaacgatcgcgagctccgtctccgcctccgcctccgggatccggcttcgcctcgagc

SEQ ID NO: 54525 - DNA, 594 bp, Oryza sativa
aggccacgctgtgccatttgccaatcaattaatcaaccaaaagaaacattccccaacccatcctgttggattaaacaagcgccccaacttgcaaattcgccgatctccaggtgcaccaaaacactcgctctcgccttgaccaaagcccacatcgcgcaggcgcagtgcatgcaccagctttaacctggcgccaatggcgaacgcaccgcaccgcgagacaagtacgtgtcacccccttggcgccaatggacaaaaccacacccggccccatcgcttccccccctccatgcccatctcccgccatataatacgcgcgcacatactccatgacacgacgcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgc

SEQ ID NO: 54526 - DNA, 1501 bp, Oryza sativa
gtcgcggcgcgcgctccgcaagatcctgtcgcggctgcaggtggacgcgtggacgagccagcacgacgccaagttcctcgacctgctgctgcgccacacgggcggcggcggcggcgcgaggaacgtgggcgagctcaccggcgaggactggtcatccatccgcgccgagctgaacgccgccaccgggtccggcttccccgtggaggagctccagcggcggctgggcgagttccggcgggagttcgaggcggcgagccggatcaagaaccacccccggttcagctacgaccctcgccgccgcgtggtcgtcgccaagcaggccgactggaagaactacatactggtgcgccgccattgctgcatccttccgaatcgcgaatgtcttcttctcggtgagctgttcttacctcgatcgtttgttttggcggtttcaggagaatccggaggcggcggcgtacgaggggaggagcccgcggcatctgggccggctccgagcaatcttctccggcgacggcggcggcggcggcggaggaggagccaagtgccgcgagacgaaggcgaggagttgcctgaggaagctgctgcggaattttaggctgcgattcaagctgtagatagtttaaatttctgcaatatttgtctcaatttgatcgaggcgcacgaaattgttggttagttttagagcattcaattgagatcttacagtagttggagacacgactctctgagctgaagcaacgcatcttcagtcgcttgtaaagggtgctctgctgtttttgaattggctaaatgctactaatcggactgacattagtagaagcttgtgtgtgattgaaggcccgaataaattccaaatccatatggcatcagccctagttctcctgggccatctttgcatttgcccattctggctatgcgaaaatctgcagccttgaaaaatttccaaatcctctctatcgatctattgacacgaatctctgcagccctgaaaatttcagaatccttgattttttttttcgttaaaactttacaagtttgtggaatgatttaatttatcacataggagtattaatctatcttgttaaaaaaaattactacctccgttttttaatagatgacgccgttgattttttctcacatgtttgaccattcgtcttattaaaaaattttatgtaaatgtataagatataaatcacacttaaagtaatatgagtgataaaacaactcataacaaaataaattataattacgtaaattttttgaataagacgaatggtcaaacatgtgagaaaaagtcaatagcgttatctattaaaaaaggaggtagtataaatcatttagttgatatgtaaataactagtgaatgttcatgaaagttagaatagtttccctgaatatcgaagcaaaacaatcaaactaataagcctaatgctgagctgcctccgatctcagataacctacactgaattatttgagaacggaggaattaacagaggaattt

SEQ ID NO: 54527 - DNA, 1030 bp, Oryza sativa
accacccaatttattgtttaaatttagtttttatttttattttcagcagcaattaccctttagtccctatattttatgtaatttagtcgaaacagttcatcagttgtataaacaattatgtaatgatcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattttgtattttgatttagcaaattccattaattatgtccaacataattaatggaggatttaatgcatgttccacttcatactttgacttggaaattaattacatgtcgatggagtcctatactttggtcatatcgaccataacttaggcagcgagtatctcgcccatcataaagtggtctacattttgagatgattacctgatggagtcctagaaattggccgcactggtcataacttaggcagcgagcacctcgcccatctcacagaggtctacatctcacgatgattacccacatgtgttcttttccaagaatatgttttgagaaatgagattgtttgaaatttggttgaacacaaggtagtggagtcctaaacaatggctgcggtatattcatcagaatatatttgcctggagaccgtgttttaggcagcaagtataccttgcccactattaagagatctactccactgtttaattacttggagattagccacattgtgccacctaatttcgaattctaactcaaaattgtcaggtccataacctacatctttcgaaacattacagaatatgaagttttacatttcgcattgagatttcaaccttaatatcatgtttttattaatttacctctgtaaattgataatgttaaccatgattgtagggacatggcaacaaaagagttcgacgaactcgccctcgatgggactaactatcccatctgggcttctgatatcaaaatca

SEQ ID NO: 54528 - DNA, 188 bp, Oryza sativa
agggtcatgaagtgaacttattccccttgataagggccacacgctgctcacagtcctgttccggcccataaaatgtgggcccagcgcgtctgtcgcattgacgttccggcccagttcgcttgccacataaaatctttcgagtgagatatagcaaaatcgcacgcgaaaaggtgaaaacgtgagagcca

SEQ ID NO: 54529 - DNA, 1256 bp, Oryza sativa
gtcatctattaaaaaacggagggagtaacataatataagcatttttatactaattctcatcattttaatatttcgaaaccaaatcagatgcttcgagagcgaatagtataaataattgacaacctaaaaggacttaaaaacattttgatctaatcttagtatttattaaataacctaaaaatatttatacttaacaacggatggaacgctaaacgaactcctaggaaattaggtaaaactcctgcatcacgaaagagcctaaatcttaagacaccgtgaacgagaccacgatcgcacaaaatcgtgacgtcgatgaattaacggtgaaaaaagacggcatgtagatcatcatttcttcaccattcatctagcgaatctacttctatttgtcaaaccactgatacagtgatattagtgccttcgttattcaaaaccgaacgaccaaaatcgtcatcttcttcacacacaagcacacacgctggcagcctggcacaccaaatccctttttcttttcgccactcatcacacatgcgccgcatcacagcaatcaccagttgaccccatgagctgtcctgccttctcatcagtcatcacactcttcctggtagtcttaggccgcgttcgatagcgagagatcgaggggatttggtgaattgtgcactgttcagcactgtacatgtctgaataatttactgcatattaaatggcgttggtgactaaacgtggcacctgtacaaacggcacagacggcatttggatggatcgattcgtcggcccatccgtccccaacccaccaccagcgcaagcagccgtgctcgctctctctctctcccatcgatccccttcttccttcgccaaattttctcggtcgtcgacggctccacgcgcggttgccgtggctggaatcgttgtgccctactgctgagcgtcgtccggtggtcgtcgtggtcagcctggggctgttaggcacgcggagaaatcgaccactcgtcacgggagctgctgaaaaggcgaatcgaggccggagaaaggggattctctggcggagctgccatcaagccaggcggaagtcggggagcgctgccggtgttgtctgcgtcacctagctgctcatcaggcactgcagctttggccgcatgcggctgtactcggtggagcgctctcgggtgtcacagtgtcgtcaagattcggcagagttggaagctatcttctcgcctccggcctcctatttgaggcctccttctccgggtggacaa

SEQ ID NO: 54530 - DNA, 1501 bp, Oryza sativa
gacaccggcttcctcttgatcgccttctcctcgtcgtcggcggcgacatggacatgcaactgctgctgctgctgctgatgcatttcttgcttcgccgtcgccgtctccggctgcatcaaccgcacattatgcatctccgtcctgccatagatcgatcgatcgatcggttcgtcaaaacaaaatcgtaagaatgctcgccgtcgtcgttgtgaaatttgcacgtactgataggcgtcggtggcgaggcggaggctgaggaagacgacggagtcgtgacgcacgccgtagtccgcgagcgtgcggtggtcgtcgtcgaggcaccggccggcgaagaacagccgctgcatggccaccgcgatgcgctcccgggccatgaccatgcccttgacctgcgccaccgtcgtcgtggcgccgtccacgtcgagcgccacccggtccccgcgcagcgtgcgcaccatgatcctcatcgtccccgacaacgtacacaccgagctcaccctcagctcaggcgacaggtctcatccggattcccgtgcgagaaaagatagcgaggaagaggaagaagttgttaggttgagatgagaaaaataatggagatctagcgcgaagaagaagggattggctggcatggcaatggcatgcatgcacgatggctacgagagggaataaagcggtttggatcgatgatgatgacgacctttgggcgccaacgtgaaggaaagtattttcttcttcggagcgctgacctgtgtacccaactgtccatgcagttcaggcgttggaagatctgggccgagacagctaatgggctgcttgtgggcaatgtcagaacctggcctggcccagggatggcctgtgcaacccaatggaaaagaacaaaagttttaatcagctttcaacaattcgtagggttaaaatgatctttttatagcactgaacggagtgctgttaatgaaaatctaatgacgatgatatttatggaacaaagacgattgtacaatgacatttttaggaatatatgttcatcgatggcatttcttgaatttggatgtttatcggtggtattttctggattttctcatatgataaagttgtgtttttgagcttttgactctcaaattattctctaggttgtacaactatagattcacaaactatgggcaggaatttataatgtttaaaatagttggagatcattcaaaaagggcatgcggactagtatagttgttggaaaaaaaatgcagatgacaaaaaattgtggcaaggggcattatggtttgatattcccttttggatatacggattgaatgcaacataaagatcaagtgaactgaatgcacaatcacatggacctcgcaggcgacgcatggcgtttagccgctcgccatccggtcgattcaatacgcgcctgcagagttgttcagcttgccggaaatggcgacgagcatggtaaagtcgcgggaaagcattcaggcgcatcaccaacctccttgacctcccc

SEQ ID NO: 54531 - DNA, 184 bp, Oryza sativa
agattcaccgtgattagtcccatcttaataaatcgacccaatgcactgtagtttaggtgggttggttgggcctgttcaacgtggtgtagcgttgatcagtggagatttaatgttactttaattactcaacagttttactgttttgctcaataaaatgttttacaaccgcctttatgcaaatagc

SEQ ID NO: 54532 - DNA, 1501 bp, Oryza sativa
aatgacacctctgagatttcaatcacatgagtatatttaactgaaccagaaaaacatattaattaattctcaaaaaaaagaaaacatattaatttagtatgcaattgacgactctgatgaagaatgtcaggtcaaaatcaaacctagaaagaaaaaagaagctgaaaaaaaacaagcatgcatgtgcatggatgtcaggcaatcaggctcaaacaccagctaagcaactctatgactgccctgatgacaagaagtttcctagccatgtacagtaagtttcttctctcctctgaacagaaaatctccaagttcagaaatgcagctgcagatacttccattcttcaggcagtcagcctacctgttgcctgcatatgccatcaattctcactaacttctccaaatcaatcaagccctaaacatgcatatatgaatccatgtccgacatactcatgtgacccaatagcaaaaatacttttggtttaattagttatcctgactccatgagcgaatttactttgctctttctcagccagccattggtgccaaccacagttaggaccagcatatgcatatgcatgaacaaaccagctacttttctccgtgctgactgccgttttgcagtggcaatctgctgcccgggaaaaagcttcatcgatcaaccgtcctacataactccggtgacctgtgcacatgcgtacatgcttgggccaattaaccatggtccactggaaatttctggctctgaaattgggcatagtactgtactatatctattactagtatatagtatatgcatgtgtatagcattcatgaaggtaacctgcaggatttgaattcagaaaactggagtatctagctagtagcagtagattcagtgtcagcatatatacacgatttattttcatgttatagggaaaaaaaaaaacaaatcagcagcatatgtcaaaaaaaaaaaacaagtgtactttgtagctactttaatttcctaggtcggacctagtactccatcaattgctctttagcttattatccgtagccaaaatttgaattttaaatcttaattttagagttggttctgattttatttccatcgtaatttattttctaatgtattagcttttaaatttctaagagcgtgcctaatgctacaaaagttttatccataattaaatattttttttcactaataagtgttacggcttgtaatcaactgtagcgaaacgatgggacttcactcaagtcaaatcgtgtaacgcgcaaccacatgtgttacagcttggcgccatttgcgagaaagtgcaaacataattcctgtccatgatccatccatccattgcatgtactacacccccacccatggaggagaaaaccctataaaagctcttcaacgcagttcccagctggacctccgacctcctacctcctcaccttcttctttctccattctagctatcttagctagctagatatctctctgaaatctcttcttgttgggttgaga

SEQ ID NO: 54533 - DNA, 728 bp, Oryza sativa
tcaccggatatttccctgcttactttctacttgtgttgtccggccattttatattatctgttctgtcagggttaagtgtagtagatacaacagatgggtaaaatgagctactttctccgttccacgatataagattttctaacattacccacattcatatatattgatttattaatatctatatgaatatgggcaatgttagaaatattgatttattaacatctatatgaatatgggtaatgttaaaatgtggacaatgctaaaatgaaataggtgccggttctaaacatggagccgagcatcccctcgtctactctactcattgagaacaagcacatccgcatcacattcatcaagaacaagaatgaacaagaacattcatcacagcaagcacatccacatccaacattcatccacaacacaagatttggactcaaatttatgcaataaaaaaaagaagggattcacacctcgtcgtgccacctcccgtcggcgagcccgccgcctccctccggccagcccggcgctgcgtctcctctgtgaacccgccgtggcaccgcctgccgccacctagtcccggcgagcccgccgcctcccctcccgccagatctggcggaagggaggcgtcgcccgccgctgccgcctcccgccgccgcaactgcagcctccctcctaccgccgcaactgtagcctctcctcccacccttgccgagcacctaccgggccga

SEQ ID NO: 54534 - DNA, 1501 bp, Oryza sativa; identical to SEQ ID NO: 47973

SEQ ID NO: 54535 - DNA, 1501 bp, Oryza sativa
ttaaaaaacttaaaacgggttaatatgactttttacagccacatttctataaaattttttgccaaacaaaatacaccgtttagtagtagcggaaatcgtatgtgcgggaaacgaggattagaacctagacctgtgaacatagccaaaagttgttatgtttgtatgcgtatctaccatctgtccttctaaacataagtacacgtggtactcactatacgctgaaaaaaaagcagaaaataaaacttgtagatacagttgggaaaaagtaaatccatccttccctcgtaattttagattcaaacctgtaatatgtttgtatacatacacatgatcagttcatggtccgcaccctcctctatggtttcttttactctctttattttctaccatagtgattatttaaaccataattcactatttaaaataggatctatcttcaatataaaacagaagaaaatatattgcatcctatattaactatatttttatactaactacattttaattaaaaaatgttcacatatggaatattgtatttatttattttataaagtagacgaacacgcgcacacacaccactacatacgcaacttcacactcacatgcctgcaaatgcaccttctaacacacgtttatataatcctattgaaagtgcacctacatgtgcgtcatattcgttgtcgaaatattttattatagcctttcttagtgaaatagcctatattctaataaaaaaatgtcacattatatccttttgcatgtccttctcacgcatcaattagtattgacaaccatttgctcaccaacatgcattgctaaattagatctataataaccacgtgacacacgccgtgagtattctttgatatagcttatctttacactttctttaatatagtgcggggttacgatataagtagtaaaaagtatctaaaaattattagatccataataatatcaaaacccactaactcatgttagtgagattattactcgagtgaattttttccatgtgtttctcgctaccattgagtctgttaatttttaggcagattgtaattaatttcgtcaatatgattgaatagagtgccagataatttatcttaagaaaatatgttaagaactatgcttttattaaaaaagttgcacatggaactatgttctaatattttacatgttatgcaaataaaagtagcaaacttgacgacatagattatgacataatatatcaccggtcttgaaacgttcataacttttaaattatacatgcaatttaccatcatgtttttttttgactgaacaatttaccatcatgttgtattcctttaattaaacaaaccattaatgactcataatagctttactatagtgctaaatacattatgacatatgcgtcgacatgtaataaatgatgttatgatatttttaaataatttcacatcatattttatatttgtatggtgtcaaatatcactggacaaatattcaacgctaatttgaa

SEQ ID NO: 54536 - DNA, 813 bp, Oryza sativa
gttactgaaatatatatttgagtgatctctacctgcatccgttgttccattgatcgtgagaattaggtaacatcagttttgtgttccttttgaatgtgtgagtatgcagcatggatttctatcccatgaattcgttggcaagatgaactgaaatgtagcataatgcatagatatgggttagaatattttttccccgtggaagaaccaattgttgctttttttgggcacagctcttgtgccttattagcacaggcaagagatatgaaccatttctattatttcaaaaaagtgaaagcaaagattaacttaatggattgacttaatgtgatagtagattgataccaaagcataaatatatataggcacaacattcttatccatgcaaaggactttacatccttatccgtacaaccgacttaaaaaacagaattggaacgagatagatatgaataaaggatgaaatcataagtctaacacatgagtaaatataaatatagacgttgcaccttccttattcatataacctgtttgtaggctatagaaaggtagggaggatagaccgcggatccataagacaagaataaagtgtgaaattatcggtctaacaaaaaatttgtgtatggttaagcctcccatcctcgccattcacaatgttagaagctactatataaaaagtgtttattgctaaccatgcgtgccccagaaatagagtcttaggacggaggtagtaactacagttagagttcatttggtagggcaagttcctaacttccattatcttgttttccgcacagacgtttttcaaattgctaa

SEQ ID NO: 54537 - DNA, 261 bp, Oryza sativa
atatatatatatatatatatatatatatatatatatatatatatatatatatatatatatatatatatatatattcaaattagcgttgaatatttgtccagtgatatttgacaccatacaaatataaaatatgatgtgaaattatttaaaaatatcataacatcatttattacatgtcgacgcatatgtcataatgtatttagcactatagtaaagctattatgagtcattaatggtttgtttaattaaaggaatacaaca

SEQ ID NO: 54538 - DNA, 1501 bp, Oryza sativa
tttctctcccctaccctatcctaccaacctaattaactactaccccgtcccaaaatatagcaatttttagttatgaatctggacattcataaataaaaatcttatattttaggacggagagagtacccttcctccacatccaagcacagatctctccctacactaataccacaccatcacatcacatgcttgtgttgtggctgcattagccaccattgttactgatgttctctactgccactgctatccacctgtgcactccatagtttggcacaattcataaaggcagcagcagcagcagcagcaggagcaggatgcactatcatcttcttcttgttgtttttcttgcaaaaggcgggaaggcagaggcaaaagggcgctaaaagttgcggccttttcttgcacccacctagtcgctggcgtgcacattattaagctcttccacttcggcacatccccggatcaatcggcaacggcgtttctcttcatcttcttgctccggcgtggtctggtcgccggcgttactgacggcgacggtttttgaagctgcattcaagtaggtgcgagatcctcgtcgcagttaatataatctcttaaaattctccatgcgtttcttgcagattctgctacatatagtaggtgtgaagccgtacttgccgggtttcttgcagggataggatggcgccagcgatggctctgaggttgctggtggtggtggcggtggcggcggtggtgtcctgcgccgtcgccgccgatgaggggagcgtcgtcgaggtgtggccaatgccggcgacggcgagcaaaggcgggcagacgctgcacgtcagcagggagctcaggatgacggcggaggggagcaagtacgccgacggggaggccatcctgaaggacgcgttccagaggatggtgacgctgatagagctggaccacgtcatcaatggcagctcccagggcttgccgctgctcgccggtgtgaatgtcgtcgtgcatttgcccggcgatgaggtaaagccttgtgaactttgggtgttctccttttttcttaccttcttgtgacctgtatttggttgattttgtcctctgcagctcaacttctgggtggatgaattatacaatttgtcagtgcctgcaactggaagtccaatttatgctcaaattgaggttagtgataaaaaaaatatatgctctgctaactgtgctgtcaacatgaaaggttggcagaatatgacatcagatgccgacactttaactgcagacattcttcctttgagaattcacggaaaataatgaaatcgtgtggcttagttctaggaattgtgacacttttttttttttgctgtcacctcactatgtctttattgcaggcccaaacagtttttggagcacttcatgccttgaaggtaacttggcatggtttatccactcaatgcatctggatgatcatagataaaaaagacaacacgatcactttcagacaatctaacagtgtaccttctatcgt

SEQ ID NO: 54539 - DNA, 1501 bp, Oryza sativa
aattacttatccgatctacaatccgattacaccattgtattcgttacaattaaatcttcacaacaagatcttacatgattatattacgatgaaaaaatatttatatttgtaaattacttttgttatatacataagttacttttatcatatatataagttacttttagatttgactaagttacttcttagacatataaaagtaaattcaataaagtctaaaagtaatttacatatattataaaagtatcttaaaacaaaatggaaacatactattgcatttttttcaagttgaaaggaaacactagatggagtacaaaccagctaccactagttgtgtagtcacgtccaatgaaaaaaaaatgaatgcattaaagttactttatttttgttataagttacttttataatatatgtaaattacttaagctttattgaatttacttttatatgtcgaagaagtaatttagtgaaatctaaaagtaatttagatatattataaaagtaatttataatttttcatcaaaatataatcatgtgagctcttgttataaagatttaattgttacgaacataacggtgtaatcggatcgtagattggatgagtagtttaagagaaaattttatttgaagtataggtggaatatgatctctcatagatggagtggtagctgatttaaacaaaccagctaccattagctgtgtagtcacgtccaaccaaatagatttagtatttttatatttgagaaagtagcttatgacatggcaagatgatgcaatatattttgtccgttaaacctaacaaactttgaagtcactgccataccgctcccctaccgtcatcggcatgggtggaaatcaggccagcttcatatgcctccatcaaaatcgatttatttatccttttatcatatggagctgttcttttaacaatctaaggagaaaacggcgtaaaatctaattttcgttcggcaataaacaactttgattttctaaagtcagcgtaacttatctagctagattcttcgtaatgagacttatttacttgaactcaaatcttagactttcatggctaattattttttaagtagtaggactttgctagtattaagatatgctacatatatatcttgacatctcaattattaaaaccgttataatttgactctaaagatagtattcatagtggtattgatgtgaatacgagctgcgttagcaaataccattataaatactatcttgtgagtcaattacattggttttaacagttaaggatcaagatatccgtattacggttgaggggcgtgaattagatttaacctatatatcggggagtctaggtggacttattccaagtaataaaccccacaaaatggaagctcgcgaagcccacaagccgcaggaaagcccgcgacgagaataccaaaccaaatccaccaagtccaaggggatctctctctcgcctcgcctcgcctcgcctcgtctagttgagcagccgcgacga

SEQ ID NO: 54540 - DNA, 1501 bp, Oryza sativa
ggttttaatttgttagtgtgtggaaacatgagaggatgtcgtctgctagctagctagaggaacggatcaatctgctaacgatagattgatgttcgtattgctgtgttttttttttaatttgtttcaatgtttcagcttaattgcatgcttcctcttcttgattgtgtggtgtgatcaataagacagcaactgttcagaaattgtttccgtcaagatcgtatcctatcaagaaattaattaataatgcctgcagcctgacttaagcgtgtaatcctacatacttccatgtgcggacagtgcatgcaatctgatgtaataatgtgtcggatctaagcataatatgtctgagattaatttaattaacctgttttcttcagacagatttatttgtggttgattttggcactgatattgggagagaacacacgtactccctccgtcccattttaaacgtaactatagatttccgtatctaactttaatcgtcggtcttatttgagaaaatctaaaatctttaaaaaaattaaaaaaaacataagtcacttatagagtactattcatgttttatcatctaataacaacaaaaaatactaattataaaaaaaattttaaataagatggacgatcaaaattgaactcgaaaacttacggttgtgtttaaaatgaaacggacgagtatcactcatagaatagttgtcggagctactccctccgtaaaaaaaacaatcatgagtttaaacctgaacacaatgagttgggttcaggtttaaactcaagattaggttgtgtccagttttaaatttaaaattggggttttttttttctttggaacggaaggagtagctaggagagctagctagcccttggatcgaaaaaatctcacatgcatgacattgtgagctgtgacatattactagcaaggagatctagtatagtcaagtacggtcggatagcgagagaaaactatactgtagagaatactttgacgactgcataggagccggaatgctcgatcgatattctgcattctctggagggtaaccgagaggcatgattggtgcaaaagtgagggcaaagcatgtgcagactccgttggcagtatgccgcccgtgagcgaatactgagcagtaactgagttgatgtgatggacatgtaaccccgtgtcatttgttgtcttctgtttgtagtagctctgggctgtgcatgaaacacggcaaatgggcaatggccatatgtgatcttaccttggattttatactgaacagactttgaaaaggctgctcgtgagtgtactggccaatatataaagatagccaactgtgtaaatacaagtggcttgaaatattttgcaactaaatttccatataaaatggtacttggttcttctcacatgatcactagtactcactagtgtgctgcttgcagaaaggcaaggatggaactgcacagttatgagtgcagacatgacacaagtgactaattgagttaaatctatggatta

SEQ ID NO: 54541 - DNA, 1501 bp, Oryza sativa
taaaatcaatatttgtataaattttaaattctaaattaaaattcatttactttggaacaaaaggaatggtagtaagggcttttacaatgcatatagatgtcattcaacatcaacttgccacataaaagatttcacgtcattcaacatcaacttgccacataaaagatttcacatcacatctgcttctcccattaccaagtgaagaatggaaatcccaaatgagacacgagttccttattaatattcatgagggatttttcagggagggggagaggaacagcgagcgttgtacgttgggagaagtgttgccccatgcgatgccctcataacccgttggagccagcgacgatgagctgattcgaggtggtggcggtcgtcccgagttgctccactcgtggttgtcactgatcgaggcaagcccaatgcctgatctagcgagctcgacgaggcagcgacgatagcctagtgagagacgtgcgcgggtgaggagaagggaagatggaaatggtggacgaagaggaggcggcggatctagcgtttaggacctcattgttgtccccattccgtactgtcaagctcgttgttgcccctcgaaccaaccgatgttatcgtcgtgatcgacctatgaagaagcagctcgacgacgaccgcctcgacctgtccgtagccgctccgtcggagctgccttgacctcctcgtcgcttcttttcgtcgtcgtgtcaatctcctcgatgttcacccggttcaaggcgatggcactagggagctcgttgttggagatgggggagggacatcaacagcaattttaggaaaggaaaaagcgactatacctcccactctctgccgctgagctcatagtagtccacccttcccacatcaccgagctcgtcgacgcgccgattagagtaggagagccaccgaacagtcgtgggccatgggaggacgagataagagctgagatgcggtcactgccgtgggaggagtcgaggagagaatcgagagagtgacggaagaggggaaagaggggattttattttttttctagattctggtattcattgttaaattgtgtacttccacacaaattgaaataaatatgagagctagaatagatagtagcaaggtctgaaataaaaaaaacaatgccattcctagagccacttacattataaaaagaataattttagacttatgaccctagctagacttcgtggtacagacgtacagtactccaaggctcaaatgaagatcctgcactgtgagtgacggtcactcacgttgccacacacacatgcataatttccgagctactagcactctagcagctgcaaaccctagagttcacgggccacaacggcgagctcgccactctatataaccacaccgccataaaccctagatcgatcgcacaaacacttctagctcctcttcttctcccccccccccccccccccttctcaccacaacctgctagcaagctcagagctagcagcagccatgg

SEQ ID NO: 54542 - DNA, 1501 bp, Oryza sativa
gcatatgaccaattgaccatatctatgcacgcgacaaccaaaacattacaattccacgagtccgcgacctgttctactcacgtcaccccgcatccctgatcaaacaaagcatttgctcgggagcttgagctcgagctccgtaggccggagcagccatggtgtcgtcgtcgtcgtcgtcgcctcgccggcgagctctcctcctgctgttcgtcttcgcgtcgtcgttctttgccagcgctgcaggtgagagggttcttgagtagttttgtttctttgatgaaatggaaggcgtggagattgatcgatcgatcgatggtggcgtgccgtgtttgcagcggcggtgtcgcggacgaactcgtcgtcggcgttcgtgctggcggcggcgcagacgcggcggaaggatccactccgcgggctgaggtactacaccggcggctggaacatcagcgacaagcactacctcgccgtgagctcctcatttccgtgataaatttcagctcgcaatgcgatcaccttggtgttctactgttcttcctgcctggttcttgatgctgacgccgtcgagttttgctatgcttgtcgccgcgcgcgcgcagtcggtcgggttcagcgcggcgccggtgttcgttgtcgcggccgtctggttcgcctccctcgcgctcgccgcgttcgtcgcctgctgctgccgctgctgctgctctggcgccggcggcggcaacggcaacggcggttactcctactcccgcgccatcttcgccgtctccctcgcgctcctcctcgtcttcaccgccgtcgccatgtaaaaccatttctcctctccaagccatttcatattacaaagtacaaaactgttcagattttttttctagtataagtttgatcaaatttatacaaaaagtttagcaacatctgcttcattaaaactagcattaaatatatttgttttgcattagaaatgatactatatctctttataaatttagtcaaatctaaatatattttgataatatatttgtttgtggaaatgctactatatctttttataaatttagttaaatttaaataagtttgataaataaaatcaaaacgacctataatacgaaacggacggagtaatttctaattttggacgccgccgccgtcgctgtgggtgcagaatcgggtgcatcgtgctgtacgacgggcaggggaagttccacgggagcacgacggcgacgctgcggttcgtcgtcaaccagtcggacggcgcggtggcgagcctgcgcggcttcagcggtttcatcgaggcggcgaaggcggccgccgtggagaaggccaccctccccgccgacctccaggggaaggtcgacgacgtcgtgcgccgggtggacgcctccgccgacgacctcgccgcgcgcaccaccactaactcccgcaagatccgcaccgcgctggagaccatgtatgtgtgagattttcttggtggacgccatgacctcgtcacttccatcatcaagaagat

SEQ ID NO: 54543 - DNA, 1501 bp, Oryza sativa
gtatagattagtcttaaaatgtattttaataagatcatatatttgttaatatttttatacatattataatagaaaataatggccgaagttttttttttttgagactatgccattgtccaaaacgataattattatcaacccggagggagtagtactaggatggtataataatactgtagtagtatcagcaaataatactacatcctttcatgtaatttatggcctctctctgtgattttattactgccaatccgacgtgaacgtgtagtaacagcaacagtagtaacaaacatgcagtccctaccatcttctgaacctgccacactttgtcaccgctttattcgcgtcctttcagcatttacgtatgctacctgaccataccatgccatgcgtggtccacataacacatcggccatcatcctgcctccatatcgactctcaagtagtgacattattacaaccaaaaagaaaagaaaagaaaatctcaactgaatagatgagattaatttaggtcttaaatgaaaccatcacgaacttgaaccataaaggccaatgcaactaatgcaagtgctcatttaattaacaaatactcctactaacaaacatctctgcactgatacgcggtagaagcgaaagccatcagatatcgtatagtactcccctttttgcaggggcatgcatgtgatgagcgatttgcatcggatcaggctgacagctttggcgtttttgtgtctccttttggcttaagatctactacttctacacctcgatcgatcgctgctgtccagtgtaccagagttcaaatggcctatttgagaaaggttacagtgtaacaaagtttaaatgacctatttaagatagtctaaaattctgagaagttgcttgttagtaactactccctccgtttcacaatgtaagtcattctagcatttcccacattcatattaatgttagtaaatctatatagatttatacgtttagattcattaatgtcaatatgaatgtgaaaaatgctagaataacttacattgtgaaacggagtaagtagttctttttgtcaaaatctgcgtgaaaagttagattgtttggtgaagtttctgattatgtaagaagccgcaggcctgcacctaacagaggctccccgaaaccggtccaaagacccaaacggttgtgttggatcttgtagtcttgtcaagaaaccggccaagccccatgaaactccaaatagtataaaaaaaaagtcaagatttgccttaaagatataaatacgagcccaatttatttagtagctgccattgcaacgatgtgcagtaataaactagtaatagtagtatagcatgtgagccgagccgtgcagctgcagctgcatgcttcttcctccttcgctatatatgcagctgagctgcacacacgatgagcagtagtagtagtagtataatttggtagtagtgagcaagtgaaactgcaagtgagctaaggtgcaagaagagagaggtggaga

SEQ ID NO: 54544 - DNA, 1501 bp, Oryza sativa; identical to SEQ ID NO: 31180

SEQ ID NO: 54545 - DNA, 1501 bp, Oryza sativa
tttgatcctacaaacagtagatcaaacagccgatcggctgacaagtcgatggagtaattccagccgatatctgataatagccgatgtcgataccagccgatagcgatagggtttaagcaatcggttgtatgtccaatgtagataatgatataaagtcaatcggctgatgatgatgtaataaaataacaatataatccagtataaaccaattggatagcaatatgatataatagaacaagcactgatccgacggttaaagcatacatcggctggaggtcccatgtcataaaatccacaagattagattaaacagtgaagtctttgttgtcatcggctaaatccaacttatatgtatatgcaatccttataagccgatgcaacgtctagataacttatcggctagcaccccgataaaacactagcatgaacctatcggcttagcaagacttatattatcaacaacaatctagtaggtcgaacctaaccgatgcagcacgagattgtatatgataatctaatacttgatgagctgatagatctatctaatgtgatggatataacaaatctatttagaacaacattgtgattttagagatatatcagctaagacagataatcggacctaaccgagacagtcccaactaaaccgatgtgtctctaaacacaatgtaattagagatagaattgagatatcaggtaggcaaatatatcaaccaaaccagagcgatccaagagatcgaaacgatgcagtcttgaacaacaccaacgtagccgacagattcaccagggccagcggaacgtaggacttaccccttcaccggagatcgaaagccgatgcagccccgcgtcaggtgccaaattccgccggatgataagtaaaacctcaggaaagagggtggcgatgcgccgagagtaattgtattgatcgagagatattttacaatgaccccgggtgtacatatttatacccatggagagatactagtccttgtaggacaagaaagaaactttcctaaagataaaaggaaaacataaagtccttatcggacactaaacacactttcctaaagataaaaggaaactagcaaatacttcctaattaatagataaaccgccatgccatatccttcttgaactcggactcttctggataaatttcctttaattgatccaactctaccaaaaatacaactgttggcgatttgacgactcccatcagctgattctaagactctgaagccgatactgactctaggccgatgataacttcgggcttaccaaattttggcgttaacacagggaaagaacatgaaacccatgcgccagggggatttttacaaagttcatatttgtgttccatttgatcccaattctctcccaacacattacactaaaagggcattgaaaaaagagatggattaatgtctctctgatccccaaaggacagagtaaacatgatagaccaacatcttttaggacacaatatcggacatggatcctc

SEQ ID NO: 54546 - DNA, 1501 bp, Oryza sativa
cagaaatatattcttggtctcatcatctaggatacaatcatagggagaagggtgagatgcaggggtgaaatggtccatgttgatcatgatcaaactggcaccaaacaagaactgatcatccttaccaacaacagtgccatggtcactggtgaactcctccatgaagtaggaactcttgttgtcaggcaggagctcccactcatctaggctgattgcatccatggaagcagtacctctgctcatgtcaaactagttcagaagcgagcttggatcacagagagatatatagctgcccaaatgcttttaattttgatactcccttgatactgtggaagtggtcaagaatggatgctcaccaagaatcaataccagcagtgctgaggaaggatactttctttttttctggaggagaataaatggaacaagagggtacacttcttgcaccaggggagatgggtggcaatccaacttgaggggtttgtgtgtgtgtattggcttagtctttctgctaagtgacaaaggtgaaaatgttacctggggcctaccagtgatgactcctcctttcctagtttccttcctttctactcaattctttctaggtttgtgcaagaatcaagattagcagacggcaaacaattaattattcagcaaacatgattagagattgatttctataaagataggatatagtgtcggtgcagaactgtgaactagtctgaagtcagctggagcctcacattcagacatctcgtgtgtaaagagcattcagattaattaattcctctaatgaacatctgatgataataactcaaaatattcctacgaaccagcagtatgttactcagtaatcttacctggacggcagacaaaccttcattaaatatcttgacagtagctgtcgaaggattagggtgccacctaatctgaaaaggcttggaatgtcaatccttttcagtcgacttacgaaaaatgtttccaaaatacaggtccaatatacaagtcaatttgacacagcactggttagtagactggtaacactgtgtagatgataagaaaaggacttgataaacgaaataaacaggaactgatgaaggatagtgacacacaccacttaaacacggcaggcataggataatcagacacatgttcagaaacttctacagaaattttactctggaaagctcagatgagaccatagatagaacccacaattttatagaagcagatttatgaacagggcacgcactcacaaatctccagtaaacaatagattcacatacaaaaggagcatcttccagaaacattttgttagcttcttataaacggtgatgtacatataacaatcacagtaaataaggcatgagtcggcggccccagcttcaggctggtgcagacaacgaccaagttaagagttcttcaaaggttaacactgtaatgattcatacagcagcaggagcaacaaaaattcatctaaaggctactcaaactggcaccacacatc

SEQ ID NO: 54547 - DNA, 1501 bp, Oryza sativa
agtaaataaggcatgagtcggcggccccagcttcaggctggtgcagacaacgaccaagttaagagttcttcaaaggttaacactgtaatgattcatacagcagcaggagcaacaaaaattcatctaaaggctactcaaactggcaccacacatctcaaatttacagtagttatcttgacaacaagattaggcattgcatccgcaacgcaaaaggtattcctagtatacaacaaggtgaggccctcagaatttacatgaccatgaggttcccacatgcctgaatggcgcaacaaagcaactatcatatatagctggatgcggaagcaagattaaataactttggatcacatgtgcagctacactaaacaaacagccccgaaaaggttaagcacttaagcttgccgtgaggatgatgattcacccagtgaaacagaagtaaacgaggaagcccaagctcgagcattgcttgcgcctttcctaaggtcccttgtcttattgctcagtctaagcttgctacaaagcctcttcacatcaagtacattcagcgctcgttccaacagttggcttgatcccctacggatccctaagttcaagttctgaacacgcacgaccaagaacgttttcagatgggagacgacgatggggacgaaatgcgctgcaaccttcaggatgataaaaagcaccgcaagcaacacaaatggctcatcttttgcaattttacgcagagatcggtcccctggtgtgactggtctgaaatctccagtactgtcttgatgatcgacatcaaaatatgcaattggatcgaagcctgcaatataaataatttacttcaagaaatgctctgaagcaacaaaggcaacccaaaaaaatctaatcatcaatagcatatccctgtttagttgattggacaatggaatcgattctatacaattaatggttgtctgcattcacaagcatcaatatttcatactaaaaaggttcgaaagattaaaacattatagtaagatggagatcctggtgtgtaatatcgagaaagcatcatggcaatcctaacaggtgcagctaattaccagcgagggaactgtatagtttccaaactaaatagcacccaaaggctatgttctcatttctgggtttaatatatttgaaagttgttacgattcttgtatgcaggaaaagaagagcaatgcttgtacctgtagtttctttatagaagtccaccagagagctgagatcttttgggccccagtatcgtaccattgtagtctcatttacaagaagaatggccgggaatccacggacaccatatcttgaaaacaaactacaataagcagaaacagcataataagcagacgagtcgacttaaaagggggcatgatgcctcacttaaagagacatatagacaacataggagtcaacatttacatacctaggcattgcagatgattcttcaacagtaaagtgatatatctgagggaacatagtgctgagagcttcaaat

SEQ ID NO: 54548 - DNA, 1035 bp, Oryza sativa
cttaatgaatgaacacaaatatgatgatcatttagaaataacctcaaaaaactacatgtagatcaatttggaatggaggtagtaatgaatttacagttgagactttacacaacacgcatatcaaggaaataatgttagtgggtgtttgggagtgagaaacttcctctctccgaaaaataagtccctcctatacggactaaaatttttgtgagagggaactttagtccctccttcccaaaccccaccttagttgatctggacagtgtgtgcacgtggtacatttctcttttattcccaaacaccgccttggttgatgtggacagtgtgtgcacgtgatacatttctgttttagtacgatattggtaggctaattcctttgcaaaaccaaaagcattttttttcagttccacctgagttttgaagccgaaaaatgttctaacttataaactaaaaggccagcttattaacatcataattgaaaaggctaataaaccaaaacaaactggcccttagtgatcagtgtaatggtggcctagctaattttatttagtactaatttctcaaatgtcgcaactaaatggcagcagcaaaatgtaggtacggctctcttcaagtgattgtgtgctttaattgctacaaggattgtaatctgtccgtgctgtcggcactgcagttaatcattgccgttagtggcttcacaaaagataagccaatatattaagttagcaaccgtagcaagacacgtacaataaaaaggaaacatttttgggaccaaatgtacttcgcgatgacaattatattagtggtgttattagcatccaatgagtgaccaacattactgattgagtgtgttgcaattaaattcataaatagccgcgtaagcagctacagttgtttgcttaaatgagcccaaatgtacttttgtcattgctaattccctctctattgacatttgtacaacttttcatggaaaacattctatgatttaacaccagctgattttagcttgtgatgattttatttgtatgtttcaga

SEQ ID NO: 54549 - DNA, 1501 bp, Oryza sativa
ttacatataccactccgcttacactttcgtccttacttcgtgtaaaagggttaatccgtgagtgatatggttagagggacaagcccttataagctggttccactctcactaaactagcaatgtggtactaaacatgcgcacacaacttacatggcccacacatgcctaatcttaattgggtcaggatgtcacaccaaccataccattttttttttggcaaagttgccaaaggtgtgcatacatttagttttttttttgccaaacttcgacaaatacgtaagaaattctaccaaaattttagtaatattgtcaatttatcaaaattttagtaatacataagcattactaaggtttattttggctacgatccgaacagccccttacaaaccgcgagaattttttaccatatttacccgtgagaatgtaagtgctagtatagcacaaggccacaagccgtccgatgggataactgatcggctcatattcaatttcccaacctaattaattagttaatgtttggtagatgattgatcatatgtacattgttcagttattgctgacgatttgcagttttgcactgtgtatataccgtactccctccgtttcacaatataagactttctaatattgcacacattcatttagatgttaataaatctaaatgaatgtgggcaatgctaaaaagtcttacattataaaacggatgaagtactagctagtaggtaatttgacacctaaatttttacttcacatcggtgatatatatatcgatcaagtacattaacttggtcgtcggtcctgcaatgcacatgctcttgcacggttgcacctagtcggccatcgatcaggccataaacccataactgcatgcgtgctagcttgtccatgcatatatctgtacagatgtactaaagtttttagttataatcatgctgtcatgttgccggttactttaattacttggattagtaggcctgcatatcttctgttcctttttaattatcagaatggcagaatgcacgctggcccgttggcctttaggtttttaagggccgagcctatttgatttataacattgaacgaattattattatcgtgaattaattatttaattatagagataaattaaatattaaaaagataaagttgagaactaacttaaaacaaagtgatgaaagggaatgaagggtagaatggtaaattctctgcttccttaattttcacaagtgctccctctatctaaaaatcaaagacctatttcgtttttttgcaaaagtctaagacctattagtaatctatatgtgttgaattaaattgttaaccgaaacccaagaagccatcttattgcatgcaagtgtatagttcatttgttttgtcacatagtggatgagttaaattacttattggtcttggtgacaaaagaaacatgtcttgttttggatggagggagtatatctgaaatatcgtaagtttaaaaaaaagatggagttattacaactta

SEQ ID NO: 54550 - DNA, 1501 bp, Oryza sativa
atataataatatttttaacacaaaacaaaaaagatactaaaatatattcaatgtttgatgtaatgaaactgatttggtgctataaatattactatatttttcataaattccctcaaactttttagaagtttgactttaaaagggtaaaaaccacttataacataaatcggaaggaacactaaattttggaaaagagataatactatgtttgtttttttattgtgacgaaaaaagtataggttatatatatataggttttatatatatatatatatatatatatatatatatatatatatatatatatatatatatgttgatttgtgctagcacatattttaatgttaaacggtccatcttctgcgaaactttctgtatataagttatatgaaacaaatctacttttatatttataatgattaaaacttaattaattatatactaataccattcaatttttttggtagaaaagaacatctgtgtcgtccggctcctctagctttggatgctctcgtctcccttcccttggtgtacacgtactatacgtagatgatgctagtatactgcacgtatctttgcctgggtacagtgtagtactactaattaacaaatgtggccatgtgatatgtctgtgccttctccagaagctcctcttcgtgcaagtgtacaaagggctgcatcaagcaaatttctcctcgacccagtgagaaaacagagactgaaatacatctgctagatgaaaaatcgtactaggtgatattttgttactgctagtactatacatctgctggtagcctctgttgccttctgtaaatgtaacacagtagagtagagtagtaacagtgctaatgcatgatggagtagtgcttgcggtagcatgttaatttcacagtttcagtcattcattagggtggatctaacactctagcagtagtagtatatagtactcagtactcacataggagtaaatcagtacatgtcctatgcaagtctgtactagtttgcagagcgcgtcagtaacattgcgcgggaactacaccacaaaacgcgggaaccatgaccgtgggcaccccccccccccccatacattcattcgcatcagaagggacagtcagatataataatgcaacaatcttaacccttcttgtaaatgtgagattcacacactagccctagagtgaacggttttcactattagtaatccttcttagttttgtttttgtttctcacagtgcagtcatcaagcctgcaaaaagtcccaactaaatattgattcacgatttatttagagattaattatatctatccaatgagtctctgatgtgtaattccgacagcgtgggaggttctgtatgcaatttcccactccttttggtaataaaggaggaaaaaaaatagaaggctgcttgcttccttgtaactctcagcgtcagcgagaagcagccaaagtgaaagcgaaagagagctgaactcagtggaggctggagagtgagcttaccaa

SEQ ID NO: 54551 - DNA, 320 bp, Oryza sativa
cactttatgcctgcttggagccttggagcaaaataaattttcatgccattagcagatgatctacgaagttttatgcttggaaagggggttccgggagaaaacctttactctatgtacttgctgtaactgttatttttttagtagttaacatggacgtatcaaatgttaaaccacctgttgagtctgagccaaacaactgtggttttgtagtccaggatgctgcattcactggatatgtctcagatgatttcataatatttcacttgtaatgcacctttctgttaaagctcttaaatttcttgccactaattgaccaggga

SEQ ID NO: 54552 - DNA, 1501 bp, Oryza sativa
taactaattacacagattgcgtgtaaattgcgagacgaatcttttaagcctaattacgctatgatttgacaatgtggtgttacagtaaatatttgctaatgacggattaattaggttaataaattcgtctcacggtttacaggcggattctgtaatttgttactgcgtttaatacttcaaatatatatccgtatatccgacgtgacacgccaaaactttacacccgtaacctaaacacagcctaaattagtcagaagtgagatgatgcactcgcagacccggacactgcaggagccttggtggtgctcacatgccaagcagttcctgtcttggacgtgtagcaagcaaaatgatgacggagtggcgtacacttgccggtgccggagacgacggactttccggcgagcggttgccatggatcgacggacttcccgatggccgaggatggctgaacagttgggctccaactcggcctgtcacgctaaaaacggcccacgacgacccactttctaagcaggccatttggaggcccaaaatagtccgacagccaccatttctcggcgcgtgaaattgctctcctactccactctaggcccaatacggatttcttggtgggccaaaacgaacccaaatttgtgaggtgggccgcgtttcttcgcttgggctccctcgtacagcccacgggcagcagcggtccatttactggtaggccaaatggaggcccaaattcctgcggcggcattgatcgaggcagcccgtggcaggccgggtttctcttcatgggctcccaattacggcccacgaccaccatctcggccctccccacaaaatgctcaatttcagcagcctgacgaggcgcctagacagattactgagtctgaaacgaaccaaagataacaacggtcgtaacataccaagcagaattattaacaggagtgagtgacacagcacaatccatcactccaacagaacttaaactgtaacacaagacttatggagaaggtcaaacaactctgcgaatttgatatatatttcaggagaaacagtctaaccatgaatccaggatcatgcccaggcatggcctgcacacggcgttctcttcaacatcaactaggattacaatatttgggattcagtagtaacctatttgaatggccagctggcctcaaatcttcctcccaacttggtgttactgttacaacaattgaggcaccaaaatgcaccatgcaccatacccaacaacctcccatcttctttctcaatcccaaatcatgatagactcatagaccatgcattgctgccttccatcttaagctctctctcttcgttttcatttactttcacttcagtggtgaccaaactccgcggtgcctttaaggtctgagctacaaacttgctagatcaggaatgatctaatatacaactatttcggtcgataggcttagttctagatgacgatttgtttggaacaacgaatgaacaaaaaaaggatggagataca

SEQ ID NO: 54553 - DNA, 238 bp, Oryza sativa
tttagttgtaataattgatacttcgacgactttggttatcggagataagacccgatcagagcatgttctctcttagatcgggttcttatttaccgtagaataaaatatgataaaaaccacgtaattaacttcaaaattaagcactaaaatttaaaatttaacttataagcaaaactctaaccgaaaatgatggggatgaacgtgttttagtgcccgcctgctctctgtgattaaaaga

SEQ ID NO: 54554 - DNA, 1501 bp, Oryza sativa
agtcaacgtgtcctgctaatggattagttatggtcactattactttttgacaaaattttgtgaaactatatcaaactattacaaaagtacatattcattataatatactcctatcatgtcttatgactacacacaacatgtcttatgaaaaagtatggtactcctagcagtgataaatatttgtcattctattctaatcaaaacaaatatttgatgttctagacaatatttgatacaattttgggaatttgattattaatttctgtatatttagaataaatgtataaattacaattttataaaatctaataactttaagatggtatgatagtgcttttcatggaaaaagttatatatagcatttcaagtaagtatttgagaattattgatgatcaaagttttaaaagtttttatcaccttttacgcgtccctaacacacgctaggaatgaaattggaggcactagacctcagtgcacgggaaacgtgcaatcccactgaacgcgcacgcgtgtgtgtaccctattacctagccaggaccaaccgaagtcagtcccggggaaagaggggaaaatccccccgggcgagcacgagtgtcgaacctggggtttgaacgctcgcgggctgcgtgcccaccagcgacgcttgccacctgagcaagcgctcggtctctgaacatcaaatatttattgtctgccgcagatgccattcgatgctaaggagaaggtcgagttcaaatcaccgcaaatctggggccagggctatcaacgctacaaacgccgacatcggcgatgcttgtcgacgccatacaccttcctagatgcgatgtcactgacgcctcatccctctccttcgtgccttgggatagtctccgggtcaaaacctggtacggatgtttggagtattgatgacgatattgtagatgtgatcttcttaggccatcccaaccctccatgtcatatagtttccatagcactaaatacattgacacataaaaaaaaattctatgtggcaagagagttaatgatgagagaggtaaaaagatgaagaaacaatttctcatgcaagaaaccatttctacacaagaaccaagaataaaattaaggggataggtggataaaaggagagagaagagaggggattggatgagaatttaatttgaagacaccatccattaaaaacatagtttctacacatgatatctatatgaaatgacaagtatggaaactactagatgagttggggatggccttaaagacgtgtcgtattggaagttccgtaatggtgggtatctttagcgttggatcagctctgattgtaatggtggcgtctaagatctggacgtatgagtgaatttagagattacagttcagttaccttctgacgttatcttctgctttgattttacgtcacatacacatggtgatgcttcaattgatggagatggaaaatcgaattatcgatctcgacctgacataacatacattggtcgtcctgtaaggc

SEQ ID NO: 54555 - DNA, 1501 bp, Oryza sativa
tccccagttccatctgtccacacactccacagcaacaggcttgcagcctgcacaacagtgcttgtgtagttgtgtcgcgtgtgtgtctgagagagagatcagagatgagggcgggcgggttgactgggagagtagaccaggaagtcgtcttcactgaaagtccgtggaatgccgcgtccctccatcgaaagcgagaggggccccgccctacactgccaaacgtccctctcccccagggccccaccaccccttgaaccaaaaaaaaaaaagaaaatctctcgcctacgcctagtagggattagtagtagtagtactactcctcgtcgtcgtcgtcctcgccttctcttttgacgggcttgcctcccctcccctccctcctttgccccccgcgtccaagtcttccttctcccaccatcgtcgtaactatctcgttgttcattcgcctcctccgctcctcgtcttcgggtgtgcgggctcccttcctcctgcttcttcaggtgagacgagctctgctttttaattcttgttcttgtgccttggtgtgttcttgtggggctttatttgggggtgtacagtggatatgatcttcgtgagtggttttgcggtttagtgttcttggagcgcaggaggatctcccggacccggaattgttatgcaaggatggagaggtgaatttcgggggtgctggtagagtggtagtacggcgatggaattaggggagaggaattctgttcgtattgctgctgttgttgttgccgatgcgtgggtttcttgaggaggaccaagggttcgtccaggactcatccgcttggggatttttgatgatcatacgcgaatcatttcgagtggcggagaagggcggccggagtgcctgaccacttttggtgcgagatcgaagagaaaagatagtgtttgtttgtttggatggtggtggtgccttcttttgggggatatttttttcctcgttagatttttttcgcaacaaaagtagggcgcctttttgagacacgagagaagccgagatattaaaattagagaccttttgatcgctctaaaatagaattgattgaggcatagaacgatggttttgtgtgttagaacctgcttccagtagacgattctttgttactcgttctcattcatgcatctacttgttcttccttttgcctatcttaataattagaaagtttaccgcttgtgtgatttgctttgtctaaggtggggatcagttctctactgatgtagtgatgttggctgcttacagttgggattctttgatgttgttgttactatcataaattaagtcacaatttccatcgtactaggataattatactgtggcacactaactttcaggctagagcatcgtatgtttacctgtaatttcgtgacatggtgttattgattcttgcaggcgactgctaattttgaagtgccatttctcatcgtcaaggagaggtggcattaatccgcagcaagtgctcgatgacagatcattatt

SEQ ID NO: 54556 - DNA, 1501 bp, Oryza sativa
agatgagtgaggtggctttacatgatgtactattaagtagtatcagtatactgcatccgctgtataatttttgtagcttgttgttatctaccattgggaggtgctagcagcagcaatgatgatctttcactcaaccgatatggggatggggtattaactactcctaatagtagtttgctcctcatgtgatgggaatatgccatattggcatttattcagtcatttttcatgatgtcatttgtacttacgccacgggatgaggaatactgaacgtcaaaatgtgtggaatgccaccttatgatgtcttccagccaaagtgcacctgagtatgcaagcaaacttgggaatttcattatttcaacttgcagtgtaagagtagtgggtcattgtcttttgtaaatgtagtatagcttttgctggttgaaactattttttttcttggtctataaaagcttcttttcatgctagccacttctattgttgaaatatgcagaaatatcaagattaaagaaaagaatggtgtaggaatattgcaaattaagcagagttatttttagcttataaaaacatgtcacctttatttggtcaaaactcttgcctggtcttaaagggccgtgtgcgttccagggaaattcatggacttttgtagtggttatctggttgatgcatctggaaatactgatattgatgggaaaaaatgctcctcttttaagtcgtttttttttcttggtgggggtggtccagaaaacctcttacacgtatgaacaccggtcaaaatttttgacttcaacgaatgttatatctggaatcatcaagattactgataaaaaatacctgcaagaaatattaatgaaaaatcaaggcgtatgcataccgattgctagatagcgttgctttggtgctctctacgggtattattataccactagtattattaggagtaaattaataactaatatactttttcatttatgttttttcttggctaaatcgatctatgatcacccattacgctggcatcgctcatgtttcatgaaaaaacaaaaaagaaaaaaaggtttagtcactgctaaatgatgattataccccttcgcacccttttacatttctactactattaactagggtggttgtataaatagatctgaacccttcgatcaaatgagatcaatagttcggattattttctaatacatgtagagagtaccgtaatgaggctcttgctagaagtatttcgctgctatttatttagtggacacataaaacttttgctctctgaaaaaatttcacatgtgacttcagaagcagcataaagtttacgggcttgttcggtttgtaggatttttcaaaacgtacgaataggaaaaacataaaatagtataaaaatacaagtgcaaacctaagaattgaaaaacataggaaactttactatggttgtgtagcaaacaatacaatggattgaaaacattgggttagagtggattatatttttctttgtttt

SEQ ID NO: 54557 - DNA, 197 bp, Oryza sativa
cgaatctcgaacgttcatttctcgatccaacggtagttttcaagttttcactacatatgtggtttgcactagatattttccccttttgttctgaactaatcatgatacctttggatgaactttgtagattttttttactaccggcttttactaaacttgcacacattaattttcagttcgaaagcttgagagataga

SEQ ID NO: 54558 - DNA, 1501 bp, Oryza sativa
cgaacactaatgaaagttgcggtgcgagagattgctacgtactggttcgagaaccagcgagcgagtagaatcatctctcgaacaccaatggaggtttgcggtgcgggagattgctagtactggttcgagaaccagcgagcgagtagaatcatctctcgaacaccaatggaagtgctagagttggtttattacatgtgcatctcatatggccagcatgactcacacacccaacttgtagcatatccggacgtccattcgcaatcatgtcgggtgatcaagccgacggcgttcgcgaggaactatccgttaacaaccttttctcgagtagtccagccatggccggtgctatgagataggtcgtcggtcttcgttggtaggttgggcgcgacgactctgcatttgtcgaggttgttctcgataatacggtgtactcgaccacaaactattcgagtgctcaattgttcctgaaaaatattttctagaagacaagacatatagcggagaatatcgagtatgtactaaaaaattgcatggatcttctagtattatcaggatataacgagcagatgtaaataccaggcattatgtagaccgtaaacaagcatgatttatacagaagaagacagagcgagccctcagcattagatcgtagtcgatttaacatcggggacacccgcgcaacagatattgtataaaaaatatattgtaggtaaacataataaattatagatctgacaatgctgtatgatctgaatagatatgataaattgcagataaaatattgtatacctttgtagatacatgccggatgtatctatgaaattaatagattaattaataaatcaatccactaattaccttttagccaaactgaattgtcctcagcgattggcacgtgtagatggcatgcctatgtacgtatgtatgcatacctatggctgagatagctcagctcttcggtacacaccatgcaatactgtacatcggtcccactgtatgcatgctgacatacggagtatgtgtcaacacgtgatgtagtcagccgtcttctcgcttggctgtccggctgctgcacttgagatcgatccaatccgaccacggatacaggcgacatgtagtagtattctgttttgtcagtagcactttgtgtctgagacggaacaatcaagcgctcggtctcaaagcaatcggactcggctgaaagtctcgaaacccgcggcggtgacatcttggtcgatctcgccggatcgaattatcgacgacgatggttcagatctcgttgggggacgtactttggctgggttggatctccctggttcgaagtagtcgagtagcttattgttgaagaatccatctttttgaacccatctcgtcgaaatcctaaagcaccaaaatcccctacctggcgcgccactaacaacgtttgatgtcgcgattccggtatttgcatggtatggagatcgtcggtaccatgatatatgcgagattgaggtaaaagaga

SEQ ID NO: 54559 - DNA, 1501 bp, Oryza sativa
aaccacttcttcgacgatgggcacgggcaacggcgcgacctccggtgcccaccgccgccaccttccccgacaatgacgagcttcgactgagttgataaggggcaattttatctcatcacctagtagatgagagaaaatcttttcgaaaatgaataaaatggcaaaaatgccaaagtggcggtagacgcacgcttcatattggcattttatcgaatcgcattttcgggatggcattctagcgaaaccgtgttttgaacatggctaaatatccattttctctggcattgacaatcccaaattttcgtaagtaacaacataaacatgtctcaaatactgtaacacgtcatatgataccaaaatttaccagaattcggtaataccaagttttagcatattttgctggtaccaaattatacagtagcattagatgtatttaggttgatctcttctcaaacttttattatgatagaagtttctgagttacaatgtagcattggtaaaataatctttagtttatcatgttgtatagttatatcttatcaattgttggcattaaaaaaatggcggggttagttttggcatcaaactgaacacaccctatattagcaaaagggtgccctttcacttggatattttactaacagcccatatcactacagaatcgtgcatatcgaactcctcaaaattgcaagaaataacggcacagtgatgcgcgataccatcatctcaagtccacaggatattaggatggacgatttttagaccatgttggatttggattaagtatggtgacgtatatcacgataaaacaatggttaacggtgaacaattagtactgtgctagctgctttagaaaatggcattttgggctatgtgtcagtactataatccagctcgactttttatgagtttttgtttttccaagtcattttcattcgtgttgtcaccttgaaacgagacagaatggctaatcttgtttgaactctccgtatatacattgcaaatacaataggagcagtgcatggtgtttcgtttcattcatgcaccatttcacacattgtatttgatatttgcatcagattgctacgaagctaagaacaatcgctgcattcctacatctacgcgcggttagctcgccggcgtcgcctgcggcggcttcttgatggtcttatcgctattgtgaaccatcagcatctcctgcaccgccgcggagagcagcgactagggccggttcaacattttaaagggccctaggcgaacttcacattatagaccctttagaagttaagaagttaaggctattttttaacttgtaatatctataaagcatctatactatagtaacagaaataaacatttctaacatgttaaataataaatcaaacagtttgcaagttgcaatataacaatttgttctcgataaataatatcgatagtatgattgataacttaaaaaacacacagtagaaacaaagtactatgacctaaaatcagtgaggga

SEQ ID NO: 54560 - DNA, 1501 bp, Oryza sativa
tatgaatctgaacacatagttatctaaatttaaagctaaatatgtttatattttgggacggagggggtatctggggatggctaattggcgcgcgcgccagctagcactccctcccctcgcgctagcttttctttttcgcaattttcctttttcgcttttacttgattttttgttaatcttctacacacgttttttcaaatctttaagttgaaagtttttaaatctttaacttgaaagttttcaaatcttagcttaaaaggttttcaaatcttaacttgaaaggttttcaaatctggacttaaaagttttcaattttgagttgaaaattttcaaatctcaagttaaaagttttaattttcaaatctcaagttaaaagtttttaaatcttaaattgaaagttttcaaatcttaaatttaatttgaaagttctaaattggactttaaagtttgcaaatttgtagtgaaaaggaaaataatgttttggaaaaaaaaagtttatcttgattggcctaatttatactacctccatttcaggacataagactttctagcattgcccacatttatatataatgaatctaggcaaacatatatctctagattcattaatatatatatatatgtgggcaatgctagcaagtcttataatatgaaatggaggaagtagaacctaattacgtataaaaattaagttaatcacgctgtcagggttatggataccacatacctaatagtagttgactaaatctcggcacgactcaccacataccatatcctatacggaaacaacctgcggatataggaagagttccggataaggaaagacaaccagagttctatatggaaacgacaaggactactctgattgtatccatattggtttacctagttctatttgtacaagggacacctatgggtataaatacaagactccctaggaggaaaggggacacacccaccatagaagagacaatcaacacccaccacaatctacggaacaatagatcaagacagaagatcaacatacaagccaatatacgctaagacaagccgccgggtatcgacatcagagatatgcctggatcgaccctatccggaacctacagaggccggccgtagggacgcgttgtctctgatctcgccgggcatgaactcgaggaagaagactaccctgatgtcgactatgagtcagatcttcagaccgccatgtcgataacagttagatatgctacccaaatattgtactggtgtgattatgatggataagagcaatgaccggcttcgaccaacaggatgtagggttattacccgataattcaggggcccgaacctgtataaaaatccctgtctccatctcttttacctcaatctcgcatatatcatggtaccgacgatctccataccatgcaaataccggaatcgcgacatcaaacgttgttagtggcgcgccaggtaggggattttggtgctttaggatttcgacgagatgggttcaaaaaga

SEQ ID NO: 54561 - DNA, 1501 bp, Oryza sativa
tgcgattatgttatttgagaatagtacaatttgcaaaataaaggtgataagaggacttcaaaatgccattagaaagcatacagaactaaacaaactattctccaagaaacttcgatctgtactttagtcaactgtagaatggttcaatgaattgacttggcctactatacattttctagtcaaaccaaacatcgataagatcttcggtgaacaccattagtcaacacaggatttggttaagcgttgtacaagtggcgaaattgcctatgcttaccaaaatggcatgatccaattatcctaaattgaattactccatctaccctaaaatataacaacccatatagattcgttgtaatgtagatgaagattaagtaccaacataaaaattattagcacacgattaattgagttttaattattttaaattaaaaatagttttatatgatattctaaagcaaattttcacattaaatgtactaaagtacttagcattttgaaaatcatgctaacaaaaaccgagctaaaacttgcatcttaatcagaactgaacgagcctgatgtgtcccattttatattaattgctatattttgggatggaggaaataataaaattattttgtgtgatatatataaaatccatctaaatttgaggacgtgcagttcagggctagtagtgaatattccacgctgacagacaggtgggccacgcggtaggcagtactagccactgagtgggacccaccagcaaccgctggccaatcagatcgaagggatgtatccacgcctcccatgtggccggaccgcgcgagttgcagatccccaaatgttactcaagcacatacccacacccactgattgcgtggaccccacgatcctatgggcccacatgtcatttgctaatctagtgggtacattgaatcgctgggttggtggagctaactgtactcggaattaacgtaaattgactatcctctttagtttatcggatacttttatgagagagaaggaagaacagagagagagagagagaggagggagaagaaaaaaaataatcgaaaataaaataaaataaagagagagatagaaccccagatctctccacagtttcaacgcctcaaatctctcaactctcgtcccaatccttaggtacacgcctccctctctttcctccaatttttgttcggagggaggacgaatttcagttcttgtttctgtttcgatctccaaccaaatctggcccaagaaaatttgagtttcttgtgtggtagatgccaccaatgtgtgccaagcccctctgagatctcaccggctgatcagctgatgtagtttgcagtcgaattttgttccgtttttgggggcaagattgtgttcttggagctgtagattggttatacatttttttttccatttcttggctcagttttgtccattcgacgaggaatttctcgtcgtgtttgttgttgattgattgatccaatctttgatgcgccaagaagcaaga

SEQ ID NO: 54562 - DNA, 1501 bp, Oryza sativa
atccttgtacgatgcaagagcacggatcttcttgggcaattgaggtccttcgatcacataaaaccataaggaaaaaagctatacatgaagaatcttcacatagcccaaaaaaaaaaacagacttaccagaaaggaccaaattcagtttagcacactgcaaaacaagaaataagtccagttagtttctaaaaatgagttagctacatcagaaaactatgcaaggtgagagaggctagcgttaaagctcatatgtacaatgaagcagctcgattgaatcgaggtagtagtgagcaaatcgcattgagctaataccacaatcagtaactagcccctgagctcgaaccatgacttaaatacacaatcaccgctccaaagcatctcaaatcacgcgttctaacttgtaccagatcaactcgctccaccaagctccccgtaagctactccgatttgagacgcgagcacacaaggccaagggtggacggtggtagggcggcgtgggggtgggagacgagcggggagaaagcagctcacgttgtagacgtggaaggccttgccgacgctgacggcgacgaaggtctcggtgccgaggcgctgcacggagaagggcacgccgccggccgtgatgtacccgatggcgcggaacggctcgaagatccccatctccctctctctctctctcccaccgcggcggcggcggttacttctccggcggctgctgctgctgacgatgcttgtcgagggtttggccgctcagcttgggtgggggtgcgccgccggcgagggttttagaggtgggggttttggagcggcggcgggagaaggaagggtggacgctgtctgggtaggtcagtgttgttgcgttgcgtgatgatgaggtaggatgggccgggccgggtgatctggaccacgagggcatctgggtcctggaggctggagctggaccgagcccaagttgcgagttctaaagtttctttctttttatttgtttttcagttttagattagataggcagagatatttcagttttcaatacagggaaaattctgcatgaacttgaaattcttgtgtattttaaatttaagaatttatttataagtgtcggtaacatggaagcagggaagagttgcaaacttctttggtcctctccggccacagccagccatccactggtggggacaagccgacaaggccatccttctcttaaaaatcatgaggtaccatactcctcactcctgaactgaatgttcatgggctaaaaagtgattaactcgagatactcagatacaagctgcaagcaatgtcgtactgccagtgccagatacgttaaatggggaataactggaaaaaaaaaactattactctctctgttccaaaaatatgcatatcgtccgtatacatttaaaaaccatgcacaagtacctatattttcgaacggatgcatcatccattcgtaggtcctacgagagttcataacacgtcaagagttcagatatttgttttg

SEQ ID NO: 54563 - DNA, 1501 bp, Oryza sativa
ctaactacctattttcttcacaacaacatttccatttattcaaatttaagccggattgcgaaacgaatatgaaggtttcaaatattgacggccaccactcgatgttgtctgatacatgaaaccactcgattaattggtaagttcaaaaaacaaactaatatttataccttatcgtgggaagtggttttcttgagccccaatatattttgtaaaaatttggtggtcactaaagatatagatagtataatctttaaagtatcactcactaatatagatagtgttggattttatatcgcaaaacaacatatttcctcggtttgagaatgtaagtattttctaggtagacacatgtattaataaagtagataaaaatgattagagaatcacaacagaatttaagtatatttttagttggacacggctattaaaaagtatataaaaaatgatcgaagagaaagtaggtaaataaatgaatgagaaaatgattgtgattgattaaaaaaaagagaacagataaagaaataattttattttaaaacaaggtatactaagttagaaatagctgtagtataatttagcattggaacggagtacattattttttgagttaatttcactttgggccatattttattgccaaaattttcactttggactaccatttgtccaatcttttcacgttggactaggtaactttacctttgttgcacaatgaaccaccccaaaacatatcttcagttcttcgatgacttcgagcaaattgttaacgacatgccagtaaactttcataccaatatgcatgccatacatttgtcgaaagagacgctagacatcactagcgaaaagatttatggtggtccattatgcaacaaaggtaaaattatttagtccaacgtgaaaagattgtatacagggtagttcaaagtgaaactatcgcaataaaacatagcccaaagtacaattcactctttttttttttcactaacacagcggctattactccatttcttgagaaaggctttcctcggaccccacaaatcagtgggcgttacccgtggtcctggcgtggaatgcccggtacccgtaataatttgcgaatcatggagggcattttggtccagtccagaagccccaaaaataaagctcgtaatctgcgaaagctgatgaagctgagagagagagagatagagagagtgtgtgtgtgtgtgtgtcttcgcttcactgcccacttggatcctcgtggctgctgctgctgtagcggaagacgacgagccgcccaagaatccagcacccacccatccactgctgctgctgctcctgctgctgcaccccccgcattgtttcgaatttctcaaatcggccctcgggctgcggcggcgcggtcaccggcggcgaggtgagttcgtcggtgaagaggaaggggggggggggggtgtgaagtgaagtgcgatttgaggagggagcggtggcggcgtgaggaggcgagagccgcacatggcca

SEQ ID NO: 54564 - DNA, 1501 bp, Oryza sativa
gacacattcttgggctcttgccaagaacatttccacaggtcgaggtagtaatgtgcttgcatgaatgtgatactgaacttgaaacaaaaatgcagaaatgaaactgtaataactgaatctttctttgcttaaaagaaaactgaatctttcttcttagaacatttacatctgcaagaaaatgggatccaagaaaaaaccaagaagatgtgacagagaagagaacacagtgagctgagacctgagagaagaaccataccttcagcatctttaggttgaggaggtgcatgggcaggggcaggagctggaactggaactggaactggagctttgacggcgagtgtggcaccggcggaggaggcggcggcggcgacggcgagcagcaccagcagcagggcaccccgaggaagctccattggtaagctcactctccagcctccactgagttcagctctctttcgctttcactttggctgcttctcgctgacgctgagagttacaaggaagcaagcagccttctattttttttcctcctttattaccaaaaggagtgggaaattgcatacagaacctcccacgctgtcggaattacacatcagagactcattggatagatataattaatctctaaataaatcgtgaatcaatatttagttgggactttttgcaggcttgatgactgcactgtgagaaacaaaaacaaaactaagaaggattactaatagtgaaaaccgttcactctagggctagtgtgtgaatctcacatttacaagaagggttaagattgttgcattattatatctgactgtcccttctgatgcgaatgaatgtatggggggggggggggtgcccacggtcatggttcccgcgttttgtggtgtagttcccgcgcaatgttactgacgcgctctgcaaactagtacagacttgcataggacatgtactgatttactcctatgtgagtactgagtactatatactactactgctagagtgttagatccaccctaatgaatgactgaaactgtgaaattaacatgctaccgcaagcactactccatcatgcattagcactgttactactctactctactgtgttacatttacagaaggcaacagaggctaccagcagatgtatagtactagcagtaacaaaatatcacctagtacgatttttcatctagcagatgtatttcagtctctgttttctcactgggtcgaggagaaatttgcttgatgcagccctttgtacacttgcacgaagaggagcttctggagaaggcacagacatatcacatggccacatttgttaattagtagtactacactgtacccaggcaaagatacgtgcagtatactagcatcatctacgtatagtacgtgtacaccaagggaagggagacgagagcatccaaagctagaggagccggacgacacagatgttcttttctaccaaaaaaattgaatggtattagtatataattaattaagttttaatcattat

SEQ ID NO: 54565 - DNA, 416 bp, Oryza sativa
tacgtatgattgttcaaattttatgatactgtaggaatctaaccttgttactatgattcagtaatattatcatagatgggtagtaacatgctatgttactttaaaatttataggtcgttactgcacttttggtaatagcacataataaatattgcaataacagagaaaatgtaataataccagtgatgctataatagtaatgcttgtgcagatatagaaactttaaagtcccaatcttcaaagagcaatatttcttacataatatcttatttttctaatccatttgcaccataatgttcataaaaaaatatttaatgaaactagatctatcgtgactatattttgacgtcattactacgaaaagcacatgtgttactgcatactgaccgtcacgttactacgtaatttctacatga

SEQ ID NO: 54566 - DNA, 1501 bp, Oryza sativa
cttgaaatttaatactacaaaattttatattaaaaaaaaaactttcttccatgtacatgtggattttttgactttttcaaatatgaatatgacaaaaaaatcgcatcgcttaaattggtatgagcattttttttccattaaactttgttatgttgtaagatatctaacattcaactgatttgtttatacatatttaattaaacgaaatttaattggtgtttaacaccacttatattttcttataatcagctgagattttcttatatgtctgccaactacctcggccatcaacctcggccatccgactgaaatcaaatggtcatcacattttcagcgtatgcgaaacgagacaagtcattagtgtatgactaggtgagtattaattattactaacttggaaaaatgatttatttgatattttaaaataacttttacgtagaaagttttcgcacgaaacacgtcggatagtagtttgagaaaagtgctagcaaaaccaaagaaaaaaatctacatctcaatcagaaaaaaaaaacaaggctgagcctttggatgaaccacaatcttatctcatcaaactgtcccgacaaacaacaatgtcatgtcgtgcattttgtcatggcttcccaagctaaggtggcaggattatgtcactggtttagggtgagggtggtcaagttagttggtgcagcgggtacgaaggtatgttgtagaggatgcatatcctctacattgctacacgctcactgacacaccagtgagtagtactgcatattgtagaggatctcgacgcatgttataggcaatggtgagagcaatccagtgaggtggaggtagcgccactgtaaccattattcatgaagaaggccagtggtgggtggatagtatcaatgttagggtcaatcgggacaggttacaaggcggcgagaaacaatagtcgatccaatagcgtaagccacaaaaaacggagaggtgaggaagcttattggcttgagcgctcttaaatagagagaaaaaaaaaagaagaaagtttgtcttagagcatgaagaagtttttatgcaccatcaagttgcaaacaaaaccgaccgacaaaagtgaaaatgcatccactatggttcaaatcctagtggttaacaggccatgaatatcacgtacacgtgcacacactttccataaagatttagtggactcggccaagaatatgtcgttagcccccgtcttttcaaacgtgtgttaggggtacactcatattgttatagtgtgatgtccgtgcccgacggtgtgggtacatgtgcgtttcccgtgtaataaaaaaataaaacctaccaagaaaagctaaaattcctataaccatatggcgatttttattacagagcatataggggaaaaaaaatccggatgggcgacgcgtggacgtgccgtggatccaaccgctcgctggcgtcggctccaagcggaagaaaaaccgagaggataatgcagaaagcccaaccctcccaagaa

SEQ ID NO: 54567 - DNA, 1501 bp, Oryza sativa
acttgccattaaactgattcatcaagttgatctgcgtgttggttcacatcgggaatattaccacattgaggatggccagacaaccttgtcaaaagggacagaggtattagaaggtggatacgaaaattgactgggatggaagaactagagggataattatagactaggatggaaaaactagaggcattgagaggcagtgttaaaggattgaatatttcttcttgattgatctcgtctgatgctgatgctctgtattttctctagatttgtccctaacatagtatatcattatacatagactcttgatttctaaccaaaaaaaaagctgacattacttgtacaatttagactctaataattaaaaactatatttacactcaaaaaaatattcaagactatattctaaacttgcagactcaatttctaatttaataggaccttaatgtggcagccactgcttcttgcagctgaaatgctcctgagttttcacaaatactccctccgtcccaaaaataagtgcagttttgcactattcacgttcaacgtttaaccgttcgtcttatttgaatttttttttatgattagcatttttattgctattagatgataaaatatgaatagtcctttatgtgtgattaaatattttcaattttttcacaaatttttcaaataagatagacggtcaaacgttgggcacggatatccacgactgcacttattttgggacggaggtagtatcacttagatttattccatgtgttatgatggtttaattttttccttcatcacatgcatacatgttttctttaaaatattacataatgctacatagaaacaatcttttaataatatagtttcagcattttaacagtgtcacacagcagcatgtacttattgaaatgggatggcagctattgtagtttcttaaattttgccggcatagtttgtgtctctatctgttttgttttccttttcagggtgaaatactaataccaatttcttttgcaggttcagaagcatgaacatggcaatgtaactttgagagttatagacttgaatggaaaaaatgaaattcttcaagtggttcctatttatacactgctggagcaaataagaattatcttagtagattttaatagcaccataaacattagggatagtgaggctagaaaatctattgtccacattcattaggtccaatctaatacggaaccatcatattacattacgcttcatttgcctcccgttcgatgacacaatttgttggatttgtttgcccctctgaccaaaggaaaccacgtggaaagcgtggttatcagctaatcatgtggaaggaggggatgaacagaggagaacgaagagatgctaagatcagagaagacagaggacgaaaagaatttaatagtaccactcactttgctcgattgcttccaacaatgttatgccgatgaggaggattatagtgacttgctcactttgagaattgaccattttgcccctg

SEQ ID NO: 54568 - DNA, 1193 bp, Oryza sativa
caaaccaaatcaagatctttcttaagtttaggcaacccatgaacaagatccaaaccacttaacctagtgagatgatcaaaaccaacatgtccaagtctatgatgccaaaacatcacatctttatcaaacttagcaaccaaacatgttatcacaggtgaaacaggattttcaaaatcagctttaaacactcttccatagcgagaaatactcaacacagaatcaccacaagaatcaaaaactttacttccagttttcttaaagtgaacctcaaaatcttcatcaacaatttgtgaaaccgaaagcaaattgtactttaagtcctcaaccaaagctacattcttcaattcaaatttctcatttaccttaaccaaacctgtagcgagaacggcacttgtagaaacatcaccaaagataattgattcagtcttggatgcctttctgagagaggagaaccaatttttatcaccggtcatgtgtcgcgaagaaccggaatccacgatccacacgttctccttccttgccaccaaagcctacacacaagcatatgtcgaagcctcagtactggggttagatgataataaaaatttaggaatccagtactgagacacacgaccagaagatccaataggcatatatccacgtgcaaaaacagtttaataatttttcgaaaaatctctccgaggccagtctgaccgtgggtgtccagccggtctgaccgggggccggtctgaccgccgcttcaccgttggtctgaccggtgtccagtctgatcgagactctgcagccggtttgaccggttgccagtctgaccacgggacccactacggtctgaccggtttcctcgagggaaaaccagatttttgccactttgattttgcaaaagcaacctctctctcctttttctgtttatgagctaatctgaaacaaaaaccaacaatatatccatctttgccacaaaaagaacaagtatatttttgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaa

SEQ ID NO: 54569 - DNA, 1501 bp, Oryza sativa
tatattacagagcacacacacacataagctagctgctactgcctccgtctctaaatataagggattatgtctagatttattgtactagaatgtgtcacatctaaccaaaatcgcttatatttagggacggagggagtagtattcatgtgcaagtaatagtgttgagtgctgactgtagcaatattattatcaaaaataaataagaatgagaaaacaagaagaagatggaacaacaaaagaatataaggttaaagttgttagtttcacaccattcactacaaagaacaattttaataatattaatatattatctattaatgtgagtatataccataccatggatgtgagcaaccaccctcatgtgtttgggctagtgactaacctcctctttttcttacttcttttgaagttctctgaacgtatttaggtaaaagatgttttgttttgaataaaaaagaaacaatttaactagattattttttagagagaatccatcgtgtgccgctaactttgtcactgttctataatatgccactgagtttgttaagttctacaatatgtcattgtattttgcttaaattctataatataccatcgccgtccatttagattctgttagtactttataattttgtcctaatgattgaaatatccctaggacaaaattttctaaaatttggctgaaaattccaaaatatcatattataaaataggcagagaagttgcccatctcaaactttgtaagttttacaatctgtatgataaaattgtacaatgctaacggaggctaactagacgatgatggtatattatagaagttaagcaaaatgcggtgccatattagaacttgacaacccaatgacatattgtagaccggggacaaaatcagtgacacacaatggattgtctctattttttatggttgttcggttaactacctatctactatgatgcggcttttttagaaaaaaaagttaaatcttacactataagtccatatcttacacattaaattacatacacttataatataattttcaaattttaaaatgccctattctcattttataggagaattatggaaaaatgatttattgtctatttaattatgagaaaaatattagtccaaattaacatatatgtagaaaataaaaaacaatatgaaagaactacggaaatacctactaatgtagtaatcatatatcatgcaatgaaaaaagaagaccatagtcgaatactttattattgagcaaaaatgatggtattatttttatcatcttttagcggaatctatctaaccataattaatcatcccgtgttttttgtgggacaaaagggagtaaattatagcacatactatggattcttaaaaattcttaaaagttttcatataatattatcctttaaccattcttttcatttacacaatagccaactttacatttcaatttggaccaccttattctatccaagtccggtgattcagcaatgactctgcaca

SEQ ID NO: 54570 - DNA, 720 bp, Oryza sativa
gtgcttggataaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacaaaaatatacttgttctttttgtggcaaagatggatatattgttggtttttgtttcagattagctcataaacagaaaaaggagagagaggttgcttttgcaaaatcaaagtggcaaaaatctggttttccctcgaggaaaccggtcagaccgtagtgggtcccgtggtcagactggcaaccggtcaaaccggctgcagagtctcgatcagactggacaccggtcagaccaacggtgaagcggcggtcagaccggcccccggtcagaccggctggacacccacggtcagactggcctcggagagatttttcgaaaaattattaaactgtttttgcacgtggatatatgcctattggatcttctggtcgtgtgtctcagtactggattcctaaatttttattatcat

SEQ ID NO: 54571 - DNA, 1501 bp, Oryza sativa
gacgacgacgtctgctctgttgttcgatttccgtccgcatattcgtcgtgtgatcgtgtccacgcctggagttttctggcacaggccgcgctcttctcacctcagcctcaggactcaggtgatcgtgtcaacgtccggagctctcaggcgatcgtgtctcacttcacaggttgacaggtcggcgcattcgatgccgttccaaacgcagaaaatttagagaaacatctcgggacagagcggcgctcccacgcgtggaatcccgcagatgtaaaacttcgttacaatttacagtgttcgcaacatcaagaaacgacattttttcattcgaaaatgctgcaaatctgcaactggcaatctctagacaaatcctttccctttcgatgccgaagcagaattgaagtttgagaatgttcttcgtctagaccgagcagtcagtgatctgcaagcgcgaggcgttcacagatcgtctcgacgacctccctcccctgggacgcgttctgcctgaacctctccgcgcaccgccgctccaccatctcggccgcccaggccgccacggcagcgagcggcgcgcaccgaatgctcgtctcctgccggaacagcgtccactcgtcgggccgctccgggtgcgggcggtagctgcaggtctcctcgacgtgcaccagcgcccggaggttggcgttgcgggagatcacccgcatggcccgtgcgggcccgtccacggtggtgtgctcgacgcagagcaccacgtcggcggcggcgacgaggccgcggaggaggagcgggagcggcggcgcccgccccgcgatggcgcgcacggcgtcgatgcgccccgatccagcgtcgacgcggcgggacagcgtgtgcacctcgaggatgtgcgacagcggcgccgcccgcgcgtccgcgtccgtgaacttgcgccacgccgccgcggtcacccggtgccacgggtggcggtacacgtgctcctgcgtgtacgagaccaccatgccggccggccggccgccgcttgcctgtgcgcgcgcgcgtcgcgtcgcgccgagatcgagcgaggctagcgagagcgatttcgacagcaactgcagcgaaataatgggaatatgagtgtgtgtggactccggactccggaggaagagaggaatattcgagttccacggggaattaaacccattattttgggctcaatttgcttggactgcaaagctaccagacctgcagcccagcgcatctacagatgggccaaattttgacatacttcttagtgggcctaagaattcatgaattggggccggcctaaggccagcagcccagtgagtcatcacctcgcgacctaatgtctcgatccaacggcgaagatcaaaaccctaacctgcgccatcgtcgactatattaaaagcccactcctccccgcgccgccgcccttctctcgagcaagcacccaaaccctcccctctaccccgccgccgccgccgaggaaggggcaagaggaagccggcgaaga

SEQ ID NO: 54572 - DNA, 862 bp, Oryza sativa
caatgttatttatctatatcgactggttcaacctagatatagccgatatcgtctaaattgctctcgtcgatttagattgtttagtgtatctaccaccctgagaaacaatcaaaggtttgcttagaccttacgacttccattataacttgatgttgcattagttaggtttgacctactacgttgtaattgaaattgtaagacctaacttgctcttggattgccaataacgatagcattggactttcagctggtcatacctaatataactatttttattttagattactcgctgtcttttacttaatttgctatatctatcatcttatacaagtatatcaaacattttaatctataaagcctttaactaatctcacactatcttggctaggtccgatctactgggattgaaacttgttagtagatttaattgaaacaatactcttatataaggttgtatcagagctacatccgatatgttatctttaatcacctaagttacttcatcggctacgatataaatccatatagttattaatttacgtactcttagttataagcaattaatgttgtctcggcccgatctattgtaattgcttgtatttaagaaaatgatagaattagtaaatgcatgacatttacctctacaaccgatcgcatgtattttaggtctaatctacaagcatctttccattggctagtaatttaggttatataattatattatggccgactttaaactttattaatcttatgcttcatcgattgggtttgacctataggattggttttattaaagaaaagttatttataattatattcaatctaaatctaatttatgtacagtatccttcatgcttgtagc

SEQ ID NO: 54573 - DNA, 1501 bp, Oryza sativa
tcaagtttgcttatttaacccccccttttcaaaatcaaacttgccgtttgaccctattttcaaacaatgtcagggtttcatttagaaaaaaataaaaacatgaatttatatgctaaactgacaaagtggcctctaagaacacgacatactatccccaaattccttttcctctattcgtctcatccagcatctctggatattggcgtagcagatggtaaccagggcggagggagtacgtgatggcaacgcaaagagggagcggggccagtggcacacggtggaagtggaggtggcagcgcacggagggagcgacggtggtggcggagacggcgaatggagggatcgatggtggtgtgtgaagggagcagggtggcagtgacgtgcagagggagaggtggcaccgcggcagggagcatgggcgacggtggactggctctcaactttgtttttgctttttgctgttttttcttcattggatgcaattcaaaatggacaaaaaaaaagacaatttgctgtgggaatctattaaattttaagccataattatgtacaattttcttaatttgatttttgtcaaatttgtcaaattgaaactaaatttgtcaaagctatgctaaatttattacaaatatgtcaaagaatcaaataaaaaaacttttatatagcatggtcaaattaatgagcaagagtaaaaaaaataatttgcccctttgttaacatgattatcttgttttcacagaataagttaatatttatcttcaattttgaaaaaaaaacaaggtcaaataaacaaatttggaaaaacaggattaagttgattgatagacaataaataattatttctttaaatacatagttttgttataactttattgctaaatttgtatttttatgaatgcacattaaatttgtagttttgcaatagtttaatcaaagtatctatatttttacaaaattgactcctaattaacttcagtgttcctttgatgctccacgatatcaccttaatttcctaccttacctcaaagattatagaaagattgtgagcgagaagtaagctctttttacctatatgtattagtattgttttgcatattattagtaagctacctctccgtcctaaaacatatactaataatatttattttatgtatgtagacaagtatcaatattttgagattggagatattaatgtttcgtagcatggctcgtggtatcatgcagtatacggcagtagtcgtcaaagcacactaatctgcatgaaaaaaaatcaaacatgatgagttccattttggataagagggattagctctctgaaaagtggcccctattaaattatgtgctggcaccattcccagcaaaggacaccaagtgtgggcccaccacccaaaacattctgttcaaggcaaataagctttagctctattcgcgcctataagaagaagagatcctcctctcctaatcctaagagtcgacacgaataggggctgaacacacagag

SEQ ID NO: 54574 - DNA, 1501 bp, Oryza sativa
cgtcaattggacccactggccgtatatatgcgggtgccgagacgggtgactcatacggcccaaaagtcctttgggctgtggcccataaaaacctatacttgtaaaatgaaacgactcattaccacatagtttcacgtcccacaaaataataacccaataccagaggagacatatcctattattagaaatctcagacagaaggtttgttcagatttatattattaagatgtgtccactatgttctaagtattagctaaacacatcgtatagtagtttgggaattattcgcgtgaaaaacaagccaataaaagatgtgaacttgtaggatcgcgaacacagccatattgaatcaaactaatggcacctggcaccaatagagtgagagggaggagggagtccattgggtaacgattataaattgggtgcctaatttttgtttcaaatttgaacgttgtttcatcgtttataaaaaaatgttttgtcactttaagaataactagcatgatgtgtgcggctatcataattatatcttctctcatattgtcgacggggatacccgtaaaccagatatagagggtattgaggtacgttgatatgaggatctacgtagtacgacatcaagcaaacaggaaacagggattatactggttcaggcccctgataggtaatagccctaatccagttggtatgggattatatagtggaaaccacaagttacaaagggaataacagaactcgatgataccgacgagatcgtagtcgagttggttcgactagatcacccggcgacttggctcctgtaggctccggcttcgtaggctgtggtggttgtcttggctatgagattcgatgccttaggtcctcccgggggtcccttttatatcgcaagccaggtggtttccaagtagaactcggagacatcggaccctgcacggtatagtgacgacccagtcctatacgggtaggaatctttccatcggtggacttcgtgatgaatttccttagcgtatacagagaacgtccgtacacgcgcagatataccatattgccgcatagcgtatatccaagggtagagggtatgccttatccgtaaccctgacagtagcccccgacttctgcttaaatgaactcatgtaaccgatcgcgacttctgatgttggagttgttgtcgttctcgactggtcgttctcggtgtaagaaccgtagagacaaggaatagtcgacaacaccatgcgaagttcaacggttatgagtgaatttaaattgaagttccaaaactgccgcgcgtaacggacccagaaatttccggcggccatctatctcctttccttggaattcgcaccgtcggtagtgtgcctatttaagggagttttgtgaatccattttggagtccgcttgttgcgaaaactttctagcctccaaacgctcttcgtttttttcgcttccgcacgaaccctaacttactcgtctcggtctcttctccgccgatccccggcggcaa

SEQ ID NO: 54575 - DNA, 1501 bp, Oryza sativa
ggtgagcacttggaatatctcgtgggatatcatctcggtgcttattactcttggagatgatctcctagacggttaggtgtcgcccgcgagaatccgttgcatattgtggatgtcccgggtaagtttgtgaaggatttcctctcctccgaaagggaacaaggtaagttagtgaagttcttgtgctgagattttagaggctttccaagtagagaaatccacacttgtggtggatttctagaagtaggttgagttggatcttggtggtcactcaattctagaaatttgcctaggggtgtttggtgttgaaggctgtggattttctctggggtttttgcacaagtgacgcaaggggttaatcgagacccagctctttggagctcctcaacggagagtaggatcgcaagattcgaacttcgggaaaaaaatcgctcttgtctctttctgtgatgcttctgtggatgattctgtgatatatcctctgcttagaatacctgtgcaccatcttgtgaagattggcttagtctcttgtttcgaaatttgaatttcatctctgttctgttacccggaagttcctgtcttagaacaccgtaagtttcgggcctgggaggccggaagttccggagttccttaccaggaagttctgggtttgtttgaattttatcgctgcgatttgtttttaagctttcagggacagcctattcacccccctctaggcttcatcagcacgttcagcgtgaagtttgttcgacatggcagggggctgcacccaagatgaagtggtctgaacagaagatcgagttttcagatgaggaccaccccaaggctgctgttatcccaggacgatatccgatcgtggtcgaacccactattcggaatatcaaggtagcgcgagttctcgttgatagaggcagctccatcaatcttctcttcgccagcaccttggacgcaatggggattccacgaagcgagttgacacctactgatcaacccttccacggaatcactcctcagtcatcgtccaagccattgggcaagatcacgcttcctgtgactttcggcagagcgagcaacttccgaacagagcagatcacgtttgatgttgctgagtttgacacagcatacaatgccatcatcgggagaactgcactcgcgaagttcatggccgcatctcactacgcgtatcaagtgctcaagatgcccgggccgaagggaacaatcactattcaagggaatgcaaagctggcggtccaatgcgacaagcggagcctcgacatggtcgagcacactcccagcccacccgccacagccgagccacccaagaaagtgagcaaaacaaccaagacgctgaaaccagacggtgcaatcaaaatcgttctactcttcagtgccaaccccgtcaagacagtcaagatcggggcatcactgaacgagaaataggaactcgcgctcatcaccttcctccacgacaatgctgacgtattcgcttggcagccgtccgaca

SEQ ID NO: 54576 - DNA, 703 bp, Oryza sativa
agtgcaaaaaattttatggctggaggtacgtagacagactacataatcatgaaattaaattgcatctagcaattgttaattgcatcctcaccagtaagagtgaacaatcgaaatcgtaatatggtgatttatgattttttttagatgaaatactgcctgacatttgccgagcagtgttgtatggtgatttatgactgaagcagtctaattccacagttagtaaatttaaatgtactgataatgcaatagaaatgtaaaaccaaataaccataaacaacatccagtcattcagtgttcatcagcactgctgtgcttaacattacgttaaattgtgtatgcagaaactgtatacatttctttgtgtcaatatgctttttatcgcgtccaatttgatgcatagtacactttagttttgactgtgctaatccaggtcattgagtaattagtccctaatctatccatctcctacttattcttcctgtgatcattgccaccccaaactctgaggtcctcatcgatgaaaatgaggaatgagcacaggaaggataaggggagccgggaacgagatagatttagagttgataaaatgtacaaggaccatcaataaattaggaaacatagatagattcagagtttggggtgattcatgcagatgcactaacataactcagagaagacaaaaggtaaaacatagatgcagaga

SEQ ID NO: 54577 - DNA, 1408 bp, Oryza sativa
cgccgcgccgtgcgtcgccgccttgcgccgctgtcgccgtcgtgccgccgcaccgacgccttcgtgccgccgcgccatgcgccgtgcgccgtcgtcgcgccgtcgtcgacgccaccgccgtcggtaagccgccgcctcctccccttgctcggtcgccgtcgccgccccgggtagcagggagcctagagagagagaaagggagaagccgaggaagagagaaagaagccgggagggaggagagaaagaaaagaaaaggaaaagagagaaaaagagaaaaagaaatgaacaagaaaggaaagaaaaaaaaggaagggagaaaaaggaaaaggaaataaataggaaattagagggagattaggaagtttagaaaatttaaaataattagaatttaattatagattaattatagtcgtagaattgcaaaatttaatataaattatggattattcttggtaatttctataaggaatcaattcgcggtagtaatttagatgtaattaataactaaacaaatagatgaattcttatagattattatagattatttttgggtaatccctataagtaatcgattcacggtagaaattcggatttaattactagggattttagccgtgtattatatttaatcatttagtcatagactaaattaaatcatataataattctaggatttcgtccgatatttagctcgcgatagaaatctctaacctattatatggatataatgctcgggtagattaagttaaaaacttatgacaacaaaacatttatacccgcaaaatagtttgaatcgaaattgggtttgccttaaaataaaggaatcgactttcgcattcgactttcatttggatttatttggattttatttgaattctaatcgaattcaaattgttctttcgcacataattttagagaccgagggagccacggatccgggtgaaggccaagacccgcaagaccttgagcaaggcaagtcatcactattcttgaacatattgatcccaattgcgaaattgttttgtttacaaataaaattgcatgcaaagatgaacatcctacttgcaattacctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtccccggtcaattaaggaccgagccatgaagttaagcatgaaacgacccccgtacaaccgcacttctcgtatgggtatagacctagtggagtagatagccgagcgaggcagtatccctgcatagatgattcacccctgagtgaggcaggtgcgctacggtgggacagccgttgaggtag

SEQ ID NO: 54578 - DNA, 239 bp, Oryza sativa
ccagtgagaggagttctggcgctcctaggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaatcatctatgcagggatactgcctcgctcggctatctactccactagg

SEQ ID NO: 54579 - DNA, 1501 bp, Oryza sativa
tcggcacggccgccggctgacacacatcttccacctcgaggtaatagaaaaaaccaaacaaacatatttgcagttattctgcacttcattctacatgtatcagaaattcaaaatacttgggtactaatcacttgtcctctggagtcgagtcggtgcagtgtaactacacatttttatcttatgcacataggaatttagcatttgattgaagctttttgctccataaatccatttttttgagatgataaatgatagctgaaatatctgtggtatgtacaggaagggtttaggattggaacttcaggagatagctgaagaggttgccagtctcaagttttgaactagatagctgaatttgtgatattattatacgaggagaatagctcaccaaacaaaacatttggacatttcgctttcttcttactgtctggtcttcaggaaatcttcttcatattacttgtttttagcttctttttttttttacaagtatgacaataattcggtggcagattataaattacaagtgttaatttgatgaattttgttatagggcacacccacttaaccactttaagccctagagtgccccctttataagaactaaagttgatttagtgaagtgtatctttgaccacttgatggattgttagaagtttcagttggcagtactttctgaaagatggagttttgccatcaaacatatatatttcatgatttctgaatctttgtcttttccttgagtagctattgagaatctatatcaagcagatatgctgcaacccacatttgcaactgtaggtaaattgacgtttattttttgccgggttggctgaaggaggtcgaccaaatgttatcaagattgaaagaggaaaagttacaaattgcaaaatgcaaatgagatgcatcactgattcccagtgactccattttatttttcttcctttagataaaccttagaaaattagtatggttttgatatatataatctcctggaactgatatcctgaacttgttatttcttttaacttttttgctcttaatctgaatcgtaatgcgcaagatagttgtgctcatgtctgactcctttgtttgctctttgctcattttaagtggcagttactattacgaattatgagcagatagattatgaagtgttcaacgcatccaattgaagtttattaattgtacatctttaaacaaatatctcaatactgtaataaaaatgatggaatttacacctattgccttattcaggtttggatagagtggaacttaacatgatgcagacatattacttaaaagtcaaagcaagaagccactgcagagtgcagacagagtacttcaaaatcaagctaccaaagctaactcatagctagttagctacactttgaaactaatctccttcacaagaaaaccattagcactatgtagcagattaatcaaactgaaaccctcactccacagcattgctctgcaatcttaaccatggatcaccaagaac

SEQ ID NO: 54580 - DNA, 459 bp, Oryza sativa
attccatcgatttgatccatcgccattgccggtgttggaggcaggtgcttccgcgtggtagacgtcgcatgggcgcccatccgcgccgctcggcttgcggcccacatatgtccggcggcggcggcttcgatggcggtcggcctgtctgctggctcgcacctatgagcctgtgactgacgacggactgcctgctggcacgcacaagcgggcgtctgtgcgtgcgccgacttgcaaattagagaccagatcgagcccctcgccggctgcagctgcctccttgctacctgctcaagctctgaagtctgaagtctgaaggagctcaccattgttgcctgctcaagctctcaagtctgaaggagctagctagcagccatcttcttactggtggagcgagctcgccggcgtgtgcttggctgctgctagctactagctggccagttttcctcttgtccagggaga

SEQ ID NO: 54581 - DNA, 1501 bp, Oryza sativa
  unsure (1)..(1501): unsure at all n locations
ctacatcggtgtcgccattggtaggactgccatgagtgtgtgagagagagaagttaacttgaaccataatttaatatgtgtgtgagacttctctttcctgggagcgccagaactcctctcactgctagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaccaaatctattcgattagcagtgctcgcggttattgtgcaccgggacgtgtattacacttggctagactctaaattcttaacctgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccgtcgttatttaaatacaaacactggtactaaaatttgatcagtcaatgctaggtcttaggtttgtgaaaagaattacataactggcttagcgcaaaagagccatagccatccattgaaatacccctttcatatgcattgttgctgtggtgacttgctgagtacggttggtactcacccttgcaaatataaaattaatcagaagcgggagatgaagcttcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagacaatgcctgcgggcttatgatgtaataattagcactagactctcgtgtatgtgcttttggtatttcagctatgaactcgtgtgtaccagactacttgatccagggaaatggtaatgtttacacgaatgattcctgttataaaaacgggggtccacatgtggtgacctagaaaagatgcagaactgataagtgccctaccattttttatttttttatgctgactggattaccacgtgtgtgccacgttggaccaaaactgctccggagtcgggtggcggagggggggggggcgtgggggtaggggtggnnnnnnnnnatcnnnncannntgcngnnnggccgggcaaacatcccattaatggactacgtatagaaagctttagtaggataagaaaacattgacagcacattaggtggtgttcttttcttgtgaagatgaagataaaaattatgtttttttttacataaaatgaggtgatattaacgcataattgattgagttttaattattaaaaacttgaaaaatagattaatatgatattttagagcaactttcatatagaaagttttcacacaaaacgcaccgtttag

SEQ ID NO: 54582 - DNA, 1501 bp, Oryza sativa
gtttacttttattatagtgttttgaaagacaaatctatatatgtttttctaaactaaatatttttaaagttattgatggttaaagttataaaagtttaacctcaaccttgtccaaaacgtcaattaatataggaccagagggagtagttttttatctatatttaatactccatgtatgtgtataaacatttaatgtgatagggtgaaaagttctttgagagagtgaaatgtgcgtgttctagccgccgatgtaaatgtggagaccaagagtcaaaactgtaaacaaacagttggagcaactccagtcagcaaagccgcaggagctgaaggatgatgaccgagagagaggctcagaggccgcgaggaaaaagctgacaggaacccacttgggaaggctggcaagaaccgaacgcgacgcagcgcggcgaagtcagcagcttccctccctgctctgctctgcgaccgcggccggtcggaccgacggaagctcgcccgtcgtcgtcggcgagctgtaactaatcgcagtttcttcagagttttctgaatgatgcttatgatacatgtttggaccacctccactgcgtgatgaggaccatgatgacactgcgtgacagccaccgttattagcacgtcaacgactgactgtaagtactacctatgtactgtactactagaaaaaacgtggagattattagggttggttcaaaaatcacaaggaagttgcttgtactctcctggtcctggcgtcctgccgtccttggcgtggagagagacatggcagtacgggtacggcactactcacatcgctagtttcaatttgggccagatctcttcccctgcatcactactacgtcgtccagtgtagtttgggccgtttgtatttggcccattacccccaagccacaacctgaaaagaggcagcaattctcagcgggaatgtctgtgtgtgcgtgtggagtgcgagctccattagcacaagatgccaatcccgtcgcctcatcacgccatggcggcgagcccagctctcgcaccaacccgcacggtgccggtactgccgccgcgcgggccgtctcgccaccggaacgccgcggcaccgccgtgtcggcctgcgacggcgcggatcggcgcgtctccaggcgacggcgcggccgcggcagcagcggctgcggtggagcagggcagtcggagcgaggagaaggataggaagcgatgcctgcggtgcgggagcctgtatctcgacgaggacaactcccccaccgactgcgccttccacggccacgtcacaggtagccaacctcgcgataaatatcttcttctttctccggttcgtggctatcttgggctagtgtagtgtgaagtgtgtcgacattttggatagacgcccacaacattttaacacttataagcatcttcaaatgattagatcgacgtattttgaaattaacgaaatgaccttatataaatatacattatatagcactgaaataataattagctgtaa

SEQ ID NO: 54583 - DNA, 1501 bp, Oryza sativa
aaaaggtttgatgtataatcatggtgttgtgcagacgccaaattcaaatagggatcagacagtggataacaaactgtaccctgagcaccgacaccactcatggtttccaaaccaagaacttagcaatgccaattagcccaactacaaaagggatcttggttgttcaagaaatggatttgttcgtcacaaatgtgttaacgtaacttcagtactgacataacagacagatggtgaaatggttattaaaacctaagtagagcactgtaaataatgacattcacaactgccaatgatcaaactaaggacatagaacatcatgccgccttagcagtttcaacatataaccttaagcagcaaacaacagaaacaagcaggcaggcatgacttgttaaacaattacaaacctagatatatcattggagcaaagagaactaattcctacaaccatggcaacatgagtacataacacatgcaaagatcaggactaattaggttatattgcatcatatcagtattagaagaccaggaaatctccaatctatagggagaagaaacgggatcgtatcattcacctggttgatgagggctgctgagcgagagacgagctcgatgtcgttgccgtcgaggacgagctcgtccttcaccttctccgaccgcaagatggtcaccccctcgagcatgtcaaccttcctcacctgaaacacaaagcatacagaaagacgcatcagatttgagagatctgtgggggagatctaggatgatccacgaacagcgggcaaatggaagtgatccaaaggtgggtttcttaccttcttctcgcccaagaagttcctgatctcgatggcggtgttggagttggtgatggaggcgttgatggggaagtgagcgtagacgaagcgcatcttgtagcggtagcccttggtgacgccggtgatgaggttctggacgtgggagatggcggtgcggatggcggccatggtgcggcgggtgccgaaccacgcgtccacctgcagcttgcggccgccctccagcagctggaagtcgaggttgaggtgcttgaagttgcgggtcagcttcccgcgggggccctccaccgtcaccaccttcgcggcgacctgcaccgtcaccccctccgggatctccatcgtctcggacgccaggatggtcttcatcttcgccggcttcctcttgccccttcctcggcggcggcggcggggtagaggggagggtttgggtgcttgctcgagagaagggcggcggcgcggggaggagtgggcttttaatatagtcgacgatggcgcaggttagggttttgatcttcgccgttggatcgagacattaggtcgcgaggtgatgactcactgggctgctggccttaggccggccccaattcatgaattcttaggcccactaagaagtatgtcaaaatttggcccatctgtagatgcgctgggctgcaggtctggtagctttgcagtccaagcaaattgagcccaaaata

SEQ ID NO: 54584 - DNA, 1501 bp, Oryza sativa
aattgtagaaatacaaaagtcgtatccaaaattatgtttcgttgccgctattaggcgaatccaataaacgtaaccctatatattctgaaaatatctttaaatatactacctctgtttcaaattgcaagttattttaacttttttaagtcaattaaatttatagaaaatttacctctgttttaaattacaagttattttaacttttttaagtcaatcctctttagatttgattaaatttatagaaaattatagcaatgttttcaaccaaaaaaaaaactatcagaagctagacgtaatgaaataaatttagtgctatacgtattgttatatattttacaatcttgataaaaaataaatgacctagcacttcccaactcacttatttctattgtgcgcgcatgctttttaaattgctaaacgatactttttttttgcaaaataaatccttataagaaagttgctttaaaaatatattgatatttttttaaaaaataactaatatataattaattatgtgctaattaaccgttccattttccgtggtgcacagcccttataatataaaagagggagtacataataaaaatttaaaaaagactcgttatttggagaaaaaaaatggttgagatgccgtggaaagcggcaggtaggctgaccgcgtgcggtgaaccgactcgagtcgagagagggtgcctcgaaatgcacgttgatataaacagcccgcagcgaaaccaccccaaaaaaccaaaaacccaccacccccacgcggtgccactgccaccgcccctcgccgctgacgaccgccgccgccgccgccgcacggacattccgcacacgcccgcggggggcgggcggcgccgcgtcgctgatccaacgcgagcacgttcgtcgtccatccatcctcccgctcggatttggagtcggcaaccgctcgggctcgcgtcgcggcaactgaagcggcgaaattgcaacaggcacaggcaggtgaggtgaggagcattctgatatattattatttttttttgcccccaccacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatt

SEQ ID NO: 54585 - DNA, 1501 bp, Oryza sativa
attttttgaggcgaataaaatccaccgcgcgcccaccgcctagtccatcctcgtccttatcccttctcgcagtctctcttcctctctcccttctcgcggtctttctccgcctctctcccttctccgtctctcctccctcccttctccaccgccgctagctcgtcgccaccccaccaacgccggctgccgtcgcctcagctccaccgccgcatatcgataaccgctagcgaagatcgatatttccctggccttttctttgtggcggctgcaatttccgctaggaaaaacctaaaatagccgccacaaaagatgattttcgtagcagtggagtgttgggaacttgctcttgcaaacacacggagtttctataagaaattgatctgtgttgtatatatatatttttaaagtggccaggggtttgtagtttagtttcgattatccccaaggataaagataaattagcgacaatgaatctaaatcaacatcccagcgccatttgtcactaaaaaactatgaggaaatggtttaattagaataaaaatccttggccaagaaataaatctaatagtattgccacactcaggaaaaattataaatctaatagtgaaaagcaaggcctcacatggaaattacaccgccagacaggccgaacactactacacagaaggttttctcgtgcggtcgaacggattttcgcgtgcggagcttcggcccgtctcgagcagttcgtctataaaaatcgttatttgtgcgtgcgggcggcgcaactgcacggaaaaataaaaaatcaaaataaaatcgaaaaaacgaaaccctaaccctagccgttgccgccttcccgtcatcgtcgccgtcgtcttcccgtagttgccgtcgccttcttgttgtcatcgctgttgtcggagggctgccgcccccatcacgccgccggatccgcgcggggggtggccgccgccgccggatccacgcagggggcggccgccgccgccttcgcgacgccagatccgcgcaaggcctccgccgccggatccgcgcggggggcggctgccatcgcctacgcccgccgcacgccgtcgtcgccttcgccgcgggctgccgccgtcgccgtcgacgcaggccgccgccctcgcctacacccgccgccatcaccgtcatcgtcgccttcgccgcgggcagccgccgtcgccgtcgccacaggccgccgccctacatccgtcacgtgaggagaggagagaggagtgaggagaggattggaagggcacgcatgaggagaggataggagaaagagcactgagagaataaaggagaggaatgggaccgaggcgtggaaaaaggaaaattttgaagtgggtaggagggaaagaagggatgattatttttccgtgcagctctcttaataggcccgcacggaaaaattggtttatttttctgtgtggttcatttaggaggaccacacgggaaaatcgattttcccgtgcgggtgatagcccgacacccggtc

SEQ ID NO: 54586 - DNA, 1501 bp, Oryza sativa; identical to SEQ ID NO: 30080

SEQ ID NO: 54587 - DNA, 324 bp, Oryza sativa
tgacatgtgggcccacatttcttttcatgtgaataactaatgggtcccacgcgtatcccttctttctatatagttaagaccgaaagctgatttctggttgagccacgtcacctgttaaatcttagtcattcgatgtaatctggacgctcgcagctgccaccgccagatgcagtcgcttctcctcccttctccttcaccccggcccgcgctcgcttctccgccccgcacgcgctcgcggtcgcttctcctccgtcccctgcgagatgcgcggcgggcccgccgcggatgcggtcgattccccttccctttgcgctttcttaggat

SEQ ID NO: 54588 - DNA, 1501 bp, Oryza sativa
catatccacctaccaatattacttttctattaacgaggaaaactttgatttttttagctactatctaattttgagcacccaaaactatgagtaaaattactctgggtgtttggtgtgactagatggcaatcaacagctacagtagcaacatacaatttctaccataaccgcagcagcagccgccctacacagcagttatagttggcctgccgaacataccctctgtactagtgactctaataacagattgccagtcatgccatgtatcataatcctctgacgtaatatcgccatgacattgtgactcattaacatactatggacttacgggtggatggctctatcattgatcacatcgatcacatcatgtagttatgtcggagaggaaccttttgttagtcagacgtggttttttctctcaaaaaaaatatattttctctcaaaaaaaggttagacgtggttttcacttgtctatgcgggattaagatttgattactttaacaagtgaaacggagatgtaagacaatttttcttgttcagtttcattgatcaatatttgaactcgataccttttagttaactcggatagttgcacgttcgcgaagaaagttaactcggatagcatattaagttgtacctatgagtacactcagtaatttaaaagattaaaatgacactatagaaagaccgtaaaatttactttaatttgtactatttcattgacgcatcaatctcttgaggtcatagcttagcactatccatggttgatctagtatctggacgtaaaagagtgatttgattcaggttccccccgcccaatagcgccccttaattaaccaacatattagctcaatactcaaatactatctctgtttcgaaatgtttgacgctgttgaatttttagtacatgtttgaccgttcgtattattcaaaaaatttaagtagttattaattcttttcctatcatttgattcattgttaaatatatttttatgtaggcatataattttacatatttcataaaagtttttaataagacgaacggtcaaacatgtgctaaaaagttaacggtgtcaaacattttgaaacggatggaatatttggttgtcgtctatgctgtttaatgtaaaatgttcgctttgctacgtacgttggttagtccacgcatgtttcattcaacgggtcatggatttaatcccaatcccgtgcacctagctagctatagtattttttttttccaaaaataaaaaaacctgtacatatctcttgaataatattgtgtctcacatcggttattttccacctatgaaaaacattttacaattgatcaatgtaagagcaagtttaataatatagctaacaactagctccaaaaattaaaatatcaccaatagccaacctgttagctcgctcatacaatagttagatgtagatatatattgtatcattaatacataatccttccatctctctcacatagtttattaaagttcgtgctata

SEQ ID NO: 54589 - DNA, 1501 bp, Oryza sativa
ccatgtgtcttacagtagcacgtgtgggcccccggctttacacaccagaaaccccatgtgtcttacagtaccatttcctaaatcagtagatggtacacacatggcacgcttgaatatctcaagctgacatcattatacaggttgaactgtacattaataatagaagggtagcctaaataggacccaaatagaccgagcatggtcataaacaataccaaatatccaaagaagtagatgagctaacggaagcgaagcagcggcggtccaacatactccacaggcatcgactggtgcacctaggtcccggctccacggtcttcgacatctcttcatcagctagttcccgaatggtcgactccaacttctttctaaaagatttagttaagcaagggtgagtaccaaccgtactcagcaagccaccactacagaatgtatttagtgcacacagggggttaaaggatggcttggtttatttgcaaaaagttagatttcacaaatcagttcacaaacctaagacctagcagttttaaatgaaaaacaacgttaagttgaagttgtcattaatccgcgaggattcatccacattcccaaagcctcgcttggtccggtttaccctcacatccagttttccacattcccaacatcacaatgaccttccctgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcttacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgaccttttcccttgtgtttttctaaaattagttgaggggaaatattcctcttatcctcctctatctttacccccaaaaatcggagcaaatcgttgagtattttatccgaatcgaactcgttttcgagtttatctccaaaaccgagtttttgatttcccggatcgatttc

SEQ ID NO: 54590 - DNA, 1501 bp, Oryza sativa
ttcgtctcgtcgtcctctacgtgtacatgtcctccaaagtcgcagccgaccatccaatctccggcgaggtcgccatcttggtccggccattgatgaggtcctcatgatgtcatcatcgtttttctttttcctgttgttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattagagtgcgccagactgagaagtggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaacaatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaa

SEQ ID NO: 54591 - DNA, 285 bp, Oryza sativa
ccccccccccccccccccccttcccgcgcgacgccaacgaggccaataccggaaataacacgcgcccgcgcggcaggcggggcaggtcgctgcccccacccccacacacgctgcgcctccgcgtccataaaaagcccccccgcctcgccgccattcccgatcaaatcctctcctcgatctctcctgcaatcctcatcacacagcaaacccaaaccgcgagcggaatcctcagcctgctgagagagcctgagaccaagagggggattcttttttggttattgacga

SEQ ID NO: 54592 - DNA, 252 bp, Oryza sativa
gcatgttggtctcgcaggtcgatcaaccttggtaaaagtcgtccttacgtcccaaccaatcttcttgctgacgggcttgaaagcatctaaggaatcccttgaaattctggacaaacaacgaaggcaatttctgtgggttgggaatgaaaccgtcactgggggaagtgcaaggtaaattggacgcgtacctgcctacctactgcctcgagagggcttggcatcctaaatctcaagaaatttgcaagggccctc

SEQ ID NO: 54593 - DNA, 1501 bp, Oryza sativa
  unsure (1)..(1501): unsure at all n locations
acaaaagttactctaaaatatcaaattaattatttttttaataattaaaacttaattaatcatacattaatactatcttattttacgtaaaatacttaattatctcatccaacgatgccaaccaatgcgtcccggaaaaaggagatcacgggaaggaaaacgttacatcattgcatggagacaccatcgacatcgagtcgccgtctcgtgtcggccatcgatgaacttttttttcgaacctttttattttttaaaatttaaaaatgaactcttacaaaatttaattttaaaactagaccttttaatggtactggctggtctgatgtggcgaaataatattgtcaagtcaaatgaggatgaacatgatagtttatgatagtttagtttcgttatgccagccggggtggcgtggttaaaagttttaaattttaaaaataagttttgggatgtttatttaaaatttaaacacaaaaaaggttaataataaaaaaaatggccatcctattcatcaattcatgccctgtgaccttgttctcgtcaacccatcggcagcacaccaccaccagctaactcacgatttaattcaacatcatggaatatagttcaattgcatcaaatcatatcttctgctatctagtagctgtgtgaattgaagaagggaaggctgcaaggaaaggaaagcatgatgctcgcgttttatatccgcacgttttctaaactgctagtatgtattcttaaaaaaaagttattttaaaaattatattaatttattttttaaatttaaaataattaataattaattaattatgtgtttgtgacttgttttgttttgcgcatattttcagtcctctctaatactcttctctctaacacaacctgctgtgagattgcccctaaattatatatggttctgcagatggcgggtaggtagggatgacagagggggaaattagttgtactaccttgtaagtatgattaggattctccgacaacgagtgatcaaattaacaggaattaacagttggatcgtgtggcaaggagggcaagcacgtgttctttgctccaacaaaaagttggactccaaccaaaagttggataaagattaagatttttatggcacgcttttcaaactgctaaacggtgcgttttgtgtgaaaactttctatatgaaagttgctctaaaatatcatattaatctatttttcaagtttttaataattaaaactcaatcaattatgcgttaatatcacctcattttatgtaaaaaaaaacataatttttatcttcatcttcacaagaaaagaacaccacctaatgtgctgtcaatgttttcttatcctactaaagctttctatacgtagtccattaatgggatgtttgcccggccnnncngcannntgnnnngatnnnnnnnnnccacccctacccccacgccccccccccctccgccacccgactccggagcagttttggtccaacgtggcacacacgtggtaatcca

SEQ ID NO: 54594 - DNA, 1501 bp, Oryza sativa
ctctcaggaagtggctccatcagcataaaaatcatcatgcaatatcccatcccacacaggttaagaatttagagtctagccaagtgtaatacacgtcccggtgcacaataaccgcgagcactgctaatcgaatagatttggtttactcacactgcagtggatgtacactttacccgcactccgcgactgcccaacacatgagcctcgtcccaacacatgagacgcgccacggcaaagccttttgataacctcgcattggcagtacccgctccatgaacttaaatcctcatgcactctaggcgtccatgtttctagcagtgagaggagttctggcgctcccaggaaagagaagtctcacacacatattaaattatggttcaagttaacttctctctctcacacactcatggcagtcctaccaatggcgacaccgatgtagggcacgcctctcggccctacctcaacggctgtcccaccgtagcgcacctgcctcactcaggggtgaaccatctatgcagtgatactgcctccgctcggctatctactccaataggtctatactcatacgagaagtgcggttgtacgggggtcgtttcatgcttaacttcatggctcggtccttaattgaccggggacgatactagccttttccagataccacccaaatcctccgtctgccccagtcgaaaacagttatttagtttatttctcctttcacaaatcatgtcctcaatatcatggcaatgtggcgctcatgtctccacatgccgcatctcaattaccttcccaaaggtaattgcccaagcatatagcatttgacaaatattagtatgcttgattctagaatagcatttctaagcatttgtcatagttgactagggactcatacgtaaacatggttatgaaggaataaggggtaaacaataatcaaggcatggcataatcgcaagtaggatgttcatctttgcatgcaattttatttgtaaacaaaaacaatttcgcaattgggatcaatatgttcaagaatagtgatgacttgccttgctcaaggtcttccgggtcttggccttcacccggatccgcggctccctcggtctctaaaattatgtgcgaaagaacaatttgaattcaattagaattcaaataaaatccaaataaatccaaatgaaagtcgaatgcgaaagtcaattcctttattttaactttattattcgcgaactaaggcaaacccaatttcgattcaaactattttgcgggtataaatattttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataa

SEQ ID NO: 54595 - DNA, 1501 bp, Oryza sativa
gtaggccaacatgcagctggagcaagactgtaagaggcggcatcccggtcgggtggcctgagatggatcagatggcgtcgcataggcactgtattgccgatgatggcgccggcgggctagggtgcacggtggtggcaacgaattgcattcagcggagcgatggttgctgggagaaagtcggggagaggagaagcgctatttcagggtggtgcagtgtgggaggttggtaacgatcgctatttttgtttttaatcggtggttacatgttgcggagcaggagattgctaattgtagggacggatttaactcgccacataagccattggatgaaaatatctaatggttaaaagagaattatgtacaatttagtggataaaactattacattttatatcagtatatctctactatattatacaaattgaagatgtttccgctggaattttgatacgtcattcgtgttggtttttcagtttgttgtacatcgtctatacacaattcgacgtaagtatagaataactattatacactctcctcctatctcaaccactcctcctcccagcccaccccaactggcccacaccattctatcagcccatcctgcgtgcctccactcagagccgcaggtgccactccccgtatcagtgtcttttttctttcctttttttcgttttcttttctcttgatcatcctgatcctctccctatccttccaatctcctctcttttctctccatgttctcttctttcctcttagttatctctttcaaatttctgttatcataaaaatttttgttttgatattatcaatatttaaggtatatgtggcaagtttgtaactttagaaatgtttttcatctatattaaaaaaaactttcactgattgaataatcaaaatttcaatctttggtcaatgaggtatagagaaatacgcatgcgtcaacttatggaatagccacccaacgatttgtgaggctatggaaatgtgtacaaaagagattctttgtgtgatgcatgaagcgagcgcaactaggttcaatgctatgtatgattcctgattttgttttgtttgtcttatttcggtttgtcgtttaaattagtggagtttttatcaatcatgaaaattatcttcacttgttgcagtattttttgctagtatacatatagatataaaattgattctttggtgcaaggttttgtgccaagcatgaaacgctatgattcgctttgtctcttaactctgaacgcgcaatacatttagcttgtagtaatatatgcttcttttattttactttcacactatctgaactcttagaaaaaaataattatgatacgattgtgtcaggtcaaatactcaaatgtgcaccagatgttcagtcttttacatacaagacatgcgtgctcatgacacacgaacacaaccgatgatttctatgatagtaattatatatagaaagctgctatatattcaaacgtacacaacttggagtctaggacaaaga

SEQ ID NO: 54596 - DNA, 1501 bp, Oryza sativa
ggtgcatgttcacactgagaagacatcggactttaattgtgcttttctcattccgggaattgtacaggaccatatccttttggacagaaatatgtatcagtttttgatatcttttaggtttcatgatatctaaacggtatcaggtgatacctcttaagtattacttgatacttggtagaaatcgtgtggtccctgattggaatcatccgatacctgatgagtatcaccgtttggacagaaatatgtatcaggtaatcctgataccagtttctgatacctgataagtatcaccgtttggacggaaatatgtatcacgtcctgatacctaaccggtatcaggtgatacctatcaggtatcgggtgatacctcgcaagtattatatgatacctggtagaaatcgtgtgatacctgattggaatcgtctgatacctgataagtatcaccgtttggatagaaacatgtatcaggtcttgatatctttcaggtatcatgtcctgatacctaaccggtatcaggtgatacctatcaggtggtacctcgcaagtattaactgatacctggtgaaaatcgcgtgaaatctgattggaatcgtctgatacctgataagtatcaccggtgatatctcccaagtatcatatgatacctattagaaatcgtcttatccttagtactagtagaatatcgtggtaataaaatagttgatgatgcactacacatgcatgttctgacctacaaactcaaggagaagcgctagatgcatgtggggccaatcattaattcctacatgcagatttttgtgagagccatgcatattggtacgtcaggctagccgagtccatctttgatccttatccatatcttgctcggggaggtggaggtgttatttaattatcccattcagacggaatgccgtgcactagtctccctcttaatataagctataagctcgtagttggctctattatattaaacttgctctaatccgtcgactccatcaagaactctgctgtcaccatacgccagaggcaggatgtcatccgcgcccagttcgaggccaagggctacgtccacgtcctggccgaggccgacgacgactctgacaccgaccaggagatgcatccgctgtaattaaacaaacttcactttacctctaattcactactagtatattactgtagtctgtagactctcttgacgatgctgcttacataatgtctcgtcgatctgcatgtacatttgactggattactgaatttaacttgttgagtgcagtagtactcaaaattaaaaaagttactaggcctggtttaggtagctattgaaaggtgacgagctaaagcagcggcgactactatcatctttgctttcatgatgctcttctcttctttcctttctttttttccccatccatgacaaagtgcggccatctcaaatcctggaataaaacatatcctggaaatcatggaaacaatgcttttattcttttaagttgttgtgttg

SEQ ID NO: 54597 - DNA, 415 bp, Oryza sativa
aatccgatcccccctttattttcttttccaagggaattaataattccttttcctttagacagaaaaccaaataatccttagaaaatccatatcttctcaaccgctcctccgattgactccgttccacttccaataattccgtaaaattgagatctatctaatggcactattaattagtctaaatagggtttttcttttggtatttttttaggttttcgattgtttgcgtatagtcgcggttaccggattttcgtcgatcatggttttcttgaagattcgtgaagctttgtgaagaccttgagcaaggcaagtcaccctttgacaaattgctcctataattggaaaatcattattattttgtttgcaacttgcattattagaatcacacacttaacttgcttggcctcggtttgcg

SEQ ID NO: 54598 - DNA, 992 bp, Oryza sativa
ggttttcgctcggggtgtatgggttaggtgagcacagtggggctcacctaaccacatttattgcggtttggctgagcgtgtcacgccgcatgtaacgcagtgcagtgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctgatcagatatatgccaggctttatcctaaccattacaagcaagatattgtgtgaagaagggcgaacatgtagattgctaagctgacatgtggtggacaagaatgaccgacgtgactggtctgactccggtcatgtcgtcagcaggcggccacgattccacgtcgcatctgctcccggcgaaagtggaggtagttgtgggccgtcccatcagaaggtgactcggacgacaacgatacaaatctccgtccatttatgaaaaggtgggggaagtccccacaaaaaagagggaaatggtgcatgtggtatccccttaagatataaaaggaggaccttgcccacttagatgggaggtttttttggactggacttttccagattaggaacccagaacaagggagaggctggctcatactttgtagctccttcacacacgaatccaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccgatgaggagccccacgctccgtcatctggcgcgccaggtaggggactctgcgagtgatcttctgagctctcgcactccttcgtgtgcgccaagcttttcctgttcagcccaa

SEQ ID NO: 54599 - DNA, 1501 bp, Oryza sativa
gctagcagcattatttgttgatgtatgcaagcgtcgcattcgtatcacaaatttcgcatggaatcttgaattcttgatgcattatactccctccgttttaaaatgtttgatgccgttgaccttttatcatatatttgatcgttcatcttattcacaaaatttaagtaattattaattcttttcctatcatttgattcattgttaaatatatttttatgtagacatataattttacatatctcacaaaagtttttgaataagacgaacggtcaaacatgtgttaaaaagccaacggtgtcaaaacatttcgaaacggagggagtatattgttgcttgtcaagcatatatgcatgcattgatatgcataccctccgatatggatactctcgtgatcaagtcgtttgtttcgtagcaactagcaactccagtttgtatgtttggtctgatatatatgatcgtacatgtatgctgattgctggatctgatcccatttgcccctttcaagccttttccatgtactgtaccagtactgtacccccagcctggctgtttccaccccttgatcgtttcctatccacaattccacacaccaatcgcctggcttgaatattatgcattttcatcgactctggttgctgctcccccaaaactagttactagctactcctatatactctctcatgtttttacttaagctttgtatttgattgctatacatataccttttccgctggtgtttcccccttgtttggttggtgccatgttctagcaaagctttttgatgaatttgtttaaaaaatatgctacataccttttccaattatgttataatgaaacataaaaatgcaatgatctaaaaataatagttccaatgataaatcttctaatatcattttcatgtgatgaagatttagttttactgtatgtaaaatgtccacgcatgttttaattaaaaaaatacgggaaacgagaaaaaattattagcatatgattaattaagtattaattattataaatttaaaaaataaatttatatggttttttaaaacagcttctctatagaaaatttttataataaacatatcatttaataaattaaaaaacatgttaacagaaaacgagaaaattgaagttcatattcagctatagtaatccacagtagcgcatctcatagacgtccaccccgtcgtggcccttttcctctccggcctcttaatctcccactcccttcatctcttaatatgaacttcaccttgaactgattctgtcgctaggctatccacctctctcccctccttccctactccctattcttatatgaaaaagacattacccccatccttttcaacgtacgtaaaaaagttacctataattaaaattatatatagtaaatattaaatattttctttgatgattgttataagtggcaagtaaaaaaaaaccttttttttaagaacagagttcctgatgctaaggccatgtacaacgcgtgaccctagct

SEQ ID NO: 54600 - DNA, 1501 bp, Oryza sativa
gggatcatattttgaatttcgtggaaccaggccctgattgatccacaatcgactaccaagacatccaaggaattctctagccgatttgatatttccataagagttctcttaacatcatcggctagaggagctaaggctttgcttgaggtgtcttcttcttcttcatcccagaattgtcttatgtcaaaagagaacatatcggctaaaacctgcaagaaagaaaaatgcagattcggttaaagtgttcgaatgtttaaacagccgatataagatcaagataagtacttacagggacagcaggagttggagctgctgcatcttctacatgatgacttcctacagccgatggggtgtgttcacttgattcaggctgaacaggagttggagaatgaggaggctaaaaagaaaagtgttattaggaatcggcttatatgaataaaaaggaaatgagaaaatataagttaccgatggaggcagtattggtttctttctggcagccgatttcttcttctgcagagacaagtgttatgatgaaattgggatatgaaattcttgcaagcatcaagttttgattagaatacttaccctgggatgccgagctagttgaggtggtgccggaggaattctttgtggagctggggtatcggcaggaggtgtttgttctctagtgtcactgacttcggcagcagctgcatcaatgtcttcttccatggcttcatcatccagaaatttgtcgacatctggatcaacagttggtagatcatcggttgctaaagttttttgcttatttgttttcttcttcttggtagccgatggatctacaaccgatggcttggttcttttcttctttccggtatccattgggataggctctctcatctgtccttgaagcaaacttgttgtcttggggggcatggaagccgatgacaggaggagccagtccaccaccattaggaagaaggcctgcagcataattgatctccaaaccactttcactatgatgaggaggtgaagattctgtggtctgcaatcaaagaaataaattggataaatttttatatcagcagatagttaaggaaattgataaaagtagaaattcttacttgagggataacatcagggaatatgttagtgagatacatggaaaccgattgatgaaataaatgtttcttccattcaacccaccatcggtcaaatgttgtgctcctgagcaaagctagctcaatattatcaatacttccaaggggaggtccttggatgcttagcagccgatccatcattaatgccaatgtaatttcccctctatgctggatcttgtcggcaaaatacaaaccaattggcagctgtcccaatccaagttgtctggcagcactcatggggtgatagaattcgtaagaaacttggatgtttctaccctgatgtatgccaactgagagtatgcaagggctgatagcagtagtgaaaacttctctagacttatcaaacttctcagaattaatgt

SEQ ID NO: 54601 - DNA, 1501 bp, Oryza sativa; identical to SEQ ID NO: 30083

SEQ ID NO: 54602 - DNA, 1501 bp, Oryza sativa; identical to SEQ ID NO: 54583

SEQ ID NO: 54603 - DNA, 1501 bp, Oryza sativa
taggatccctcattccatatatattcatattctaggtgcttcatacatcctgaatttagttaattttattcattttttaaccgattcagaaaacatcttttttccattattacaatatttcggaaattaatgtaagaactcgtaaagttgcacgtttgtagtttggtcaagaccggtgatgatgttcttagttgtcttttgacacaagctattgctcatctttaaatagcagcatcaataatccgtgaattgtggccccggacaaaacaaattgacctataacaaaatgctaataatgtgtatatataaggaacaacagtaccgggccgaaagaaagaaaacccatctggacaagatttctccatcaaaattttataaaccaaacacataataatagtacatgtaccatcactagcttgtaactatgggcacacacaataaatgggttttcgttaatttcaaataaggacatatggaaaaatgaatcgatcaatggaaatttgactacaaatctttttttcccataaaaagaacatttcttataatatatctggcgagctggtgagaatatagagaagtatatataatcccctagcttatagcactaattaattcctggatttttagctttactaagtgtcacaatcttgagtaaacatttggattgtttggggagctagccgagattctcggagtatctatggctgctagaagccccctaaagagggcatatatttcttatctatattttgattctattcatgaaccttttaatgaatatataaaatacaaaatttaagtgataaagtcacaaggtattgattggccagtgaaattcgagcccagtgagacatcgatttttcgccaatctagaaaaatcgacacatttcgaatgaatttccataaactccaaacatgataactcgagatgatccaaattcccgaaatccgatcaaaattcatcgagcttgtgaagccttactctgcagaaagaacatgtccctccttacgagaaagaaaaaaaaaccaagaggggaagcaccactggtgcggtgctgaagtagaaaatctggtgttgaagtcgtatgcacatgatttcacccaccagggtttaaatcgtgatgtccaagaaaactatgcacatgcagttgggcttccaacaagtttttactgagatcagagatgcgctgttggtttccgactcttggagagtgtataatggtgtgcgcgcgcgtgcgtccatcttagtaatccgaaaaaacaagagttatctcccggtacatcgtacgtacgtaccacgtcctccatgcacacattagctaattaacctccacagtaaatagtaaatatactcattcccaatccccttcgggggccttccctctcacactcacacgccctataataacccctcgccaactaccacgcccacgccaccacacacgcacacgagctgtgtcgatctctccatagcaagaggcgcaagctaccttgccagcca

SEQ ID NO: 54604 - DNA, 1501 bp, Oryza sativa
tcggtatatcactcggatcatgttattcagggattcacaccgcatatgctacatattaatatcaagtcgcttggttgactataattatcgaagccactcggttggttggattatttattacttgactatatgcttggtttgttcaattaaccacatagtcgagggctacacctattaggtgcatctagtcgatgcacctgactttatttttcagcccttaacagtcttcagatttggtaaaagtactcgggagaccatggcaaagatgattgaagcactcggctttggagtaatctagttcgagagaagattatcttttcgattgtgaaggtctcaggggctactgtggagattatgggtaccccatacccacacggcatggttatccgactagttataggggataacttatatatatggaatatgtaacagattatgacttgggtattacgtttccttgtatattacggaacggcctaaagtcctggtttgataagattgtaaagtagatttaggaaaccgataccgtattggataaggtttctatcttgtaatcctgccccccatcctatataaggtgagcaggaggccctctagggggcatgagacaactagatcgtcagatctataattcacccagcggattcaaatccccaaatagaagtagggtattacctctcattgagagggcctgaacctgtctaaatcctttgtctctgcatccatccacttttaagtctcgtacgctacccccttttattattgccgaattcatgtttcgacacatagttgagtatagatcgtagttacaatgtagttagagcgtagtttcaatgcatttatactatagttataatacaattgtaaactctgcatttctttcaatggatacggggaactcatgttcttctagtataaaaaaaagtagttacaatacagttagaatataactacactttaattatactatagttatatttaaaaatattttatataatcaaaaaacttgcggcaactttttaatacttgctcagataattgtgtcttctccttcttcgtctcgcttgtcaaaacaagatttcgacaatataaaggggtagtgcatgagacctaaaagtggatggatgcggagataaggatttagacaggttcaggccctctcaatgagaggtaataccctactcctgtttagggatttgaatccgccaggtgtagtattgatctgatgatcagttgtgaatcatcttgccctagagggcctcctgcccgtcttatatagaatggggggtaggattacaagataaaaaatgtaaccaatatggtatcggtttcctaaatctattaccaaaccaaaactttaggccgttccgtaatatacaagaaaacgtaatactcaagtcatgatccgttacatatttcatagatataagttatcccctaaaattagtaggataaccatgtcgtgtggatatggggtacccataatctccacatcgctgaa

SEQ ID NO: 54605 - DNA, 1501 bp, Oryza sativa
ttgatgttctttctactgtgaatacaagttaatagtttcatgatttaaaaatgagcatatatatggttgaggaaagaaaaaactaactacatttagcaaggtatgtggttcacactttatagatgaatactttttattgcgtgatgggaaataagtactcatgctttataccttattcagaaccgagagaaatcaagcctgaatgccactgacttggtttgttaccaaatctagaagaacaactttgattaaagaccaggttggcgtaatctcaggtgaactgaccatggagggctgaaagcagtgatcaatagtttaaacacattttctgcaatggtaaagcaaacattaagaggaagaatgctgaaagggaaggaagacagtgataacttgaaaggcactatctccaactggtccagttccttatattaattcatactactccaggttatggactgaatctgaatcttccaaggaaaaatcatcaatggagacatagtattactgcatttcttcttggacttggccaggagcattcttttcagcatgttcttcttggacttggccaggagcattcttttcagcatgttgttcccctaaattctgaagaagtacgttattctcatgctgcatattattcttttcagcatgttgttcccctaaattcaagaagtacattattctcatgctgcatatttggtatctccatatgcaaatcctcaatttgctaccacaaaatgggtaaatcctcatccataggaagaacatcagtgaactcccaattaagcacagaagtgtgcagagtccatgactctccattacctcccatattaacaggattttccataacaattcttctaggcacttcactagggtctgtataaagacattttgccagaactctgccaagaatactatctctttgatgccaatggattaacttcccagaactctgccaagaacactattttgtgatgccaatgtataaacttcccaaaagcgtttacaatcctatgaatgtgagtctcatttatgtaatccgaaggaatccctaaaatcattatccaactctcctgattgaagggacagtttctccgataggctaaattatcaggtcttataaagtgtgcttggaaagcccctttatttagcatcaaatgctggccggctatcaaagtatccctgtgcaattcagaaggaacttagatcagacataaaaagtggaaacctgagggcgcagaggacatgcatgttgaactgattgttgatggcgtgcaccacttgatggatcagttgcaacattttatatatgtaacaagatccacctcaaccgtaattctgaatagacttaatgtttgttatacaatgtataatttccaactaaacaatttaaataccattattgtgagtaactaaacatcaattttacaccaggtgggactagggccccagtcaattttataccgagcgggatagggggtcttagcgcccagttacatcg

SEQ ID NO: 54606 - DNA, 1501 bp, Oryza sativa
ccggaggccgagcctgccaaggaggaggtggcgccagagcccgccgccgccgccgaggcggaggccaaggaggccgagccggcggcgcaggtggccgaggaggtgaaggaggaggaggcggcgccggcgccggccgccgaggaggtgaaggtggaggaggcggcgccggtcgcggagccggaggccgagaaggccagcgagtgagtgcatgccggggaaggctggctcgccgtcgtcgtacaccgtggagtacatgcatggcccgcgcgcgccgccgccgccggcgactcgccggagttgtacgtacgtgtgcgtgtagcgagtgatgagttgagtgagctggagtggtagtactcgactccgtaggtgtgtgtgggtacgcgtgacgtggggctaaataaaagagtttgtcatcgagggcggtggggcccagcgtcagtgacgcggtgcccctctctggcccccacatgcctccgtcgtcgcaggcgttgtttgtcggtcttttgtgctttttttttttcgtgtttgattggttttcatcgtgtaatgggtgcgtttctgagagtacattgtctgtctctatgtgtgtgcgatctcagccgttcatggccgtgtgccaaccatttctcgccgtcggtgaacctaccgtcttgtgtgttgttgttttgatcggttcgtcgtgtatatatgggtgtgtcacgttctgagagtacattatcactgtgctttgtgtgcccgatctcatccgttgatgtgcatgtgtcaatcatttctcgccgtcggtgaacctaccgaaatgtcgaaagcgaagcgaccagcaatggtggcagtgtatgcgtatgatatcttaagataaatcgagctccataaatacttcatgtttaggtctctttttaaacacgggattgaaaaaaatagagaaataggaaggataagctcaaaacatacaagaatgattgtttgagtagacaacatgaaaaatgcattaatcggataagagacatgttgaagcttctttaaacttttctccaaagtcttaggatatcctacgaatttcaatgaaaatgattgggaaataaacgacttcctactttttttatataggattgaaatccaaaaaatcctatgattttctccacatataaaaatgggccttatttgaaatatgggaattttattgggttttcacaagaatagctcatttccgggttcatgaatcaaaggggcccttgatcgtgaaccctactccttccgtccaaaaggaattaaattctagctttgggcatacctatagttaggagttgatttactttagtacggtggagtacctatttaaggatggcatcatgatgtttgtacattaatcccatgcaatcagctcttgctctgtgataagctaaggtgatcaatgcaagtgttttttttttagggggaaatgcaggagctctgccaatttcattgaggatagaaatgattcagattcacctctcaaaggttccac

SEQ ID NO: 54607 - DNA, 1501 bp, Oryza sativa
tatttttgctcccagatagttctacacctatatgtgaaacaatgctcataagttctatttgggattgaagtatatatagtacatatcattggtcattcttttagaagtgcttactcgagagctttgttcgtttcttcagtacatgtttcttcctcaaaagaaatagtggtgctaggactactatgattaccacaacgctcggcaccactatagccactattagaatagttgtatggttcttatgatttgttcctgcatgtgattgtcaattgttaatttaatgggtattacaatttcattagcaagaatgaaaataacacatctatttacaaacaagaatgtaaatataaagcacggtgagtttggtatactaccaaggcccctagtagatagtgtcaaaccaatataaactaacaatagtttaatcagtgtatggcaatagatcagcatgtataaacatacttttaaacacggaatgagtctaatataacacatagtgagttcggtaccaaaaatgaaagcaaaattgtagggcccctagtaccttttgaacgaatgtaaactaaaaatatttcaatcaatgtatagcaatagagtatcatgcataaataaactttcaaacataaataaattttgcatctcatacctttaggcttgactgtagcttgatagatgagttggtccaacattggagggcccgtgaagaaaggatatccctcataacgcaagttacaccatattgttgctcttgtcccacctgttgacatactaaaatgcgaactagaggctagatctccaaacaaatcttgcactctaaactgtttaactcaggtgagcactgtgcgaggccgaatatggtgtagttatattcattccctaggaccttctctcgtcctgtagcaaatctttttgataggtctgttatctttcttgccacatcatcaacaaataacatgactgtctcactaaacgacctgccctgactgatataaccagggttgtcctataaagctatattttccatgtcatgttgaatatcaaacttaaaatcttttccagaaattccgaggtggcaaaagttgtaaaatgctatactatccctctttgaagaatatacttgttgtatgtccttaatggccttggtgatacacctcttacaggtactaatatcagtgtcgccacgacactgtgtatacacctgctctttagttgagttggtgatgaccttggcaaacagagtatcactagctgatactttcagaggtaatgttctcaataaaaagtcaatgttctctctgtatatgttgtttgatttatagtttttgccttcacagttcaaactctataaatctgtagataatccagtggcaaattgtaccaacagtagaaatctaagaatgcagattgcagttgtcatttctatggttgccacatgaatctaaaataagaatttacataatgttagttacaattaaaatcataactacaaatggcatgaaga

SEQ ID NO: 54608 - DNA, 1501 bp, Oryza sativa
ggacaagataatgtgtcgacttatgaacatgtcagccgatttttggctcaatgtggtgaggcatcggctaatgatgctctgagggttaggttgtttcctttgtctttgtctggatcggctttcacatggttctctaatttgccatacaattttatcaatagtttggccgatttggagaaacaatttcacagttacttctacagtggggttcatgagatgaagttaactgatgtgacatcaatcaggcagaagcatgatgaatctgttcaggattatattcaaagatttagagatatgaggaacaggtgttacagcttggttttgttagattctcagttagccgatctagctttccaggatttgctggctccaattagagaaaagtttctggctcaggactttgaaagtttggctcatctggcctagaaggtaggagtacatgagcaaagatttcaggaagcaaagaaggttgtggctttcaagaaggtgaacaatgtccattattttgcttccgaatctgattctgtagatgattctgaagtagcagcggccgagtgggctagaagtaagaaggttattacttgtcaatgggtgaaaaattctgcaaaggaggagaaatatgatttgatatcaccaaagctgataagatctttgatttgctacttcgggagaaaaaattcaacttccagccaataatgtgttaccatcggttgaggaattggggaagaagaaatattgcaagtggcataatactgggtctcatagtaccaatgaatgcaaggtatttagacagcagattcagtcggccattgaaaacggcaagatcaaatttgatgattcctagaagccgatgaaggttgatggtaatccttttcctatgaacatggttcgtacaagtgggaaaacagccgatagcaagaattatcggtctaaacagctcaattatgttaggattatcaacaagtatcaaagaaagcatgatcggcaggaagaaaggtactatgaagatgataacagttttgatccccattggagttgcgaatttttcagattttgctagaacgaagggatgataacaattttgatccccaggatgcagcaattctaacaggggacatgctgcaagttcaagccgatcctatcctagggaaaattgattgcttcagaagaagttgcctgttcatcagagattaggtccaattcatcaagattattttcaagattctgaagatgaagatggaaccaagaagcaatggtgtccttctggtattttcaccaagaaccagaagagaagagttcaaaggatgaggaatagggagcaattccaagaggtacaagaggaaattaatcatcggttgaagaaggctaagccaaagcaagagtggtgtgtgaagagcaaggtggtatcagccgatgagattgaggctgacaaagtaaagaggttggctaaaggaaaatctgttgcatctacatcggttaatatggtttttgtgttaccagc

SEQ ID NO: 54609 - DNA, 1501 bp, Oryza sativa
gctccttttcacagctaggcatatggtaatcgatttatcggggtagttaaattgtttgccatagttagtgaccgagtttgttgtaaatgtgttactgttgtttcgggatgaggtggttcgcataatgcagtaattgggttactgccacattgtaagtaggcgttttcgtcggtaaatgaattatcgtattatggtgatttactacggaagttatgacaagattgtttcgtgttggcgatctggtcggttgttgccactgcgtgtgggtgggtttattctttggcaacttcacaattttggaggggtgcggttccatgcggtgggaagaccaattgaagcgtcatagtgacacctccaacgatgaactccagcggtgctcgttttggtgaattgccgccaacatctgcatcgccacagcgtgtgttaggtagtcaccacaatgagctagtgtgaggaggggcagtcgtctgtactggccgggatgcgaactgtatgccaccatctctgcgtgagcatgagatttctactccaacacggccagcagtgtacacccatgtaagtagtagttaatatgttgtttgtaaggacaaatttttgtggatgaacagatctatgctctatggcatttatgcatgcagtacgggtgggtagtaatagttttactaaatgcagtttagtgggctggatgatgacatggtgccgaaacaaaatatggtgttcaaagactatgacagtgtatatgatttctatgagaaatatgcttaccatgctgggtttgacataaggaagagtagaactaagaagactataagagaaatatgttgctccagggaggggcaccataaattttataaaggcgatgaatttgaacgtgagcgaaaccataggacaaagaaaactggttgcaaggcatacatgaaggtgaaaaatgtgatggttgatggtgaggtgtcgtctgttgtgtacgatgttgttgtgcttgagcataaccacccgctcacgccctctctagcagcggtaaagcacatgagatcccataagcacacggatgacacgataatggagtttgtgaacaccatgcaagaaaacagggtggcgcagaacagcctaattggagtgcttgctgacatgcatggtggacaagagaacatcccattcacttcacgcaatcttgagaatagatttgtatcctgcatatgtcatttgccgattgaattgcattaaacatccatacatcgtggcaccgtgttgaaataaattgtcctttgtaatttggttactaaacaggaaagccgctaatgtgagagctgagaatgcagacgacataaacaagctactggaattctttaaggagtgcaagaaagataaccctcagttttattgggatgcccagcttgacgaagatggcattctgaagaatttattttggagccatgcaagttgctaggcggcgtatgcagattttggggatgttgtcacattcgatacaacatacaaaaca

SEQ ID NO: 54610 - DNA, 1501 bp, Oryza sativa
gtttggaacacttacttcatcacctcctaatgtaatctgacattccaaacaattatggcatgagcaagatagccaaagcttgggttcaacaaattctaatagatcgtgtgcacatagtatgacaatcactgccagcactaatatggtgtttgggattattaaatagtgttctcaccagatcttgcaaatatatatatcacgtccatgctgcagcttctagtagatgcaaatgaccttcgtgtgagtagctaactggagctgcctaaatccacaaaagtatacagcggtgagtcagttcacaagaatatgaaacaataagaccaacgattttgcactggcccaaagtatcgaactcgtggtgtgcataaagaaatagagtgctaactattgtaacctgccatcgattggcagaaacaaattcagcaagttcttactatgataagcggtcgttgattggcaggaacaaattcagccagtgaatccatcacggtgaggtggttgctgctggtgctgaaactgaaaacataggggatgcgcgcgggcaaagccgccagggaccacccgttcaacacggatgatgcactcatgccagcgccgcgcggctggaccggatcacgtcagttgacaacatggggctctttatggacaatttcacaaacacattgcatacaagacgagatgctggagaaaaaaacgacagcttagggtggtgataggtgttaccagcgtcttggctccagccgttcgggacggggcggaagttggaccacttggaggagtttgccttgccgaggatggtggcagcggcggcgcggaggccggccgtcacgctggcgtcacgacagacgacgaagccgagcagcgcgaacgacccggccgtcgttttcagccggtcccgcgtcacgatgttgtccttgaggatggggacgccatggagcggcccgcagtagcggtggctagaggcgcgctcgcggtgtcggcgcgcgccggctgctggagcgcgtcggagttgacctcgatgacggcgtggagaagcgcgttgaggcgggtgatcttgccctggggacgagcgaccagggctgaggcactgccgcaccggcgacgtcgcctgggctgcaagggattgtgccgtcggccgcggcgggccccgccatccgctgtggagaagctgcgaaggctggagagattgggtcggtatgtacagggaaggagtcaaggagatgagatgggttttgttctctgttaggaccataactgcttccgagagtggagaagaaaacccggcaaattgagggaggaagcgtacgaacacaaaattttggagcaaacccgcggcaaaatcagttcgtttctgtttttcaggcacaagagagctagattgatggaaatctgacagggtggacctataaagaaataaattagtagtagttttatttttttttagataatggaatagaataattagaaataactttttttattactagtagttttatttgga

SEQ ID NO: 54611 - DNA, 1501 bp, Oryza sativa
tttaaaaatcccaatgaaaataaaaagagtaggcgatggacggcttaggggagtcgagtgacggcgtttgacggaggatgaatagaaaccgtagtagatcgagcaataaactctagaatttataagatccaattttaaaagttgcaaggaggatgaatagaaaccgtagtagatcgagcaaataaataaaagggtaacaaataagtacgaggtagcgcctagtgtgactttcaaaaactataaaattagaaaatgcagatgataaggttcggtttttcaaagtcctaagacaattatatagctatttaactaattttaagcaaaatcatatgtaaaaaaaataattttgtatggatgctagctgcgcaattgcgcggctcacctagttagttgtatgcaaatcaagttgcattttagaaaccgtatcaatataaaagcgtcacttgttattgaagggagtgattttaagcttttctactcctataaaaaaaaaaggaaccagtagttacctcgtgattaaacatgtgggaatccatctctcaagccgatcagacagattgtcagcgattattgtagataaatcatccctagatgcatgcatagcaagttagctacatgtcaacatagctaattaactagtctgatcgatcccacgccaaaaagctcttcgctggaggcttttaggccctccaattttgtgagttatgaggtgcatgcttagccacaggacaaactaaagctgacctgcattttatcttatttttgttcagttcagttcagttgtgcatgcatgcaaagagggatcctttgatggcctgatcaactgtaaaattgtttataaacatggttaataatatagaaatgacagagatagattccatgagttggtcttaaaaaaatcattctaaagaaaatgggattttgttttggagtggaaaatatggatatatgataatattatataatacattgaaagaaacaaaactgcaagcctaaaaaggacaaaaatggctgaaattccatacggcctagggtcacacgtaaggttggtaacatagctaaaaatagaaagagaaaaaaaaactagaatgccatacctacactgtcatcccaagatccggtttttcctagactccatgctacacattccgtaacagaaaacgaatcccacgatctgatttttcgcagtcgccatcatcagctcgtcgcatgtggctcgcacatgcttaacaaactcgtaacggcatgatctccacaattagatcccataagtttaggagaataagaaaggcatgaggtgggagttcttatttggaggaggagaaaggtatgaggtgtgaggtgtgactttttattttgaggggattatctccatgagatatcggtgttcatctatcgactctatgtagtaagtatatcattaatacagtaccttttagatcgatctggatattctcaggatctattaatcctgttcatctttttttcgccaatttcaaga

SEQ ID NO: 54612 - DNA, 1501 bp, Oryza sativa
gggtagaagataacttgcagtccatgacttttagcacctccttataatgttcccatcaacctatcaggaatgcacacatcaatgtatatttagcaacaacatgaaaattaatgtgtaaaagcatgtgtatgcacatatctattatatatcagcacttgtgctgcccgatgcattcattttctcaattgacataaagttagaaacaatattatgacccctgattgtcttaagatcaatacgttccatcgaattatcagcaattctttccaaaggacaagcgccactgatggaaagatgaattattgatctgtatgagccatactttattccaaaggaaagttacaaacaatagtattctgtgctggttccaaataagttttagtctttataatatactatttattcgtacttgaattgaaagaactttcataggcctctttgatgcctgttgatgctctatatgccaattctaatgtatttaagacaggaatgcatctaccatgtatgactgaagctaagactccatataattaatctaagaattgctccattcctttcacggtgacatctatgcatatcacagggcaatggataacctacaagaccgccatctgtgatcatctcaaggcatccatttcaggttaaataccaataaccactaagcaattccatcttatatattcagcccagtaaaatgaccagtaaaaggaacagaagaaattgttgtcaagtcctgattttccaacccaaataaacatattttaagtggagtatatcatcatgaaattttagtagcctcacattcaaagatatccccggcatagtttattttaccaaaattagtgactaaaattagcagctgagctctatctcatcgtgagcatgacttcaccacaatgcatagctatattttgattattaatttggcagtgattttacgacattggattaaacatcagaatcaagacacaacatttaaacgcaaacaggcaaatgaattaacatattggtttgcatattttctggcagaaaagagaacagaacatcgagaaaaaaaaaagccccaacattcacaaacaagctataacagatggatcttcaaatgtgttaataaccacagtaccattctctatcttggtgtgattttgctaaatgagaactgtgcataaccacattatcattctttctcctagtgatagcatggaagcaagaagtgttggtaactacacatgaaacatggatcatgactgagagaaacaagcaatgagaaccagtgcaattcagatttaatagagaaatatcaaatcaaaatgtaaaaagtttgaatttgaaaacaagtaaaaggtttgactactgatttaatcaggtatagttggtaagtggcaaaacaattcaatgggttgattagctctccagggaatcaacagatgataagccaatctaggtattacatggaaaattattcacttatatactatcagatgacattcttcccaattat

SEQ ID NO: 54613 - DNA, 1501 bp, Oryza sativa
tggtacagatagccgaggaggattttgcccaaggggaattgtctctttatttctagggcttcggctagaaattgccagttagttgtagggccgcagcttgatccacaaaagagaaatttctccagccacatcagcagaaaggctacatgctctcggggagtgacatgtcctttgcccatatatgctacaatataccctaaccagcctccaatactcttggtcttgaattcaaaggtatttttggtgttcaagctcatggtattagccgatgaagtcacatccaagccagtaatcattgtgatatttagcaaagttggtgtcattggcccttggttgaagaggaaagcattaagggcattcgaccaaaaatatgttgcagcggctatcaagggctcatccttagtcgaatttgctatggtaagggctagtgcttggccgattccaatttcatcccagtgggcttgtttgctagccgatacccactattaccacacagaccagtttttctcgggagaagttttctcaagagcaggccaagacttgaaggtattcttccaatgacctagattcgggttggccaatctaaaaggaatcctattggtttcagctatgataaactcagtagggtcagggttgccaatcggaccaaggaaatagtgatgctcatgagacaaacttggaatcgcgactagattggacaagtgctacagatgtaaacaaggatagagaagaagaaaacaaggtgaggcaaggaagaaacaatctattgcgaaaaaagaggatctagccagtgagcacgtacctctgcgtactcggccgatggcgcggcagacgggctggcggaagtcgacatcgccgcgagcggaagcttggccaggagaagatcgccttgaaatcgccgtgtgcaccgaggggatcgccggagaaagagaagacgaggtttgcttaagcggtgaaaacggaagtgacggtgtgaaatttctcgggggtagcggttaatatttaaagcactgtgtaacggtcggaaaacggcaagtgcgagtttctctcggagacggatatggcaaatccgaaacattaccaaatattccggacttggggggcatgtgttaacgaccaaatttggtaatctaagtatcggagataaagattagattgaagcggaatccaagatcaagattgtttcagaaacagagcaagaatcggctggagtccaaatcggctacgaccaggatcggcagagttcgagtcagacagggttagccgattgagccgatcccgacaatacaactctacgtcatcggatagaattaatgtgcttcgcatggattgccacacttggactgagtcctgaataggcaattgtatctattaattaggatattttatgtaatttccttagagataagtgtgggcaaaagtctgccgcaatgacttatggtatgttagagtttattagagataagagtcatgtccgacaaggacatattgtgtaatctcg

SEQ ID NO: 54614 - DNA, 1501 bp, Oryza sativa
gcgtgatcgaccgccgctagaccaacaacagaacactgccgagatcacccaaaacccgacctatacaatcaacacaaaacccaactctatccaagacttcacgatttagggagagaaggtgagagagaagatgaaacacctctcccctagacactccgacgtggccaacttgtagaaactaggacgccgctacaagagggctagaatttagagcgtgcttgcaccaattgctcgggggtattggcacacaacacagtattaattaagtattaaacattacaaattaaatacatgtggtttcttatatataccatgtttaaccatgaacgcatatgcctgtgtgtatgttaatggatttactgtatatgagatggtcacgagagggttatgttgttgctggttaggcaggcaggcagcagtagatgggtagttaattctcgatccactgatctgatgtgagtcgcatgccagcgacgcttggcgtacatgcatcgtgttccccttgtccgttgctagtccacaccaccttggtatgagctctcctctgcagctttccccttgtatacttgctttgccctttggaataatatcgatcgtcttgcgctctgtgtaccatagtacttgtacctgcctgccaccatgtgacactgcgtgcttcatgtctccacccatgtaaactcttcctgccaagaacgatctagctagctagtagctactcttgtgcatcatagattaattgatcagttggggattggacaattaattagtcttaaatatgacttttaggacaactacctttccaatgtataaatattataatatttaggaattactagtactaattgttagtagctagcaatagctatacatatatgtatcctccatgtcattgtaaataatgttagtgcctgtttgggttagtgccctcgtaaaattttagtagtgcaaaatcttagatatgttatggcactactaaaattattattgacttggggcaaaggttgaccttaatccaaatatgtaccgtgctatattaaagttatcaaatgattcgtaggactaaatttggtatccaaccaagctatttcgcagtacataccaactagttaattagcactagctactatgagaggcttgtatacaacccgtctatttaaaaaatatataatgcatagtaaaatgttcttaataagtctatatatgcgtgtgtatattaattaatcgtaaccattagattaagctctgggcatagagtccagcaagaaatatatatgtaccaacccatgcaattaagctaaccatataattaaccttgtaagccacctgctatataaggttcagaaatttgttgtgatattttttgggtaccggtaatttataccccccataaaatcgatttttttttaaaaaaaaggaacacatgcatttgctgcttcttcttttcgatctggaacctgccgtcgatcgatcgatgaagcatcatatctcatgatatccagtc

SEQ ID NO: 54615 - DNA, 1501 bp, Oryza sativa
cggccgcacggctcggcgtcgtcaatgcgggcgatggtagcctggtaggtaaggttggtatgctccgctcaggcctgggggtaaggagtttttcttccccttcttttcccaatattcttaaggtcggggagagatgctgctgctgcatttgctgttcgtttgttcgcataccaagtgagcctacgcgtttcttttcaggtttgcactcgtctggggggatttgagagtccttgagcaagtggatccgtagctttcgttggtatgtaatgtggagaattgaattttctaaagcatacatgtacgtttctgttctttcgtagctgtaccgtacacggtgatggttctgaccagatttcgctaagaccttttcttctatgctattagcctattattagccatgtaggagttggaattttactccatttggcatcaattcaatcctttcaagaaaaataactcatggagcaagactacttctttgtttgccttttagttgtatgtgaagtttatcaagctgcagttcacccccccactttggtaaaaagacaccaacagcatcttgtatcatcccatcatcatttgttaagacgaataatggcagatcaactacttgtcctaaaaagagaagcgcattatttacaaaattgtcttaagagcttaatttgtttcaagtaagaaaaatgatgggatgagtattaggttcagacttcagtctcagagaggtgcaggctgttgtcacaacaagctttgtagagtacattcaactaaccacatgaacgtggagcccagggatttgccaagatatgcaaggcacacctaatccaacataacctactacagttctctgtcatcagaaagttgaaagtgtttcttgtgttgtatttatacccctcttttggcagtagaatagtcacagtcaaagtaatttgcttgaaatttattcaacaaaatatatacaaatttcacatagtgaatttgatattttatcttgactgatacctcctccctttcatctgcggtagtctttagtgtacaacacatgcttttaagaccttagtgtttttaggaagcaagttgataattacaattgtttatacttgtaacaacaaggcttgattttagcattgaaagtatctttccagaaataaaaacctattgaacaaaaagtggtcacacataggcaaactgtcaaacatggagcaagtatctcaagacagtgatctcattgaaactgtccttatttctttttcgtaagcgcacaggtccacttttatcttccttcacatgcttaaaggcttaaagctatccctgctgtttcttcctacaattctcaacgaatctgactctaacctccatttcctttactttcccctcgactcctcttggtctttcaccctactggaacgaccatacagatttagccattaatcatccacctcttccttcctaacataggccatcatcatctgacagtaagaatccagaggtgggtgtgacaaga

SEQ ID NO: 54616 - DNA, 1501 bp, Oryza sativa
attcttcaactacatctgcatcggcatgggcttgactaattccaaattcagctggtaacacaaaaaccatattaaccgatgtagatgcaacagattttcctttagccaacctctttactttgtcagcctcaatctcatcggctgataccaccttgctcttcacacaccactcttgctttggcttagccttcttcaaccgatgattaatttcctcttgtacctcttggaattgctccctattcctcatcctttgaactcttctcttctggttcttggtgaaaataccagaaggacaccattgcttcttggttccatcttcatcttcagaatcttgaaaataatcttgatgaattggacctaatctctgatgaacaggcaacttcttctgaagcaatcaattttccctaggataggatcggcttgaacttgcagcatgtcccctgttagaattgctgcatcctggggatcaaaattgttatcatcccttcgttctagcaaaatctgaaaaattcgcaactccaatggggatcaaaactgttatcatcttcatagtacctttcttcctgccgatcatgctttctttgatacttgttgataatcctaacataattgagctgtttagaccgataattcttgctatcggctgttttcccacttgtacgaaccatgttcataggaaaaggattaccatcaaccttcatcggcttctaggaatcatcaaatttgatcttgccgttttcaatggccgactgaatctgctgtctaaataccttgcattcattggtactatgagacccagtattatgccacttgcaatatttcttcttccccaattcctcaaccgatggtaacacattattggctggaagttgaattttttctcccgaagtagcaaatcaaagatcttatcagctttggtgatatcaaatcatatttctcctcctttgcagaatttttcacccattgacaagtaataaccttcttacttctagcccactcggccgctgctacttcagaatcatctacagaatcagattcggaagcaaaataatggacattgttcaccttcttgaaagccacaaccttctttgcttcctgaaatctttgctcatgtactcctaccttctaggccagatgagccaaactttcaaagtcctgagccagaaacttttctctaattggagccagcaaatcctggaaagctagatcggctaactgagaatctaacaaaaccaagctgtaacacctgttcctcatatctctaaatctttgaatataatcctgaacagattcatcatgcttctgcctgattgatgtcacatcagttaacttcatctcatgaaccccactgtagaagtaactgtgaaattgtttctccaaatcggccaaactattgataaaattgtatggcaaattagagaaccatgtgaaagccgatccagacaaagacaaaggaaacaacctaaccctcagagcatcattagccgatgcctcaccacat

SEQ ID NO: 54617 - DNA, 1501 bp, Oryza sativa; identical to SEQ ID NO: 54571

SEQ ID NO: 54618 - DNA, 1501 bp, Oryza sativa
ctggaggcccctggaggtgccgggccccgccggcatctccgagtgcacgatgccgcgtccggccgtcatccactgcacgtcgccggccttgatcgtgccacggtggccctcgaagtcctcgtgcgtcacggctccctgaaaaacacccaccattcacgtcagttccaataagaacacggtcaatgcactggcctaagtagcacgtagattctgagtttaaatttttataggagtgaatttcagattaagttgtttaggctaagttcccaatttaaatggtttcatattttctgttggatgtaaagaccggattaaaaatactcctctctttttttttaaaaaaaaaagaacacggtcaatgcaaaaccaaactatcaaggccatcgtacgtcttcctgtagaaattgtttctttctatttcattttacacggcttggcttgactgatgttgggtttaggcgaagatatatattactaatcgatctgccaatgatgagttcaaggtgtgaagcagagttttgagcgcggaaaagtatatgcgacgcgaggtggttgacgtaggaaggctaccaaccaaaggcagagcaaggcaacagggcccgtttggatgggttagattcttcaatttgacggaaagaaacgttctgaatttgctaaaaactactactccgtatcagcctatcaggtttgcgttgttgacaaatgaaacgcgtttaattcgtttctgctgatccgtgtgatgtggttgtcaaaagacgctgctgtctgtacgtatcactggggattaagcaaggaattttcatggccgctctatatgcagttggatgttctactaccgacgaacagaatgtgaactgtggtaaaagactctgcctacctcgagcatgtaagtgacggtctcgaaacctctgtgtggatggtcagggaacccagccggagcagacactgcacaggattcgatcaagaagacgatcaaaaaatgcaaatctctatcactctaaaccagatgatcaaaaccgagccagaagcaattcactcacctgagaactcgtccaggacgaggaacggatcgaagtacctcagctcaaacctcccgatgctccggcgaacgacggcgccgacgccctcgtgctgcggccgcgccaggaacttccgcaccacctgccggggcttctccatcgacgtcgtcatatatagtactaccagttaccacctttgccgtcgccggcgaacgatcgacttgatcagaaattcagaattcaagaacacctcgacgaccctttcttcttcctccgacctcccttgccggcgatgcctatggtttgtagtagggtatggtggtttggtttggggcctattttcttcctctttatatagcggcaacacacctcgattccgttacgccccgatacgccgccgccgctgctgctgctgctgcttcccggggtcaaaagcgacagatggtttcttggcgttttttcctctctccgctacggggaaa

SEQ ID NO: 54619 - DNA, 201 bp, Oryza sativa
ttatatacctagaacaatctaaattaagcaacatgtcaacaaaaaatgtaaaatttagattccaggtgattcatcatgtgctcagttagtagataccacgaaacaaaatggcaaatcatccgtgcataacggggactgcatgtgaatgtaaactatgcgagagataacaactgagatacatacatatcacgtacctgagga

SEQ ID NO: 54620 - DNA, 403 bp, Oryza sativa
tacataaaatttttgaataagacgaatggtcaaacatgtgagaaaaagtcaacgtcatcatctattaaaaaatgaagggagtattttgatattgaagaacatatccatttatatttttcctattatatttagatatagtaaggctctaataatgataaatctcaaggacaaagcaaatcatttatttataactcttttgacaatgcatctatataatttagccacctttgacaataagagtcaatggcaaatctaggataaaaatagaggtgatgctaatactacataacgcaaaaattattggaaattgtatttcctgaaaaatatggtcttaaatatccgtgcttcgttttgaaaaaaaaaaaaacgttcgtcttgttgaattattcaattcgatgtgcca

SEQ ID NO: 54621 - DNA, 1501 bp, Oryza sativa
caaaccattcggcccatttagcccaaaccaagactactactgtcatctacggccaagtggatgtacactgtactgttcatattgccctaccaaataattattgactaatctaaaccaatccaaaagggcaggagaaaaaaaaatgtcagcatcttgctaagagagaatcttctatagtttgtgcttggaatatcccctacctgccacatctgttccctcgctcatgtctcctccaaagccttttgattagatatccattatgaaattcgagcatttctagttgctatcatcactaatgataaggtcaccgataattaatttcctttgatgaaactggttccagatgctctcaatttctcctttaatgaaaagaaaaactacatgtcgctgtcccaaatgttctatggattggattcttccatgtcgtacctattgtgatgactttgacctaatctaatcataaacccgtcctattagagccacaaaaatgtgaaaataaaatgtttttatcagtatcataatttccaattaggtcgtcacatatattttcaccgtagaagttcagctagcttagtccaacaaagcaaagaaaacaaaggtggcgtgcatttgtaaactaccacggagataactacttccccattagtaaacgacacgctaattaaattaattaattaattaatgcgctctttacctaactttttggatttgtttaccaagctaatctatcttaaattcttaaatcacctgtactaaatttctccagaaaaatatcactaagctacaaagacacagccctttggagttgtttactaagttaatctcatcttaaattcttggttgtgttcgttattccagattgggaacttatccctttccatgacaaacataatgactcgttagaacataagtattaagtatgaaaagtttgaaaagcaactttattgtagaaaatttgttaaaaaaagtatagttttgttgttcgaaaaacgtgtgcgtggaaaacgaagattaaaggttgataaaaggcctatttagatctcggcaaaacttttcaccttgtcacatagaatatttggatacatgtatagagtattaaatataggaaaaaaaattaattacacagattgcgtgtaaattacgagacgaatcttttaaacctaattgctccatgatttgacaacgtagtgtctcgctgtttacagatggattctataatttgttttattattagtctacatttaatactttaaatgtgtgtccgtatatctgatttgacacgctaaaactttttgccacttaatctaatcacagctaaagatgagaaacgaactcagctaatcactcatactaaatttctctctcaaaataaatcgctaagctatacaaagagacaagaacccttctaagcaaagcagccagctaggaggaggagaaaacccaatcaaaatcaacccacgagctcttcctcccacctccatggccgccacccaccccctcc

SEQ ID NO: 54622 - DNA, 1501 bp, Oryza sativa
gaaacagagttcttcttctacttcttctagtttggtgcacgtggccatttgacgattgggtgtaaatgtgtaatcggtaatcctgcccaaagacgacgcatagatctcactgaatctacaagaaaagcagagaactctgcacccctgcaacgtgtactgtgtacacagggtctgtttagttcgcggaaagaaaatttttagatatcacatcggatgtttgatcggatgtcggaaggacttttcggacacgaatgaaaaaaataatttcataactcgcatagaaaccacgagatgaatcttttgagcctaattaatctggcattagcactaggttactgtagcacttatggctaatcatagactaattaggctcaaaagattcgtctcgttatttttccctaactgtgcaattagttttttcatttatctatatttaatgctttatacatgtgtccaaagattcgatgtgatgtttttggaaaaaaaattagggaacggggcatagtagtatatatatatatatactcatatatatatatactcttaactctcttggaagaaacagatacgtttaccccaaagaggcgagaacctgaaaaggtcgggcattccccgtgcagcgtgcagcaaagcacaagggccgtgttagttccatttaaaaaaaattaaagtatacgaacacatatttcaagtattaaatgtaaactaatagcaaaataaattataaattctacctgtaaactgcgagacaaatatattaagactaattaatccgttattaccacattatcaaatcatgatgtaattagtctcaaaagattcgtcacgcactttacatgtaaactgtataattggttttttttttcatattttatgttttatgtatacgttcaaacatttgatttaacagaaaagttagaacttctaaggaaaatactatcaaaatcctccgagaaggatacaacacaggacagatgagagatgacacgtgtaaaatctcttctttttttcctttccggcgccgcgcgcggttggtggaagttatttaaccgcctctgttgggaacgcaggtgaaaaaaggcgggaagaagaagcagcggcagcagcagcaagacgacgagtcggcgacaattcagatcacaccggcatcacctgcacacatactcgaaagaaaaaaagcaagcaagcagatcagattctgcgccatcgatcgagcaccaaagcgatcgtgagcttccaggccaagaaagccgccatccatcttcctcctcctctcactctttgcccagattctccctccaaaagcacgcactctagctaccatagtatgatagtagcagctgccgccgcagcgtccaaaagcaaaaaaagcatccaatccatgagcctcacatcataagcgaaccctattccattcgccactctctcccctctctctcgttcgcttacctcctttcccacctccactctgtttccatggcggccggtgcgcccccgccgg

SEQ ID NO: 54623 - DNA, 1501 bp, Oryza sativa
tgtgtggttcagcattgcttttggaacgagaagtaaaggtactatcaggatcagactattgcatgaaatagtggaagttgagaataaggaacagatccatggtctcctctatttgtttttactcaacaccagacacttgataaatagtaattaaaaccaatcaagtaagcaatgctcacaccactgcttgttagtattcacttctgaaacagctgacaagtttgatagatcacaaagagcatgtttattaaatcgatcgaattataccaagaatgaagcaggtttatggattaaaaatgttaataatgtttctttaatcacactgattgttcacttgaaatggaaccctaattaagtgctaacctactcaagaacaaatgaaacccaaatatttggcgattcggtgacatcacaaaattgaccaactaagacaatggaccatacgcactcatacggagtgtagcatgagtccatccctacgttgtgtattgcaacccagatcctcatagacacaaaatcagcaaggcaatggagtcaaaattttcatcatctgcaaacatgaatccatccaaacctgatcaaactaacaacacaaggccataaagaaatttaaaaattctgcatctccgctctgctaaagcaaaacaatgccactaaatctagaagttgagcaacccatccgagatcaagcaattcgtaaccccaaaggttattaccaatagtacccaaatatagtgagctaagttcctccaaaaccccacaaatctgtgcctaacctaacattctctagcccaatccaaggcctaacccccagcaagtgaaaccccgaacgaagccaccaccgtaatttcacgtcgggaccaactggagcaacctcccagacatcgtaacacgcccataaccactaaatctaacttcccaccacgaaccctaagccgatggaaccaaaccgctccccgatccgtttccgcccgcgaagatcctggacgcaatctgacgaaagcaagcaaagcggtgggagggcagcaggagggagggccgagaagggcgtggggagaggggcagggggggatggggatggggatggggcgtggcccctttacctcgaggaggaacccgagcgcggcgccgacgcggaggcggcgctcgagggggaaccgcgcgaggaagtcggcggcgatgtcggcgagcgggcgggaggcggcggcgagcagcgagaggaggttggaccgctcgtccggctgcagcttcggggcgggagccagcgccgacatggtggcggtggcggtcgccggcgtcgtggcggccggcggcgaaatgttccgttcgcttttttggttttgggtttgtgttttttttccccctttgggcgagggattcgggggtgcagtggggttaggcgacttgggatgtggttcggatcggacgggtgcggctgtattcataatcgtacaggtcagctttgtttttttttccttttttattaaccatttttttaaaa

SEQ ID NO: 54624 - DNA, 166 bp, Oryza sativa
tcaacggtagtttccactgtatatatggtttgcactacatattttcccccgtttcaatgagtagaaatggataggcaacttttctttttcaaaaaaaaaagattttctagagaaaatgagctaagcaatcgacattgcggttcattccaaggtttcttcgagaaaa

SEQ ID NO: 54625 - DNA, 1501 bp, Oryza sativa
tgcccgtgcgttgcaaccgggtagtagtgggatgagtactgtttgatcttaaaaaaaatatcgaagcaactaagcctgatcataagcatcaatgatgtgttctatgaccacaaaagcaaatttgttcttggacaattagtctactctacatgtgtggcatgtaaatgatgcttataacatgtgggcccgatgattgtagcatgggaataatggatgggcgaaaaatactgttgcctttgcacataaggcgacagacgaaaatttgcgtgacaaacaaataaactgatatttgtaagcctaacgagtgtaaattggaaccacaacactttgtaaggggtattacacactctctttataggttgaggtcatttattatcttgtattatattttcttttatgaaagttttatatttttttcgcattcgatgctttttatctcgataaatatttaaattgaagagcataagatttttatcttagcgaattaaaataatagtaagatgacacttatcctctagctctctcgtttttctctctccctcgcttcttctcaccactgctcctatccgttgtcacaggccaaatcaactactgaccccattccatcgtcgttggtcttctttttcctctcggcatgtgctcaaatcaaccaaggagacgtgatcagtgagtttggtgccaccgaataaggtcgattatgatgggtgcctctttctcatcctactgtcaccgtatctagattccctaagtttagaccatgtttgagaagagggaaaagaagaaaattaagaagatatgtaaaacgaggtgagtcattaatgcataactaattaagtattaattattttaaatttaaaaaataaaataatatgcataggaggagcggaagatggagaaaaatcgagcatgggagacggtccacctaagatgtacattagctaacacacgggtggtcgaccatggatgaagcatcgtgtgcgcgtcgagtcatggttctggggtagtgttgcgcttctctttagcgacttcgagctcctcgtctatgctattgtagcctccgggcactggcggcatggaaagctcatgtccgcatgcgatcaacactcagaatgcgacgatttagcttagtttagggcacatgaccaaaaatatgcaacgttttcttctgtctcactatcccgatctgatgctatgagcggaggatgattgttggatgcttggagtgaaaagaatcccgatccgatgtgataagcggaggacgattgttggatgcttggaatgaaaagaatccaggaaatgcacattactacaacaaaaacatttttacatatggtcaaaactgatttttttttcgtgtgatttgaccaactgtctgccctgaaaggtgtacggaaatattgatttttccatgcgggtgacgcatccacatgcgaaattttgattttcgcatgtgggcgcctaagtcgtcctcacgcgaaaatgaaaaacgcaaagaaattcc

SEQ ID NO: 54626 - DNA, 1501 bp, Oryza sativa
ccggatccacccctcccgtcattgtcgctggagcccatcgccctcaccccccacaaccacggcccacggtgccctcgtacagtgcctcctccctagctgacaacacccttatcccgatgagcaacgccctcgcacatcaccctcccccagccagcggtgccctctcagcggcatcaccctattctccggcacaatggtggcaacctcttcacggtagtgccttggcaacagcaccctacttgcggtgcacaacggcatgcccaccaagcttccacagcctcgggacggcggcgtgcttggcctccattgatcagtggtgccggtgttttagtttttatgatttaattttctggaatgattttgatttattgttgttggattttttattttatgatttagtggatatgtgattttgtgattcagcggggtgaaggacgaaaaatcaccacgaaaaatccgaatatttatattagttatagtttatagataggtagttattaagactaaaggggagggggaacagtccccagtctaaaggcgtacatgtcccaaccttttactttattatttttcattcgcacgttttcctaattggtgtgtgtgttttaaaaaatatatatacagcaaagttgtttaaaaaaaattgtattaatatttttataacttttttttagaattacacagtacaacgcaaacacacataacgcacgcgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaacgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaaaatcctggaaaattcactcccatagggagtcgaacccaggacctcaagtgttactgaggctcttgtaaccactaggctacaggacctttcactaatatttttataacttaattaaacatgtatgtcgttttgggtacgtgggagagaagtttacaacctttcctcccgaactaaggggtgcctttgatttgtaagaaaaaacatagaaaattagatgatttcaatcctatatgaaaaattcctatgaaggcatttgaattaaatgat

SEQ ID NO: 54627 - DNA, 760 bp, Oryza sativa
cccccaaacagtctaaattttcacctagactgtgaaatgatgtagctgtataatccagaaaatgaactagaagccataagctggatttgtcagcttctccagattgtcacctgctgcttctcaaaatactaagctcccccaaatagggccaagtcttgcctgcgtcgacaactcaaccatggttactaattaactttacatttgtgttggtgtcatggtgtgtgataatattgacagtacgtttttctctgtgtacacacataattttggagatgacaaaattagcatgcactcatctttatatgctcagtcgtatctctactttagaagaatgtggaattgaaggatggggcttaaacttctatgccttatgttgatcacctgcagctatatcctccacccccactccccccccccaaaaaaaaaaagagaataagttcacctgatatcccaaaactttacgtcgagtttgtctgaggtccccaatctccaataccagaaattctaccgctcaactattacaaaccgtgtaaaataggtctcaaggcagtatggaccaaatttaaccccggttttactaatgtggcatacagcaagccccacatgttagtgcgccgttagggcgttattacactgagtcatctctcttgttgggttggcgcgagtttttccccttctctctctcttcgaaaaccctaggttaggcggtagcatggtggtggcagcgatggcggcaaggagaggagtgcatgcgaggaga

SEQ ID NO: 54628 - DNA, 1501 bp, Oryza sativa
tagcttgtggtgaatttgcatgtcgaactttcagggcgccggctgcaatttgtttgattggtatgatcccccatctagcagtttcatgagagagccgttgtatgatcttcgagatgtcgtgttgtcactaagagggagaaggctgagcttgagcattttgttgatgaattgaggacgaaggaagaagagcagtgtgcagagattactgcagcaaggcatgaactagcagctttgaggcttgtggcatctaaggatgaagcaaaaattattggactgaagccaagtaggctagagaaacagagatatgtgcttctaatgttactgttgacatgtgtgtttatgttgtttgttttggtgttagtgaagaactgagctgtaatatgttagcatggtaagatgtatggtggattggtggttgttgttatgtctgaaatttcagtgaatgcatcaatatgttcttttgtttgtcatgaaatttgagtgaatgcagcaatatgtttgatatgagatgaaacatattactcatcttatgtatgtgcagaaatatttgacataagttgaaatgccatcaagtatgactgaagattcatttgagatgggctaagagtttttcaaagctacaaatattacatgtgagtttggcacacatattatgtggccattagttagccatcccatacacagcacatgacatgcccaagagtttggcaatgcatcacaaaatagctgctcaagtgtgcagaaatacatcacatcttatcagattcccatggaaaagaaacatcagtcgactaggggttgatttctttgtcttggcactagcaggttcttgaacttgaacaaacacacatgcttttccagaagtgatcctcactaaagcagttctagagctctgagaatgtggcactatggcctgaagattcacactggctgaaccaccttgtcgggttaatacccttgcactggctgctaccttcaccattgggttggttttgtttggtgcctacaagcagaagatacaattagaccaggtgaatgagagtaatagtttagtccaggaaatggtacagacctttttcacaggaggtgatctcctccaagtctggcaagcagatgtgctagtactgagttcaactgcctttcttttcctgctttggccaatgctgctaggtactgagttgttggatgcattggcagcattggtagtgtgccgagaagctgttgtgctagttcctgcatcagtgtacttgtgacagcttgatttgttatgcccagatttcttataggtcctgcacctgatagttgttccaaacttagaaaccttttttggtttagctagttcattgagctcccttctccttttactcctaggcttccctggcaccttgatataccctagcacattcagtgcctctctaccatcctctggccaactagactttccctcaatttgctctttcttctaataacctcaccatcactgccaatctcatcaaatgac

SEQ ID NO: 54629 - DNA, 1501 bp, Oryza sativa
aaccgagccatgatcagtataacggatgaatgataaccttgtgtctcttgccatatggattaattagtgggtatataataatttattaatatataaagtgtggatgatatgtgtatatattaaagatattgatatttgagatataaatgatgttttaaatgaggacgtgggcctagtgaacatttttaattccccgtgctggtcgggaggtaaaaatgttccacgttgcagttggcaagatggggaccagaaaatttctagcccataaagattgggatttggatatattttctcgtgtaaaattccccgctgccatccctacaccattcacgctagctatatatgcgtgtgggtaattgcagttaaacctttgggttggcatcaaaattggatattagaattaacgcgatgctctattttttttaagtcaaacatggagaaatcaggttggtgtttatatgacaaaattcataaatatttttttaggggagcatatatataaatattgtgtttgaatcaaacttatatggttaataagttgcaatggcttaatagatttaattaattgaaggataatcgaaccgtgcctcctctgtttccatcttttttttttcatttcaatatagaaaaaatatatttaccacatactatcacaaatttttttgacataactataaaaagatatttttgacaaaaatatcacaacattacatatttaaagtcattctatcataaaacaatatagttaatgttaaacttatcacaaaacaacatatttaatgaacggtattgcaaaaatatatatttattttattatcaaggtgatgcagaggatggaacctccacaatacttagttttgcgataaacctaatattgtgacttaaattcagtgtttaaatatataaatttgagatatagcagcttaaattcataagtttttattctacaattatgtggtttaacaatgcaaagaccgacattgtccaagatatgcataccaagttgtgtacgatataccatcccctctccttacatataaaaataccatgcatttactccataatttccacaacttgcacaaaccaaatttaaaatcaccaactgacaagaaaaattcaacagtgtgtacttgccagacagaaggaaaaaaacccacaccttttcgcagactcacagaaaaaaaaaagggaattaattgcatgtgacaaatacgcaaagcaaagcgtaaagtgacaggtagtagtaattcgatggtttccatcaccgtcctcacacacaaatttcaaaaaaaaaaaagataaaaagggatatatcctttgaccggtcaaacctcgcgacttcttcttccacctctcgctccgggcaactatatatatgccctaccgcgcgcgaacgccacaaatagcaaccaagaaaccaaactaaccctacccttgctgcgctgcccatttccgtcgccgctgtcgttgatatctccggcgatgctctgcggcgtcgaga

SEQ ID NO: 54630 - DNA, 1501 bp, Oryza sativa
agttaaggaggtgatggggtagttggtgttggggcttattattaggggtgaaaacggagcggatattatccgatccgatccgctccgaatccgtccgatgtgaggatatggtaaggatttttagatattcggccggatgcagatgcggatgtggatatggtatcaacgatatccgacggatgcggattatccgatattttaatcggattatccgatgtactgtttggcggataatccgcaactttcaggccacacaacaactctatttagcccattttacatcggacggcccatctagcccatctagtgtaacctaatccaatcctcccctaaatctctctctctgtgactcatctcttagtcccttctcctgctcccacacgcgctgccgcatggcaccattaccataggtgcgccgcgccgccgttgcagcatgttggcgccaccgccgccgctcctccttctagtccgccgacagtgtgttgtgtgttgtgtgctgtaagcagtgtgctgtatggaactagtgtattgtgtgctgtatgcagtgtgctactgtgttgtgtggctgtgtgctgtatgcctagatagctgtatgcctcattgcctcatgcgtgtcgtattgatgagtgaactactgatctactgaactgaacactatatttttaaattttaagcaacacagtgaactgctgaactgaacacttatattatgtttttgatggatgtgttatattaagcaaaattatattattgatgtgttttggttggtttttcctagagagctgaaatcatgttcatatgttgttttgccatcgtattgcggctaattgtattgccgccctcttgttgtacggattgaatacaaacttaacatccgacaactttttgtccgtttccgaaccgagtccgcaccgactccgcaccgaatccgacgtccgaaataatccgctccgcatccgcatccgcacgtcatccgcacccgctccgcatccgcttaaaaaaaggtttaggatatggtatagctattatctgtccgaatccgctccgttttcacccctacttattatatcgtgagctgaaaatgtggagataaattagccggttcgttagatgtgaaattttggcggcagtctctagacggaaaatcgagattggcgggaagtattttcatgtaaattgctcataaaaaatagtacggtatttctttttcaaaaaactacgagagcccataagttaaaaaaattggtccacatgtaagtattaaattaaggtaattttgattttgtttatatatataacatgagatttaattctacattcttgtttttgagatggaagtttgatcacaattcttttataaaatataaatttatagaaatataataagtttatgagattaagaaattactttcaaaacaaaaatgtacatgtatcatttgttatgtgtgcaaactatcattttcatttatatttaaagttataataatttagttggaacttg

SEQ ID NO: 54631 - DNA, 1501 bp, Oryza sativa
aaagctggtggcaaagtgaggtgcgacctgcaaaaatattaggcacagttgtatatattagtacatatagattaattatattaatgagcatgtacttatggggatacttattactcatttacctattggagatgcaagcctaggagatgccgattacactagcatatagactaggattacaggctaacttacgtgccaccgacttgaagagcggtaacctggcaccattcaccactgccactgacactgcctcctcccccctgagatcttggttcgtggcatctgaaaccccctcttcgaggctttgcatatcttcgctggtacccgagctaccgacgaccgtatcatcatctatgaaggatccttcttcataactgttagactcgtcatgagcgtcggagacgaaagctttccttacttccaggaccaccacgagtgaggtgagccacactattgcctggaagattgatagttgtaccacaatttgccctgcccagttgccatacatggccctcgccatgggcatgcccacaaccaaagaattggtgagtgacgcaagagaaaagccgcttatacaccagtcggtgacagcggcgcataatccctctttccggaatttcaacataacaccaatgctgattgcggcgactataattaactttgctatgctatcagccgctataaggctgcacctcacattgtagggatcaaggtggagggtaaattcaaaggtgaaaaatggaaaagcaaaccaaacgaccattctatttattgcttcggaatcttctgccgtgaagatttgccaccatcgcctggaagagcagtaccccaatgcaagggcgaaataaagcagtgttatcgcggacaatatttttccaatgtccacccaccctatcatcttgaaattggtgaaaaaaaagatgaacaacactaatacttcctgagaatgtttaggtcgacgagtgaacactgatatctcatgacgactcgatatcatatatatagtgaagactgatatctcatggagatattgttgagatcatgccgttatgagtttgttaagcatgcgcgagccaaatgcggtgagctgatgatggcgaccgcgaaaaaccaaattgtgggattcgttttcttcctaatcacccaaacttaaggatctaaccaaattgtgggattcgctttcttcctaatcaccccaacttaaggatctaattgttgagatcatgccattacgaatttattaagcatgcgcaagccacatgcaacaagctgatgatggcgaccgcggaagcgactgtgaaaaccaaatcaaaccaaatcgtgtttctcttgcagaatgtagcgtgtagtttaggaaaaactgtatttgggatggcagcttagagcatcatcaaaagcatcctaaaattctatccccaacatttcagttatggtaattctaaacaagatttgaggtgttaaaatttttattcctgcaacagattagctataattgatttcc

SEQ ID NO: 54632 - DNA, 331 bp, Oryza sativa
tgcaaggacggcggcggaggggctctctctcccgcgttcacggtcaagacggtcgggacgtcggcacggtaggagctcagggcatggcgtcgacgccgactggcggcgtccagatccggtgctgtggtgcccggatccggtcccccaacgacggacggcggcgtcctggtagctcggcggcgagttttggcggtgggtttgggcggtcacgacctggcgggagacgctgctggagctagctccggtagccgagcacggaggcgtggccggacgacgggtgtggtggtggaggtgccgcgagagccggtggtgacgtcggcgatgcgggagg

SEQ ID NO: 54633 - DNA, 393 bp, Oryza sativa
accaccactcaagctctgccgacatgtgagacccctgcaccggcgtccccagccggccagctttcgtgtgccgaagaccgcgccacacccgccggcagctcctcctcacaccgaggtcgcctcctccaccaccggccgagcctctcgcgccaagtcggcctcctccaccggacacgcctctcgcgccaatccggcctccctccatcggctgcgcctctcacgccaagccgacctcggtctccgccgcccgcgcctctcgcgctgagtcggcctccgctgccatcagctgcgcctctctgcgccaagctggcctccgactcctcctccaaacgatgccacgctggccagatgcagccgtctgccacaccctcgactagccgtccgaagccgcca

SEQ ID NO: 54634 - DNA, 1501 bp, Oryza sativa
ctcctggcccttttactcccgatggcacctctccctgagcagcccctccgtcgacgtgcatgggctgcatggcgttgttttccatgtatttcccctgggcgtccgctttttcctgcactctgtcatgttgagctggtttcagcatctcccctcctatttcgcccccttggggctgattctttcccgcactaaccatctccttctcaatggaaaacaatgctttcttagcctgttcaggtttgtgcatctgaaccgatttctttacaggactcgtcacttcctcctcctccccatttctggcctctcttccagtaactactgccccagaatccttcctcctccaagatggtgcatcactccccctactactgctatccccagatcttctctgcgctccccccccttccacccaattgtctcatgttacttccctcctcccacctcctcttttctgggatgaaccgcagttttttgctataacgttgctcttctccctcctttagctgcacactacacatttatcagtatttaagttccacactacattttaaatcaggtatcctatatgatcccacatgtatagcagaagtacggtaggaactcatacaccaggggacaccatatctccttcttccccttcgccaaactcagagttacaccacgcatcaggggtttacgaatatccagacgaacctttatacgaaggaactgccccacatcagtgccatccttttccgactccattcgcatgaattcacccacctctcccccgatcgctctccctatggccttgttcatcatgcataaaggcatctttgaagccctgatccaaataggaacaaaggcaaacaccatctcctccaaaacctttgattcatcataatccacgacgatcaccagatctttaccaaacatccagggtccatcctccagagcatgccgcttcccggatgctgatgaaaggtaaacaggaaatggttctcgcctagatctctgcacgttattcccctaatcagacaccagatcttccccagtgcttgcgccaaaccctccgcgttcaccactttctccgccaggaccttcccgatcgccttcggatcccctgatcccatacttccagactccgcctcgcagatccggatccccttcttctctgcctccgacaattgcatgcgcttcatcagtgcctgcatcgcctccatggtgccctccgaaccctaaaactacccctccccggctagcaaggtttggctcggctccaaaacagagaatctaaccgtggacacagaggaaggatgggatgtggactcaggatctagaccgaagagatcgatccgactcaggatctagaccgaagagatcgatccgatcaggcatgagaccgatggggttgagagaagattgaaaccctacccacgcagaacccaccttgagtcgcctaggaaccctaggcgccgaggacatggttggctaaaataaatttaatatcaaagtgaacaca

SEQ ID NO: 54635 - DNA, 911 bp, Oryza sativa
taccagggtgctcaccagcacagccgtcgttgtcagcacggtggtgctggcgtgcacggtacccctttcttcagctacctcatgccgttcaacgtatcttcgctgaacttcaccattgtcgtgttgttcccatgcctgagctacctcaagatctacatgcctcgatttggagttggccgcttcgaggtggcggcgatcgtcggaatactagtcatcggagtatgcatcgccttcgttggcacctacacctcccttcaccagattatatgcacagtttgattgtgcatttgtgggtaaggttgtaggttttggtagtgattaaatatgtttcaaattctttttttacttttttttcctgaaaaaacaacagatatgttatacagagtgttaagaatcaactgagtggctatatattgcatgagtactcctggaatgcatttgtgtattatcactaaggaagtttcataactttcattgtcttcttgttgactaactatcgcagctaaaaattaaattttgagattagtaaagttttcagttattctcaaatttttccatcattgtttatctttttctacccttagttttaaatcactagtaatacatgtaaaagttgggatttgctatatatctgtctacaattttttttggttttatctataaattatttttggtttgttttgttcaaggcttattagcctagaactaaatcttatcggttctgaaagtatggtgaaatatgacgcaaatgtccatgcattttatgagattatttttttacgagagatcggtagaatatattcccttcattttttaatagatgacgtcgttgacttttaaataagtgtttgaccattcgttttatccagaacatttatgcaaatgtataagatataaatcatgcttaaagt

SEQ ID NO: 54636 - DNA, 1501 bp, Oryza sativa; identical to SEQ ID NO: 54622

SEQ ID NO: 54637 - DNA, 1451 bp, Oryza sativa
tcggacgtctatttttcgattcaacggtagtttccactgtatatatggtttgcactacatattttcccccgtttcaatgagtagaaatggataggcaacttttctttttcaaaaaaaaaagattttctagagaaaatgagctaagcaatcgacattgcggttcattccaaggtttcttcgagaaaatgggtcgaacccttaacattttgattcgttgtatgtagggttgactatgcttcatcttttgtcttctatagttttagcaatacctaaattctgatacttttggctatatcactgggaatggatctagcctaaagaatgggaatttttttaactaacaactatttatctggggaattttctattttttatgcgagagtatgcagtatgcactgcacacgaagtgagggagggaaggggaagatgaatgactacacttttaagtaataaaaagagaaattagtcaacatagttgacatcattagtatccttaaggaggttgggataaaggtagcctaggcatgagtgacaaaggtggcaagacaataatggtaaggctattaaaacctctatgcacgttagtgacaataagggttgtaaggtctaaatgatcatgaggcattcgagacaaaagtgacagagggaaagaggaaaaagaaacaaagtataaatgtatcaggagacgacaagcaaccgaggagcagaagcacacggtgtgcccacatggaaatatttgagaagaaaaaaataactatgactatgatagaatggttaagggcgaaaccactggagaatagagggtagaggaacacatgtgaggtggtggttagactacccgtagaaagatcttgggcggtgggccagtggctcatgtgctcaataatttcttgtctagatctcggggcgaatgtaggaagatattcattaagacggaacaaatgtgaacaatcgggataagagtaaaatttaaccaacgacttaaaaaaggctaaaatattagggaattatatgcgggaaatgaaataagcaaagtgattttattttgaaagaaagaaaatgcataagtaggaatcaggaaaaaaaataacgcctttctcattcagtgcttacgtggcaccagtataagcaagccacgtggagtaccgaacagggcaccacattccacatagatagcctgagtgccacgctaagtatacaccgtgtatacctggatgatacgcacgtgttttgttggggatgggtctaattttgctctgcgacgtggagaactggagatactcagctatctcgtgatttaagctcgccgtcgtctcgtcgaacaacatcttgaggatgttgcgcaattttgagcaaaagaaacagagttcttcttctacttcttctagtttggtgcacgtggccatttgacgattgggtgtaaatgtgtaatcggtaatcctgcccaaaga

SEQ ID NO: 54638 - DNA, 1501 bp, Oryza sativa
aatatttcaatatatatcttcatcattttttataatatcgtatatacctatatgattcatcctcacttagttagtattatttttctcttctcccattaaatcatatcatatcaattgttttttttgccttacacgattaatctacggtccaaagtatctcactccctttcttctctcataaagccacatcatcttacttttacatttgaatcattattatatatatctatttaaatttaaattatcataaaccatatcaacttatgtaagtttatattgtttagctattttacacattatttttacttattgttattatactgaactcccgcagcaacgcacggggttttacctagtataactaatgaactggccatgacgattcaacaaatacttcctccgtctaacaaaaacctcctagaacaacatacatcaatctaggaggggtcacatccacttctaggttgagtttttttttgatgaagggagtacttatttttctttcaattctataaaactctaaatgatacggctggtttaacaaatatattttcctggaatgttatttaccatcatggccactctaatgcacaatatcaaacatataaggtttcataaaaaaatatataatgttatttagataatatcctgaagatataattaaatcgttgtcatccatttattattgtatttttttatccgttgcaacgcacgggcactattctagttttaaacctaaattttaaaacccattaaataataatataataggctataaatattgagcgcgccaacgggcgcatcgattttctagtcccatccaagcaaggaaattacgaaggaagcatgtatagaaagatatagcagaacatgcagggtaactagcctaataacaaaaattgggaaaaaagagaagaaattataggaacgtagctaatttctcacctctcccaccaatttgtagatcgatgtcggccgcggcgtgcgcaccgcctacaccgctgccgcacgcccggaggagatataccggtggagacgcgcgtgacaacgatgatgtgacgagctgtggacgagagctctcaccggccggggttatggaagaaggttaaaagaaaatagcgagagaggattagatctatatatggaagaaggttaaaagaaaaaaaaaggaaaggtagggttaggaagcgcgcgtgcggggaggagacgccgttgcacgggaagaaagttaagaggatatatatacgagttccgttccaaacttccgatcaggtagttggaagttaatttggaagttgttttcggattaattaataatttaaaagtcaattaacaatccaactccggcacgaactgggcttcgatcagccttacatatgtttagcctatatatgtgcgtgtgtacgtccggtgcatgcgccaccgtgacgtctgcatctcgccggtgtagctaggttaaacatggccatggccggcggcggcggcaattcgctgccttcgc

SEQ ID NO: 54639 - DNA, 1501 bp, Oryza sativa
gacaattagatctgccgagcaactttagtggtttcaagcgaaagaccgaactcggggatttcgagtagagggaaaataggaaagaagggaatctgagggaggctgagtcgaaaagatgaagcgggttttgattcgatcgcaaggttccaagggttcggggaaagaaatggtattgtggcaaatgaaagaattttgggacttcgatcagtttaacatcgaagtgcttgacaagacaaacgggggaaagagagggtaaggaaggatgtcggtttgggggaacactctttaggtggatcgatttatctgtgttattctgacggttcaaggaaaagacggggtactgtaaccgtctagtggagttgaggaggaacagagaacggatattacactgagaggcgtttccagaaaatcactgggttcgagtatttgcagatgcccgaataatttgctcgaggagggtattaacttaggaggaggatcgaactgtggaattcgaatctggaggaatcccaacaaggattgggattcacaagaatggattaacggagatctttggcacaaacatataaatgcacacaattaacacaaatctcattatgcgtgttgggctaggcctttcaaggaggaaaaactagacttttccgtgaatcttttgaaatgaattctttaaaaattttagttcgcaaatagggtttcactagtaaatttcctctagtttttatttgtaaaacaactccaaaatagttaacttctagattttcagaggttagttaacattagccttcattgtaaaaatagttttccagggaattatcccttacaatgatgttttctaatatctagtatttgtttttatttataaaacaaatacatcaaataggttctaattcatagaaaagggatttcagaaagataattgtatttacaaatattttcttaattaatacatttcataatcatggttcttttaataaataatatttgaatctaaaatagattttgtccgtagatttttgtccttgtggtccaagtgcaacagaaaatgggagataaaatccagcgtgacggattttagaaaagttttttgataatcctgaattttgttcccgtaatctagatttgaaattttcagggtgtcacacgccggcagcggcatttttttttcactgaaaatattttcgtagtcgggtgaatctaccgtctaaaaaattatttatctatcttcataggcgtttccttacagacagaatacccgtacgtaaagatggatttggcttgcctgcaaataacttttttcaagtagtggcggcacggtggctcaatatcgcacaattatcttggcgtgacgtctgcgtcgtcacataaacccagctgtttgtcgacggcgttgccaaggttgagcatagtcagcggtacaggagcgtggccacgtcactgctttagttcgttgcaagctactactccctccgtctcatgatataaaatataaggattttgattt

SEQ ID NO: 54640 - DNA, 1133 bp, Oryza sativa
cttctgacctcactgtaaacttggagacaacagacaaatcctattttgattaccgcagcatctgggagtaaatcgaaatgaatattcaagtttctttttatttgcattctgagatggttttctaaacctctagcacaggccaatgaaaacttcgtttttagcttaattatcccaatagaaagatgcacatatgtctctggtatttaaccatgtgtagtactagtacatttctagctcatgccatgaacctgattttaggtcggcacaacaacttaattaatcggtctctgcaacgcgtgagacacgattgatgttgatcactgcctccaattgctggccttacatgcaccttaattaaacctgtcttaaggaagtctccaacctctcaatcactgcgtacttatctatcctatcagtgccatctcgatcgttcgttttccttgcacactaatagtactagctctttttctttactttattaactgctaattaaccagtcaacacaatcaacacacagatgtacgtcagagcccagctagctttacatgctccattggaatattacactttgaagagaaatatggtaagaataattaaacctagcttaagaccagtgatctctagcagataaacatgggctgtagaacgacgtgtcaaaggtaattaagctggttattaataaccacatcttgcgtgctctgagatattgtaatatcttggtcactttctgttcctagctcactgctcacctgtcgaagaaatggccatgttgttctgaactttcagacttcaccttgcccttactgtttcttcacctggagccatggagatcagatggacatttcctactcgacagatgtgatgtatgaaaggtttgttgtttctgattcgaatggcatgaatttatcatgatgtgagagagatgagctaggatgcatgaacatgttcaggaaaatgggccatatctttgtcccctgtggtggttttcgaattttttttatttataattttttttattaaaagttttacaaaaataattttccattttgaaaattgacggaagtagtcgcctaccgccctctgggagaaaatcgccctctcaaagggcggcgaaaatgacgtggcagacggcc

SEQ ID NO: 54641 - DNA, 1493 bp, Oryza sativa
ctatgagttaaaatttaactcggcgattcactcatgagttaaaatttaaaaattttactggagttaaattttaactcatggtgacgtggacgaatctcggacatctatttctcgatgcaacggtagttttcaagtttccactatatattttccttttttatagatgcatacttttgaagaagtccataatggaagagacaagtagactatataattaggagtagaatgctagtggatattgttaattgtcaactgccaaattgcccatgatgattgtctgtccagcgacggattaactacccggccaacatgggcagttgcccgggctgcgcgtgctgacccattgagatggagttatttatctactttaaaatccatcgattcgttgacttccggacaaagttgagcaggctgacttttcattatacaattagggcctaaacaccgttgttgatttgcctgtcccgtaatggaggacgtgacctactcaactagcatgcatatgaatcgtctattttataataaaatcgtcttgcttttcaagctatagtgaaattttacatgcatattgaactgtttttttttagaagattgttctgtcttcaattgatagtaagccaagaggttaattattgcgaatagttgctaattgacatcttaatttatgtttatgtgtttttttacttaccaaatcaagatttgacaggtgagcatatatacatacactcgactaatcgatccgacataatggttatagcttcttcaaaataaaggtcgaaattcgcttcattatataaaaaaaattgattcgacgtgtacgctcactggctaactagctcactgatcgtggcctatgatttactcaagggcaagagatatataatctccttaattcagagtttcacattttttttggagcaataggtgttaccatattcatatatatctcttgccaattatatagatcgacattggaactggtctaaattaattaattgatctttgaattgtcataaacttaccttaaaagtatttagagatggacaaacctctgtccttaaaattatttttaatcctcagtgtggaatctctttacgccaatttatatagcagtactaaagtttaggttgtcatgaatgcacacatgctgtttactatatagagatgggcaaagatctgtccttcaaattatatttaatccttgttaggtaaccctgttcttctttctccttgctaataataggtattcggaaattaaggagttgctgaagtgttagacatgacaaattaccttctgaaaaattggaagatcaaattataaatgtttgaatcatgagagacgctccgttgccctctacttgcagtattctactccaagtagaattaatctcaaccgtttattttaaagggtagattagtaaagtgctaaaaccgaataggggtaaatctggcacttaatttttttttctcatttgtgcgtcctatggtcaagc

SEQ ID NO: 54642 - DNA, 1501 bp, Oryza sativa
tttattatcaggctttaacctttgtaagtgtaagatgagacggtgagagtcttaggccctgtttgggggagcttaagattctgagaatctgttggttggtagccagcttctgagaatctgggttttccagcttctgggttctagttcattttctggattctacaactatatattctcataatctgggtgacaatttggactgttttggggagctggagattctgagagaagctgcagcaactagaagctccccaaacagacccatagattaaggagtctatcttaattgatgtatttaacatatagagcggttacatgggttgacaatttcagattatctagcaaacggcctaccagataatctatatccgccgaattttaaagataccacatccacacagaatccatatcacactatccgcatccacatccatatctatcggatttctataaactcgtaccatattctcgttttgagcggatttggaatggatcagataagatgttatccgattcgttttcacaccaactctaacccgataatgcccgagcattatagttgtgtttggtagaatttccacttcctatctattaagcgcagatgtaagcattgcgttcctttcgatcgtcgtctgtcctactagtaccgtaagtacgtgagcctctgttaattacgacggcgactaagatcgaatgtgagattttatacgaatcaacagactaggacgtctatggtgagtagggttagctaggcaggtcgtgcagcgttcgcagcaacacaaaaaatatgtatggcgtttgtgcacgtcgaaatggagtgtgatagctagttcgtcgtacgtggaagctcttgtcaaacatcgtagctgcttcatcggcaggcgtgatgttgagaggtagcgacgttgttgcttaagggcccatttaagtttaagttttgcaggcccaaacttaacttttaaaactcaaaaatcatctctttggcaattagatccatcaaaacttccaaacaaaaaatttacttgtagcaaatcaaaccaaaacgaaactcccgaaacacatgaattttggcaaagtttgaaatttgagttttggttggggtgcgccaggctttggcggtagtgcaacgcttaagtgacgctcaagggctctaatggcaagccactattgtgagccccttccctatgaaaaataaatttaatattttttttgacatggaaagatttccattactccatagactcagtaatatcactggtcaccaaatcgtccacctcggatggggcttcattgtcacgcccagaaattcacgaaccagaatttctaagctgaatgtgcattaaatccctgtccaggaccagccagggtacacaaacgacaattgttgacatacatatccacgtcttacaaaaatataaaagattacaaatgcagcggaaagataaaagcgagctaaaccgggaagcttgacttcagcagcgggacgactccactccacagg

SEQ ID NO: 54643 - DNA, 1501 bp, Oryza sativa
atatagatcgagttctctctctctttccttttttttttgaaaataccgagggttatttgtcatcacgtaatcttataatttataatttcaggtaacatattgttccatcatgaaatttcataaaaaaacctatctttattcgtgcacaattgttgcataataaatataccatatatgaaaatatctagacccaaagtattgaatgaaattccatcttataagaacatcaaatggaattaactccttgtatttgccccaattttcttgtttgaatataaagttttcttgaacttgacaaaaatcttgataaaagtagttccagatcattagggttaaaagtagttccagatcattagggtttctgtgtatggttttatttggtgtgttttaactttagcagcacctccaaactccaaagtagagtaagaatgtcgcaataggcaggatggctagtgtggatttagtgatttttggtaaaaggtgtgacatggggggtccctagagcacggatagagaaagagtggtgactaaaattctaagcatacaagaagcatattctaggcgtatagccaaaaccatgggtggctagtgacttttgctcccacactgcttctaggttttgtagagcatcagatgaaagggatatgattccttggggatcttcttgaagttacactgctagttcagcatgtttggaggcagaggctaccccacatggtcactcgtttttggcaaagcgagcctcaccatagaaaattcttggtacatctaaattgcggtttgtagtattacattattattttcgatttatagcatcactccaaggaaaaaaaatactcgaagcacaagttgaaggaatatatatattatagattttatgtctttttcaagaattacaataacgatgaagaactatatatatggagatagttccaaattatgtgtgacaaaggttgatggttgctccaagaaaaggaacaagtataggatattttgtgaattatgctttgttggcaattttattatcttgggccataagttatatttgcctattcgagattccttcacttttgagaaattttgccgctggaaaaagaaaaaaaccaagaaaaataaattttaaaatatatatcttagaagtatgaagattatatgtataaattaatcttaaaaactatttaaataaaataatatatttattgatatttctatatacattataactgggaatagtggtcgaagttatttttcaataccatgttctcgttcaaaacgataattatataagctataggatattattaatatttctttcttggaaatgacctctcagcattgaaatggcaactagcggccagggaagaaaggtacaaaattgcaaagtcatatcatggaaccttgcatcacatcagcaaatcatcccaaaaagaacagagcacacaaacatgcaggaccattcttttgacatcaatatttcttttctttttggctatattcttcc

SEQ ID NO: 54644 - DNA, 1501 bp, Oryza sativa
taccttatgctacaaatcaagaactcagggcagtggtaccggtagaaatataacaacgcgtagcaaatacaggctatatgttttttttaagacaacaggctatatgttagctacaagtaaatgtcaagaagagataagcgtagagaggagaaaaacgagctatagatatagtcagctgtgacacacggatttcaatatatcatgtatttacgtgtgtatgcgaggtgatcaaatattgatagtaaaatatatatttataaatttattatatgactaagctattagagtgaatgtagataactactccctccatcctaaaatataagcatttttttttactctaacacggtctctgagatgctattttaaccaacaatatctataaaagtaagatgttttaaataaaaaaagttaaatattatgatagtttttctaatgataaatctactaatatcaattttacatgattgatttttttttatttttttgctgttaatagttaaaattaaaaacatttgactcgtcactatgctaagaatgtttatattttgggacggaggagtattagatttgttcttattgcggtaattaacatcgtcgttgacttgacatgaccaagaaagtgatggtgtaagtgtaatcaggagaggacacacacgtggctttcaaaccgctaaaaccccagtggcacgtcactaaaacctcaacttcagctctggcattacaagctcacggtcatcccttagtccacaagtaaaactgccactaaacaaagcaagaggaattaaggaaacttgtcacaatatcactgctcttctcaaacccctaggtcttctccacccaggagcgatgtttatctgctcaaggtaccaaacatttgcccacataacccttgtaatgttgagctacaacctatattaccacttcggttttaggttagaaaatcgttttaaaacaataggcgttttggtcatggttcttttttctccttagtccgataatatcataactatgtgtattcttacttgatttagagaatgatatttccctcgaaatctttgtttaaaacgcgtgatcaaacgatccccgtgtcacttcatattgcatagtgctcaacgaaatggagccaatcatgcaccaagataatctcaatgctaaatcttgctcatatttgttccctctcatttgtcatttttgtcatgcatgtctgcctaattccatcatggttttgtcactgttccattattattgcaatggattctctgtatttttttctttttcttttcctctgtagtttagggtgtggacctaacaaaattcatggctgcctcccaacgtcaaagtcgtctcttccgttctccctccacttctcgggatccctccacctctcgtatttctactccacgccgccgccgatgctgccgcggcggcggtggtggtagcagcagtctcccgtctccggcgatgtcagtgatgccttcgataaggcggctcctcctcg

SEQ ID NO: 54645 - DNA, 1501 bp, Oryza sativa; identical to SEQ ID NO: 39534

SEQ ID NO: 54646 - DNA, 1501 bp, Oryza sativa; identical to SEQ ID NO: 39541

SEQ ID NO: 54647 - DNA, 1501 bp, Oryza sativa
gaaacaactcccggataattaagaaacctgaaatctaccatataagctattatctcctgcatggctacatgattgcattgtgtaacgtattgtaaagaaatgcaaaaactagggcttctgtaattcaccttgactaacttgtagagtttttgctcctcttcataaagtttctctagtgttttgccatggtaaccatatccagaggcatcacttgaatgcattgaggattgtctattagcttgcgcagatttgaatgaccagctccaagaaattgtggaaaaaaccttggcggatttggaattttttcctgcacctaggacaacaaatgttattctctggaagtgattgcttgcgaataaacacttttcttgtcctttcgtacttaactttactgtaatagagtaaagaatagaatgttcatgatcttgaaaagtttagtacaaccaatcatttcatttcccatggatgtagctttatatctatatatgtgtttccaggagttggaattataaaatagtagcattaagaaatattaaaatgatggcaaacactaaacagagacaagatactgtatataatacctctgtttgcctctaactctgagggatctggctgcccaccagaagagtccaaaagtatgacgatgtcactcccactcgccgctgctttcaagaagtattcatcaatctccttggcaattcctgccagcgacttcttactcctccaggccatcgctgaagtgtctgagtcctttgtcacccagctaaccattgatgaattgtcatcacctagagccctactcttggcttgattcaactggacactgctcacaatgccttcaacattaccagacacactttcatcgtcatatccatcaaattctgtgttagtctccacccagttatcatcatccatggtcacctgtgaggccgcttctttatcaatcctatcagccaatgaagatggaaaatttaagggacgcattgcaaaaggttccaagtactcccactcaacccctggtggcgggggaggtggtagaggagtcgagcagctgtcagtgtcgtcgtcgtcgtctgtagaatcatcctcatcaagttcaccgtctctctttttcctccttatcactattggactaaacggtagcggtggtggagggcgtggtgagggtggcaatgaggatgtcatcgagtacggtggcactgaggatgtcactgagtatgcaggaggtactggcaccggtggtggcggtggaggtggaggtggaggtggtggtggtgatggatgcactgcaatacctgcagggggctgctgtgacaatgcagactccacctcggcgaattgtcgaagtgtggctcctgtgtttcggagtgactgcaggtaggcggtttgtgcagccgcaagctcaactcggcgccgcattagctgcttcatcagcttcctcctatccttgcacctcctgacggcctcctcatcctccaccttggagtgtgtgcaacccatt

SEQ ID NO: 54648 - DNA, 1501 bp, Oryza sativa
ttaaaaagaaagtgccttggtttttcaaatgccatcgtgcctgctttgatatttgcacacggtataagctacaaaatccctcctcgccaagctagggcatcttagaaacgtagggaaaaaaattatatgccttttaccagaaatagttcacttccttgaaaattctgtgaaattcctccaaactgaatgcactcttatttgggttaagtagacgtggaagaaagaaattaactcttaaggtataggaagaatggaagaaaatataggtataaaacttttcgttaaatacttagtcatagaggaaaacattacttatacttttatggcgaaaacacgattataacaattcacgaaatataagggattgttgaaatgtcatatttgcacagtcaaaataaacaacaaatggtatgtttggtttgcgatctttgcaatttgtttcaaggtaaccaagactacataaacagaaaacagaagactagtatgtatatttacttttaaaagtaccacatgctattttgtacaagtatttcaaatgccttagtcaaatagatgacgtacatataaatctagggtcctagaaaatatttagacctaaaaagtatgattacttaaaacatgttacaaaacatagtactctgtatcccccatccgaaaaaatgctcatgtaaactttaatttgttttcaagacaactgcatagaagccgggcggtggtgcctatgctgcaactcgatttgaacactttcgtatctctcaacataagtatatttcatgagaaatgatcggacccctatagccaacatgctcgtattccaaaagctcttttgttccaaaaagaaaaagtcatcgttatttcttaaaacatttgtcttttgagtttttttagcaatatccatcatcatccatgtcatattgtcacgagtctatctagcatgtacgtagacatttttttctcttatactccctccgtactcgtaaaggaagtcgtttaggacaatgtttaaatcaaaccttgggaatataaatcatgaataactctcaagttgttaagtctgaaaatgtaaaagttatatgaatagatttgtcttgaaaaatactttcataaaagtatacatatatcatttttcaataaatatttttataaaaataagaagttaaagttatgttttggagaccgtgttgctgtccaaaatgacttcctttacaagtacggagggagtatatgtatggtcaaaattaaaactctggcaattcagactcaacgatgacggtaaaaattaaaattatggcatctttaatcagagggagtaacagtatataacaattcagacgtttcaaacgtcttgtccaacaaatcagaagctgtaacaaaatgcagaggaatacgcacagattagattacagagcattattcccatacgtcaaaaaaataacaaccaagcaatgaataaaagcatctgtcatgtgagacttgacattcagtactctgatattggaac

SEQ ID NO: 54649 - DNA, 849 bp, Oryza sativa
aagccgtcatggtggccgaggggaacatcaagttgggcggcgctcgccgtcgtggcgccggccgccgtggcctcacgctgtcgtccggttcccctcctcgtctcacgccgcgcgccgccgtgcgtgcctccgcccatgagagagagaaagagagacattaggaagagagatagaggggtattacatgtgggtcccaccatttaaaaaaataaaatgctgtcaggactgccacacgtacgccacgtagaccaaaatcgccgtggattgggtcaagggcgtaattcgtccggtttgcatagttgggggtaaagaatatccggttttatggttcagggggtaattcggtcgaccgcgatagttcgaggggggtaattcgtactttttctttaaatatatggtaatcacttgtttgaaataaatgccttactgttccatagtacaaaaaatatcataggctgatttgtaaaaactaaaataatgtgtgtcactgtgcttgtgtttttttgaaggagtacagaaaaagaaaagcacttgggggtgggggggggggacaaccagcgtgcacgtaacaaaaaccaagcacaagctggcgagggaagggaaggaagggggagggcgaaagtaggaagggaagaggacaagtggagaggagtttcggtggcagtggaaagtggcagttctgaccacattccctacaccaccaccatcctcaacctcaatccccatccattccattccatcctgcacgagttctccactggagtggagatccgtactatacttttttttattattaccacctgcccgcaaaaccaaatccccgcaccttcctctttccccttctttctc

SEQ ID NO: 54650 - DNA, 1501 bp, Oryza sativa
ccgtgcgtgcctccgcccatgagagagagaaagagagacattaggaagagagatagaggggtattacatgtgggtcccaccatttaaaaaaataaaatgctgtcaggactgccacacgtacgccacgtagaccaaaatcgccgtggattgggtcaagggcgtaattcgtccggtttgcatagttgggggtaaagaatatccggttttatggttcagggggtaattcggtcgaccgcgatagttcgaggggggtaattcgtactttttctttaaatatatggtaatcacttgtttgaaataaatgccttactgttccatagtacaaaaaatatcataggctgatttgtaaaaactaaaataatgtgtgtcactgtgcttgtgtttttttgaaggagtacagaaaaagaaaagcacttgggggtgggggggggggacaaccagcgtgcacgtaacaaaaaccaagcacaagctggcgagggaagggaaggaagggggagggcgaaagtaggaagggaagaggacaagtggagaggagtttcggtggcagtggaaagtggcagttctgaccacattccctacaccaccaccatcctcaacctcaatccccatccattccattccatcctgcacgagttctccactggagtggagatccgtactatacttttttttattattaccacctgcccgcaaaaccaaatccccgcaccttcctctttccccttctttctcctcccaaaaccgctctctttcttctcccaattgcccacctaccggaagagaggaagagagagagagagagatgggttcttgcggattgaggagggtcagatgatgccattaccaatttaacatcttctgcatcttttttttgcctttcttggcatattcttctcttctggatgtgtagatccttctttccccagtcctgcttagctttcaagcagaccaacaggtccgagattggtgacctgggagcggtttcttgaggtgtggtgccgttctgggtaaggtaaggcaacgaggcgccccacctcgcgcttctcttgaagaatctgtggctcttttctttttttgggttcatgtccgcttcttgtttgttgtattgcctcgctcgctgtagctgatatcttgatacctctcgtttttttagatcgactctgttgccctgcaagaattcgatgcaggagtaagggcggcggcagtatgtaatttggtgggcggttgttggagaagaggagcaattttgcccatcggtttcttgggtgcaaattgagggcaaatttcggtgaatttcgtcggaaattgaggaagcccgtttggcaatcggtcctgtccatgtcccatgcctagaagctggggcattttgggtgtgaattgtgacgaattccagccaatttgggttgggccaggaaagtaccctttgggggtttcagtttgtggtgtgatctgcaatctttccaagattggtggggagttctttgtgtgtgctggtggcaaa

SEQ ID NO: 54651 - DNA, 1501 bp, Oryza sativa
gtattttactattcacctactgcagaggatcccaacaactataagagacgaccatgccattggcagcttcattctgaaacgaggatagacgatggatcgtaaaataaattttaattttattccaatacgttaaaaattgattcaaaaggtatttttgaaaaagccaatgaaaaaaagttctatttctttccttaaaacccacgccatttataaggatgtgttctttatcgcctcttcccaatttatatttcctctttttactcttatgtttccacaacctgaaataattttaaagaaccatattaatatatatttaaaatttattttaactaatatttaattaatcacacgataataaattgttgcgctcatgtgcaggaaaccttcccgtgagaaaagaagacagccaatagactctttttggctgcagcgcagctggctgccggttttgctcacagatctacggcgcccccagcctggcgctgccgtcttctcttctttccttggcgttccttggcgttttgccggttggcgtttgtctgcattgccggaagatatcgtacccctttttggctcctcaaatctatgtcaggatggtatttcagccttttaggagctcaagttgcctgtcttggaacttggaagacaggatggtattttactttgttctcaatgaaatgattagtagcatgaccagcgagctgaaaattgtcgtaatatgtgcacctaatattcaggagtagaggataagtttatacgtgtttaagattacacttcaactcccactattggtgactccttcagacgaaaaaaaaaagtatcgtcttccttcctcttcatctggcccttttcctccatcgattcagtgactcagttcaccggcgagaggggagagtccaggtagtcaggttcttcccgaagtaatgttttcctctttgttttctttttctttttgatacatttgtgtagtgtaagaattcggcagcgtcacatttctcttgtcccggtagtcatctatagattccaaccaaatccattcatgaagtggtctccgggtttggcatagacgcttccaaggaaaatttgcttcacaaagggttgcatcggtcatttggttcatttataacaaggcaaccacaaggttgcaatccttcttcatcactgacggtgcatcttcaaagagaagcagtattttcatgattttatcatggaagccttaacctccaagtggaggctccttgtaggtatgcttccttgcaccttcatttttagctactcttagtttcttcatcatcgttgcagctatggatctagcttgctatctagtagagaaaagaaggacttgattgccttttctagtttcttataaatccttcctagcaaatttttaggagcttatcttaatttgatcatcttcaagtttttttggcaaaaactgcttgtacttagagataaattccctacgaggataactcagttacctagttaggaaaaattatga

SEQ ID NO: 54652 - DNA, 1501 bp, Oryza sativa
aaatcatattctaaatttaaaatatgttgcttggtattataatcctattatcagccagggcaaaaaaaaaaaagagcatcaagttaaagagtggtgaaattttcaattgtacttgttattaatatttaaatttgacacttagacatgaaatagaaaagcatgatgatatttggaaggactcggttttcaacacgtaaggcctgtccgaccaacgacagggacgtctccatgaatttggggccctagggtgaaatacacattgagggcctataatttttttttataaaagcatgtctaatataaataaaacatgtttttgttcaattaaattatatagatgcaatatgtgctataatgtaccatattttgaaatatatcatatgataataataataaaagagtgaagaaggtaatgctgacctcatgtagtcatgttctactaaaagagtgaggagggggagggggagggggagggggagggcaggagccaggagctcagcaagcagctgcatactgtagagctgctcgaagattagagtccagggccatcgccgttgccgctcggagtcacaggctgtattgttgcctcgccggtcaacacggtgcggaattaggatcgacaatctcgtctcattctcgtagcagccacggcgcacgcaatcacggaattaggatcaatgcgacgatgttgcagtattgtacgcgtggccacctgggcttgacgatttgccttgcatgttatagttgtgggaaatggactttgggtcgtcatcttcatatgggccccgaaaaatcgtaggtcctgtgcagtcgtctatttggctcttgaccattgacttggggctggtctgaccgatggcatatggtcggtaagacgagctaacctcgactccaagttgaattacattgattctttggttttttttcttggaaagacaatttttttattctaattagtttctatcccgagtaagacgtaaaaaagatcctctagaacgtaaaaccaacccctttataatggctatggttggttcaattaagacacaatctactccaacacagtagccaattaaattactttttcagcatctcatctactttttatctagttctagcctagttttcatccatcttcgctggtttgcatcgaaaactacccgtcttcaccacgagagtgcgaatcctctctgtgtaggtttgtcctgaaaaccttccgttctatccacgagacgtatgtttatctttcatctaaattggctccactagccggtttaatcttcaaaagctatctggatttagagttttttagattaaggtggttggcgatttgatatcatcacaaagcattaggtgttttaaacgtgtttgatggcatgaaaaaacaagttgtgtactccctccatcctaaaatataagcatttttggatctggacacggtttccgagatgctactttgaccaacaatatctaataaaagtaaaatatcttaaataaaaagagt

SEQ ID NO: 54653 - DNA, 1501 bp, Oryza sativa
ttataaaactttaagagtattatggtaatgtgccaccaatttaatgcctagttttttaaataaagttttgactataaaatacagggtttttttttctgaaatttactcgtttagtcattaagtaaattatttgtcacatatcatctattttattatagagctaattaaataatttaagaaataatcttaacaaatagtatcttaaaacaagtgatttaaacaataaactgtaagaaatttctttgaaaaatatatttttttgaagggtagagcaaataatctggtgaataagcgaaaagagcaatgtcttattctaattgagaaaaatcaactaaaataaaatttttaataaatactacgtatttagtttattttattaatactactttcttggagtgactcatgcccgtcactatggacaattatacggtacctcttagaagaggctgttaataattgtgcctccggcattaaagtttaggggaaaaaaagcagtatcgatgtataattgttttttttcttaatctgctaataaagaagcgtaagaatcacctgtgatcttactgatctattagtaattcttagatgccattcgtctgtttctttcatttgtcctctgttccgtcgggaggctttagtgggcatctggagcagtggagcccatgtcggctagacaatgccttaattcatcgaaagtctcgtttgcaagagaacattacttttgtccgatgtcctggtaaagcatacacagcgacgaaatacaatgatacactttctttttcccatgatcacacagctgagaataaccgatcagttgcgttacatgaattgcatgcgtaattacactcattttctctttgatgccaaactagctcactccagaacaatggcatatatgctcggagtatcttgatgcactatgctgcagcctaactgaacctttgtctaaaaggtttcagacaaaggacgtatgatttgcaactactgacaattactctatttcctcctaccgagtactccctccgtcccataatataaggaatttttggtagaaatgacacatcttaatacaataaatctggatagaatatgtcacatccacccaaaatcccttatattataggacggagggagtagtatccaactaaacatggaaaaattgaaccagtagaaccaggaggttacaaaatctgtgttcttgtgtggccgtttagttaagcctaaaacaccaaatagcaccttcaacatctcacctggtagtgctgattgacgatggagctatgcacagattttccatccagtcttgtatgtacatcagcagcagcacatggagatcagaatctagctgccatgagtgccatctattcggcgatcatgacagtgcagtttcctcagcgccttcactaccttatagcatctccaacagtctttctaaatccaactctccaaatatctatttggccaactctccatctaatttagcaagtcaaacacgttgttt

SEQ ID NO: 54654 - DNA, 1501 bp, Oryza sativa
ttcaaagaccgaaaagaccgaaagaccaaagaccgagacagaaattttcggttagaccgaatgcccacccctacttgtgggtggcactaaccgtttcccaaacacactgacgacagatacacctaaacatgatacgaagtaaaaaaagataagtgttgggccaatttggattgctaccaaaaacatgccctaccaatattttggtaattgaatagtacttgcgtttgatttggattgaagcccattcattggtaatacctaatctagatttggcattatctagaacattctttactacaatttcacattttgactctatgttggtagcaaactaaatatgataaaaataatcttaacttaccaaatatttggtagtgccaaaacttggcactaccaaaaaattgatagggtaacaatccaaataagcccgttgactcgctagttctttagggtattgactagttctttagggtattgacacagtgctggccgaagctattaaatggcttcttttaacgtgagtagtaggtatggtaaaacacataaacggaaaaaaggtgattcttatacatatgacatttgcaaagcatagggttatgaaacgaaacgaaacaaaacacataaatgatttgaatagaccaccaaataggacgataatttaaggagaaaaataaaccaaaagaaaatttctacaaggttagtgtggctctgtgcccccccccctaaccccagctgattggagttgtgtttagtcatcgtagtagtctcttctttttttttgttgtgttttttttctcttttcttggcataagctaatctagctgattgtgtcgtgtaacaaaattttttcttttaatatattgacgtacaatgcttttgcgtgttcacggaaaaaaaaagaggttaggtccatgttaaatttcatctaaaatccttatgtattgaataattcaaaagaatttcacagtatcacaatcatctattaaaaatagaacgttctccatttcaaaccctacaaaactcttcgctaaaaattcgttcttcaaaaactgccgttaatgttccaaaacccatcggatattaagattgttcgtcatgagcttttctctaagattttaaaaatctcataactaattaacagattaacactatccttcgatgtgacatcactcagatctgactgtctcattctgagttggtattatgtcaataaaaagatgtctaattaatgctaaataattgcaaaatgtgcccacctaaacaaatagtagtaggaataaatggtcaaatttcatgacggtgagattttaaagcattattaatggaacatacttatgttcgatgttctagacaattattatatctgttttcaactactagctccgtttcaggttataaaactttctagcattgctcacattcatataaatgttaatgaatctagacacacatatatgtctagattagggatgaaaacggagcggatagtttccatctgctc

SEQ ID NO: 54655 - DNA, 1298 bp, Oryza sativa
tccgccacatttgaccaccgcgcaggatatcaccttcgccggcgccattgcctccccgcacgcgcgcgcgtgcaggattagggggagctgggcggggaggaatggcgaatggaggaggaggaggaggagaagaggggagaggggtggtggtggtggaggaggagggagaggcatgggtgggaaagagagagagagagaagaaatagtcgaggtggtttggtttcgcgcgtggtggtgaggttatgaatagtaggctagcctagcttagcttagctgggaggttgtttcgagtggccatttgtgttttacacatgaaatattttagtgctgttctttttgcatttacataggtgttaattcattaggggctgttcagattgatactattttaaattatattatttttgataaaattgtcaaaggtgtgtatacatttagcttcttgccaaagtttggtaaatacataaaaaaaatcctgccaaaattttggtaacattatcaacttaccgaaaaattgataagggttattttggctacaatctgattaagccctagtttttttttctaattatacggatgacgcatacacatcttacgtacattcctgattacactgaagacacattcacaccagtgtacattcttgattacatggaagatgcatacacatccctgtacacccgcaccacactcgtgcctgttttacacctcgtattagtaaacctttagatttggaaagttaatatactcatgcatttgcataggtgttaagccattagcttcttttcttttaaaatgaaaacacatactcgctcggttatacatgtgtatcacacttacatacctattgaaaaccttatccgtgcgtgcataatattcgtggagaaccaggatttaaacatggtcaactccaccatcaatgttagtgttttctcatcggtttgtttcatataatggacataagtaatgaaatatatccatgcaaatccattagatgaaagtattttttttctaagatgtggtcagtgcttataacccatgatagtatggaaccttgagaatgtgacactccaaagcacatgaagggcccctttgatttgtaggaaaaatgtaggaattttggaggatttcaatcctatggaaaaaaatcctatgaaggcctttgaaacaaaggattgaatcctattcaatcctttaagggattgaatcctattcaatcctttaagggcccttttaaatcgtaggattgagaaaacgtaggaataggaaaaacgtaggattttgataggaatgtaagt

SEQ ID NO: 54656 - DNA, 430 bp, Oryza sativa
ccctcgttccctaaataagaaagtatttttaaacatgtttgaccattcgttttattcaaaaacttttataaaatatataaaactatatgtatacataaaaatatatttaataataaattaaatgatagaaaaagaattaataattacttaatttttttaataagataaacggttaaatatgtttaaaaaatgtcaacggcgtcaacatttagggacggagggagtactaattaaaatctgcagggattgttgaaagtggatgagaatggacgcgtgacgcttcttgcttcgactgtcgaaggctccacgatcaggttatcttcctgcaaattacttgtttcactgcaaactactatgcaatttgcacagtgcaaatctgtaactgcgactgcgaattctctactgttcttctccgttcgtcgtcttcagg

SEQ ID NO: 54657 - DNA, 281 bp, Oryza sativa
tgggccggaatacctgcggattctgggcccactcctgcctctgtggtgcgttgctcacgccgccacgcgggcctcttttgggccgcaagaaagagaggcgagatgggctcctttgctcttccttgcagcggaagaagccgcgggccgtttcctcctccccgagaccaagacacaccaccacgccaccattcccacgcctcacgcggcggagagagagagagagggtgaatttgctagcgagatgccggaagccgaggccgcggcggtggtcaccggaggcg

SEQ ID NO: 54658 - DNA, 1501 bp, Oryza sativa
tgtgttcccgtgataaatgctgctttagaattagcgaattagcctttcgatatccaattggtgaaaattgttctggctattggtcgttatattcgagaagcagataccaactagtttgatctgatattctggctagttgtaagtcatcattgcacagcaatcataggctcatagcgaagtagaaactgtacagtaattagtagatgtgaataacacttgtgctgtttggattttgcctcagtctttgtagtaccatagtctaaaatcctaaactgcagctccaaatgcaaatgatctacttttactgtgaatgatggcttagcttaaagcatacttatatctttccaacaagctgcaccatatttatttttggagcatcgtgtaattttgatcattctttggatgagaacagaagaaaagggaactactcgcaatgcatgacaaagcaaagcgtcagaccgagttgcagacaaacagcagctagtcggaaagaaagaggtgatgctgacaggcatttgaatttgtacttttgtcttcattccttaatgatcatcaaactgatacgactttgcttcttttacagatcatgtcagcaaaatcatcgtgtcccttgacgagagcaattgaacttgccaaggaagtccggagtgtcaaggtttatcgtagagacagacagacaatgcataattgcagatgtagtacgtgaatgcttctggagagggatctcaacagataagtgtatggagctttagcataaggtatcaaagcgaaactcctcttacttcaggaggtaaaggttgggttggtctgacaaatgacaaatcaggcagcgataaattacggcagaatagctgcatagaaaattcttaccagtatttggtttaatttaccccctcgttcttagtcttttattgtgcctacaaccactaataaagggtgcagctgtttctcaaaattaaatccagagaacatttttcccctttgttttactgtatcaactagcaagtctaggatttcaacctaattttgtatatcagaacaaaaacagtgcatatactctatattatatttcccatttttatctcagaaggtacaaactttaccctgtatcattagacaatatatgattttgatcaagtgcttatagccgctcaagaagctggcattgatatcccatcacaacaatgaatttggagctggtagtaagagttcaggagggcctcattgaaccgtttcgggtcctcctgtggggcatatggccggtgttctttatgattttccaacctagcattcgcacgaaagtgttctgcatttgcattaattcatcttgtgtaagtgaaattacaaggtgcagcctcagcatgtaattcccctgcaattattttaatattttttttttgaaaaagagagcaaaagctttgcttcatactctatcatgttccataatactcgatgttttggacagggttaaattcaaacttttatatcattaacgaacaat

SEQ ID NO: 54659 - DNA, 1501 bp, Oryza sativa
atgaccttgtcacatagaattgctagggcacactatatttacatgccaatatatttatattgcattttcctacatctaagtaattagatttctcgtacaattcatacttgggtatgatattctcatggatagttggggatgtcagcaatctatagcttacacggtcccttatgaaagactctattggtcttattgtgctccttgtgagcacatttggatacacattcaaatagattaagataactcgatggaatgtataccctcaaattctttttcgataatgtaatcaatattaccctattatttttctagcatgaaaatctcagatcaatccaaaaccatgtccaactcaatagttatatatcataataatttacaactcgtccactcataaattatatttttttaaagaaccactcaccatcccttccctcctctttttcatatttgtatccaataaacaccttgcccattctcttgctcatccttctgtctgtttgacagattggaccaatttatcactcgtagttgaaaggaacaagagcgatttaatgatatcttatcacttgtaattggacttcaagcctctttttttagaactacttcaagcctaccatcatcgagttatgcctggtgtcgtggcagctcggtagagccatgatatcgactgcgcagcattgtcacgtgtgtcatggatctagctagcctgcctttggtgtgttggtaaggcttgaggccatggggctgcgggttcagctttgtggtgttcttgaattggtggttatgtctggcacatagggtggttgtgtgtgaggatttgattgtggaatgacgaaagctttgtcaaattcttgcaagctttgatgacggcaacaatcttgagcgtcgtcacgacatcccatttctccacacaagtttccatattagaatcttggtccgatttcccaaacaagcaacggcgacgtgagcgtccccatggaattgttgctttggagaatcttcttcctatgacagtggccattattaggaacttagtggcatcttggaccatcttgtggctagggttcaccttttcgtatcggaaattatacccgcttatcaacggtttatagaaacccgataaaaaccaacaactttcggtcaacacggtatgaaaaccagctaaaactgaccggttttgaaaacatagcagtgtgcacgtgttttccgtgtaacagacaaaacaaattaggtctaatgtctagtttcacgtaaaaccgttttgttctatcttcttgatgaaaaggctatcttttgctatttaactttggaaattgctatgcatatgacccaactgtccgactcacgtacgattgaatttgatcaacggttgtaaacggctgcagtgtatatgaatatgctatcatttgattgatctataattgcttgtctctagttgtacatgagttgtacaactggatctcatgagcaattttacggttcttaaggaggtaccaaaaat

SEQ ID NO: 54660 - DNA, 1501 bp, Oryza sativa
aattagttatgagatttttaaaatcttagagaaaagctcatgacgaacaatcttaatatccgatgggttttggaacattaacggcagtttttgaagaacgaatttttagcgaagagttttgtagggtttgaaatggagaacgttctatttttaatagatgattgtgatactgtgaaattcttttgaattattcaatacataaggattttagatgaaatttaacatggacctaacctctttttttttccgtgaacacgcaaaagcattgtacgtcaatatattaaaagaaaaaattttgttacacgacacaatcagctagattagcttatgccaagaaaagagaaaaaaaacacaacaaaaaaaaagaagagactactacgatgactaaacacaactccaatcagctggggttaggggggggggcacagagccacactaaccttgtagaaattttcttttggtttatttttctccttaaattatcgtcctatttggtggtctattcaaatcatttatgtgttttgtttcgtttcgtttcataaccctatgctttgcaaatgtcatatgtataagaatcaccttttttccgtttatgtgttttaccatacctactactcacgttaaaagaagccatttaatagcttcggccagcactgtgtcaataccctaaagaactagtcaataccctaaagaactagcgagtcaacgggcttatttggattgttaccctatcaattttttggtagtgccaagttttggcactaccaaatatttggtaagttaagattatttttatcatatttagtttgctaccaacatagagtcaaaatgtgaaattgtagtaaagaatgttctagataatgccaaatctagattaggtattaccaatgaatgggcttcaatccaaatcaaacgcaagtactattcaattaccaaaatattggtagggcatgtttttggtagcaatccaaattggcccaacacttatctttttttacttcgtatcatgtttaggtgtatctgtcgtcagtgtgtttgggaaacggttagtgccacccacaagtaggggtgggcattcggtctaaccgaaaatttctgtctcggtctttggtctttcggtcttttcggtctttgaaaagcgaagaccgaattttagtaaaaaaatgtcaggaccgacaaattcggtctcgatcttttcggtctcggtcctgaccgaaattcaacaatattttcatatatgcaaagaaacaatggaaattttcaacataaaaatcacaaaaaaaattcataagcacttatgagtaaagactcttaataggttgcatgcctagaagaagtaggatgtgaaaattagagtttaatctattaaacatagtggattgtatgttgcatttagacatttttttggtaattcggtcttttcggtctattcggttacccgaggagactaaccgaattgaccgaacaaaattcggtctttcactacctaggaccgaattga

SEQ ID NO: 54661 - DNA, 1501 bp, Oryza sativa; identical to SEQ ID NO: 54638

SEQ ID NO: 54662 - DNA, 1501 bp, Oryza sativa
aatcatggacctaacaatgtacatgagactcaactatagcaagtgtttcctgatttgctgcacttgttacgaacttggagttgcttcctgtgttcactaccggaagtgtttgttttactggcggatccagaaatttagttcgttggtgtcataacgtgtttatcggtgtcatagcatgctaattacatttagaatatagtgttataatatatggatagtcagtttaagcatagcttttgccaaaagtcgtcggtgtcgcctgacaccagtggtattactgtagatccaccactttgtttccaccaactattagtccaatattttttgtccaaaattcagtccaataaagttgaagagtaaaatttagaaaaactatggatactttgataaaactaccacaatattgcatatttaagccgtatcatatttaacccattgcatcacaaaactacaaacttggtgctgaacttaccaagaaactatatatttaagtcatagagtcgtaaaattacagatttagtgttagtttttatcacagaactatgaattttaaaagctccatcctagttaattggtcattccttgaaacaaaaatccaaaatttacacacctttataagtaactctagcctagttggttacatgtggatgtgaagggttgatttgcttctgagttcgttttcatgtaggattggatcaaattctttttttttctctagggatggtttttatgtagtagtgggttacccattgcgtgggcggatggactccgtttttttactatagtagataaatcatatgctaaattttatagttttatgccttcaacctatagttttgaggtaggtttgacattaaatgtgtggttttgtgatatgatgatttaaatttacagttttggtgataattttgtcaaagtatgtagtgttgtgaaattaattgaataatgaaattctcaaatgaataacaaccagagtatggtgaggaagggctacctttgcaaatcggccgtgaactagaaatttgtgatacttcggggtagtgttaagtgaggtttgggatttaccttgatgtgacatattggagtttattgattaatgcttaagtaggtcatttccctaaaatgttgatatagttgaatggttaattgtaagtttacaaaaaccagcggtttggattccaagttcttatagcccacagaaaatggaatcttctagaggaagcaaggcaatctcgcctttgtcccctatacagcccgcccctagttttctccttcctccaaacccaccatatgcgacccttcgctcatatatacccaatcggccgttcctcacctttgtgcctactctaattgcctcatttcctcgccgcttatacaatctcaatcattgggttccttttggggtaggttttaattaatcgtattcatgttcttgttgattcttttggtgattttgtttatagttttggtgattgaaaaggtcatttctatattggaattg

SEQ ID NO: 54663 - DNA, 726 bp, Oryza sativa
ctcattgcttaatgacaaatggtaagaatgaggtaaacaatgattctctcgatagtactattgaaaatacttgtgttgttgatgatgatggtgatgatgatgaaccttcatatgatgatctttttgacatgcttagggaggctagtaaatacattgccaaagagaagaagaaaaatcaaattttagagaaaactcttctctctttgaaagactcaaatgtggagctaataaattcttataaggaactttgtgattcttataagaagataaaagaagcttatgagtctcttctcattggcaatgcatttagtaagctaaaggtggacataggcatcacatgtaatttaattgatgatgatatgccatgtgtagctagctcatgtagtacatctaaggctagtgtgtccacctcttgtgatgacttgttagatgtaccttgtagctcaaacatagatgaaaattcttgttcttcctcctctatgtatgttgttgctaaccttgtagaggaaaacaagcaatcacaagcccaagtcaaagatttaaaagaagacttggatagaagctacaaagggaagaactcacttgacgaaatcctaagcaagcaaaagagctcaaatgacaagtgtggacttagctttcatcgcaaggagaatgctaagaagacaaggcacatgcctaaatatgcaaggaagcatgcatacttaagaaaggatggaaagaaaaatg

SEQ ID NO: 54664 - DNA, 1501 bp, Oryza sativa
cgccataaaccaaggctgcatgcatgccgtcaacgtgcatcgttggctaccacgagggcttcggctgcgacagtactgtgcatgcttaatcaatcgcgttggcccgtgtggaaagtaaaatagaaatggaaagcgtgagtggaacgcgggcgaatttttttgcgcgggcatatgcctgctgttcggacgacggaagaaaaaaaaaatccaaatcctattgccccgtggatcggcggattagataattacggagtaaaccgatgacgtccaacatttgttaacaaaaatatcttcaatttttataatagtagcgaaatacacgatgaacaaaataataacatatgtgttgctttataatacaagcatattatttatggtccttttcaagtaaaaatatacataagattttacatgaataaattcaattcttgttaggatgtgctacctgtctaccggctgaaaaatttcttgctttcagccgcttattttagcgctggataaatgtatcggacgatccaacgatttcctgcggcgctatcagcctatcacacattccgtcagaatttaaaagttgtcctttttgcaaaatagccatcaattttgtgagaattttagatacacccttcttaggcctaagctgttacaactttttcgcataactacctatagtttttttttataataaaaccaatgaaggaaaacttcctttctccttcgcatataatacttaagtagttttgtatacaagattttaaaaatactgttttgtatacaatctttgtgtgcaaagtactcggtatgctagttttttttgctaatttttgccatatgtgttcattcacttttctaacatgtatatagactggtcaggatcacgtctttactaccgattcaccattctctgtttgttttgttacgaccttcacgaaagtgaaacgagacgagaattgtaggcttctttcctaaactaaaagcggtggttcttgcctccctgtgcctaaagcgcggtgggcgactgcggtttgagtctttatcgatcgggtagatccatatgttcttgggggagacgaggtgtagcgcagtctggtcagcgcatctgttttgggatagtcatctcattgatatttttagtacaacatctaatctagcttaatcaacgtgcgtctagcttaatcaacgtgcgtctactttagttatctcattatttttttgtcaccttttgtattaatttactaataaatgtttcttgtttgtttgtaattttgttagcaaatttttaggtgtaatgagtagttgtctagtatctctcttatttctattttgtttcactaaatgtaagttgcactttatttttaactataaggttatcattaataatgaattctatgttatgatacgtatgataagttatacacgctattttcatatgtgtatcatgtaagtattaaaaatctatcaggtgattttggtttaacaggtgcacacacagacacggggatta

SEQ ID NO: 54665 - DNA, 1501 bp, Oryza sativa
catgtcttgttttttattcctctatgatacaagagattctctttttattgggtgttttattttttaagtggtttatttatacttcatgaagggttaaattgaaccatattatctaaaaaaatcctcactagagcattaatcattggaataatcaataaattacttgagccacaattgatggataaaatattcttaaccactacttcttgctattgcccaaaatttgatattggcaaagaacaaaacagatcctacatctgtgaactgagcaaccggggtggcatcactagcacgttgcgcacgtacttacacttgcacagttttatcttccacaacaagagtgaatagccaatgcggtctcttaattttttttatgttagtttaatccctgattttatattgtccaaactccaaataaacctcttaatttatcatgtgacttgatatagtctctaatccaccgaaaccgttatacagacatgccacgtcatcctagcatacatagttaaaatcaaaatattcattctaccttgtatataccatagaaaataagaaagaagaaaggaaacgacaaaacataatgattatcatatctttgtgtctttatttactacatttttatttgtcctttttctctcctttcctctttatttctctttttcttaaaaaaaatggcataggtgaggataaaatcaaagttggatggaagtaagtcaatggatctcaatccgaggaaggcacataatctcattttgttataacgtcacacaaatataactttggataaaagcatatctaacaccctaacctaaacgcttcaacttactacataatattgttcatataacttctaaggttgttttgaacatgctgatttccgtatacagatactaaataaggttttggttaacaaagatgacaaatttcaggactaatcctcgattattgtgattgtatcgatcctcagttattggtgtaaaaaagagtgcatgggagaatttgacatatatcttgaatatatctactcctcagtccgaagataacttcatttctaacatgaacagtttattctaaaataagttcatttctagcctattataaattgtatttcttttataccttttattctaaaacactcgtaatactatttctttatgaaaaataagttcacttttatcctgttataagttttattccttcaatacctttatctatctacctactcatcaatactattttaaggattattccttcaatgtcctttatctatctatccattcatcagaatggaatgctattttttttttcttttgataaggagactttggtcttttctctcaaccttagtttgaagtttgaacaccaaagactaaaaatagagttatttttgaatagcgggagtgtggcgtcactaaaatcatctattgtacatgtaaaattagataaaaccgaataaaataattagataaaaagcactttagcggttatacgaacagtatta

SEQ ID NO: 54666 - DNA, 1501 bp, Oryza sativa
attttagggaaatgacctacttaagcattaatcaataaactccaatatgtcacatcaaggtaaatcccaaacctcacttaacactaccccgaagtatcacaaatttctagttcacggccgatttgcaaaggtagcccttcctcaccatactctggttgttattcatttgagaatttcattattcaattaatttcacaacactacatactttgacaaaattatcaccaaaactgtaaatttaaatcatcatatcacaaaaccacacatttaatgtcaaacctacctcaaaactataggttgaaggcataaaactataaaatttagcatatgatttatctactatagtaaaaaaacggagtccatccgcccacgcaatgggtaacccactactacataaaaaccatccctagagaaaaaaaaagaatttgatccaatcctacatgaaaacgaactcagaagcaaatcaacccttcacatccacatgtaaccaactaggctagagttacttataaaggtgtgtaaattttggatttttgtttcaaggaatgaccaattaactaggatggagcttttaaaattcatagttctgtgataaaaactaacactaaatctgtaattttacgactctatgacttaaatatatagtttcttggtaagttcagcaccaagtttgtagttttgtgatgcaatgggttaaatatgatacggcttaaatatgcaatattgtggtagttttatcaaagtatccatagtttttctaaattttactcttcaactttattggactgaattttggacaaaaaatattggactaatagttggtggaaacaaagtggtggatctacagtaataccactggtgtcaggcgacaccgacgacttttggcaaaagctatgcttaaactgactatccatatattataacactatattctaaatgtaattagcatgctatgacaccgataaacacgttatgacaccaacgaactaaatttctggatccgccagtaaaacaaacacttccggtagtgaacacaggaagcaactccaagttcgtaacaagtgcagcaaatcaggaaacacttgctatagttgagtctcatgtacattgttaggtccatgattagcttacatatttgacgttctagataagaatagcagcatttgaggtggtcagtggtagcggtggtagtgcatgtaatgactactgctaacagcatcaaatggaggaaaggttcatgttttgtatgttatttttttgtgcgtgtgtgtgggatcaaggaggccgactagaggggggtgactaggcggtttttcaaacttttggctaaaaccgagttttgtatgtggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaat

SEQ ID NO: 54667 - DNA, 1501 bp, Oryza sativa
atctgttgttttttcaggaaaaaaaagtaaaaaaagaatttgaaacatatttaatcactaccaaaacctacaaccttacccacaaatgcacaatcaaactgtgcatataatctggtgaagggaggtgtaggtgccaacgaaggcgatgcatactccgatgactagtattccgacgatcgccgccacctcgaagcggccaactccaaatcgaggcatgtagatcttgaggtagctcaggcatgggaacaacacgacaatggtgaagttcagcgaagatacgttgaacggcatgaggtagctgaagaagggtaccgtgcacgccagcaccaccgtgctgacaacgacggctgtgctggtgagcaccctggtaagcccgttgtgctcgacgtccgctgccgccaccgttgtcgtcgacaatttctcctcattcactgttgtgatgggctagatcacgagcacgtacttcgctagcggggtgatcagcgtcgtcaggatggcgatcctggtgtacagcttccccgtgggtaagttcagtgtcaccggcgcctgcacaacttcaccatagatcagataacccaacattgttgtcactgcgtagttgagactgcacagcactgaagagatcaccaaaacctgcacattaattggagaggaatagaacattattggagtactgatccattctcattatcgccatggtttcataaaccaaattatgataattcgaactgataatccaatgatcaattatcattgttgtcaaatctctaaatatatggacaattgaatgcaacagtagatataatatatgccgttagatcatggataagtatcagtaaaagaatggagaatggtccaagattgttcaagaaacttccatgagttaattgagcaatagtcaatgtcctaccacttttgcatcttatccctaacaattcttatacacgttggttgagtctaaacttagtacaagaagatatacaacataatagatctctattttaacttggcatataaaagtttatgatccaacacatcttccaaatttagatacgctaccttttgatttatctaaaattgtattggactacgcataaaattactttaaaaaaatttcgtaaactctaattcaaatggttaatataattcttttattttaagtgctagacgcatcttctaacttcaggttttaacatataaatgaaaccatattaggcggctcatgattagctttatctttaagctacattgcctttacatgggtggatgagaggtaaccaaatatagttgagagacgactctaatcgcctccaagtcaccagtttattctgctggggtgataggctgtaatatagaacaatacacctccacgctagtcaccaatttattccgctggggtgatatgctgtaatgtagcacagtatgcctccacatcactgcacatgctaaactggtcgaaaggccaacccaacattaccctaaatttatggcattatgcaat

SEQ ID NO: 54668 - DNA, 1501 bp, Oryza sativa
cattaaatatgtgctttgctttctccttacccgagctaatgttgctcatcttccggcacattacctagtagtagcaaacattgtccaaggctacacatcagtggaagaatgaaaatagagaacaaaagagaatgaaaagtagagaagttacgatgtgcatataatgttcaacactataattatataattatattgtacttacaacacacttatatgatataattacactatacttacactacatttacattgtacactacatttacattgtacttacactacacttacacacttaaatagtacttacgttggacttacataataattatgttgtacttacattttaattattatgtaattcctatattaagcatactgtaatagtgtcaatcggttaattaattagcttgctagcttcaggggtgcaaatattatttgttttttcacggtttccacaaattcccgatgctgttcttgttcctttttctttggctaaaatttaagttccaaaaaaagctgtgtttatgctaattttgatcggaagtcaaaaaaggtcatcttttttaccaagggactactagatggatatcccaataacttccacaggctctacggtttgagataattaaatatgcaacttcttcccaagggctgctctactatttggaaataatttaacatgaacttcccaaggacgctacggttttaagataattcattaaattgataactgcattgcattctatagtttgatatgcgtacatgtaatgcgtacatgtaatcctcaagatatctctacgtataactaatctcgcatatcatgcccattcacaattagatctcatctcaactcacaataataatcgactatgctaaaattccatcgacaatttttttcattaagatttgtcgaattttcagccgttaatctaaccatgagattcgtgccctctttgtgtcggcactcccatgaaacgtaactcgtgagcacttgaccacctggtggtactgtacatccatgcacacggctgattatctttgtcgctcactaattaaatagtttaaagttgttgttaatcatctagtgtacggtttcctgtcaaattcatgttacccaaaagcgtagagaggattaaagcatggtaatgatatgagagagagagagaggaggtaagttgaggaaaaaaattacagtgtaaatatagtacttttagagtgtaatttgttgtaattacattgtgactcgttgtaaattacaatgtaattctattagacttgtatgtaatttattttttttctatttttcactaagtgtaagttacactttatttttaactataaggttatatttaataatgaattctgtgttatgatacgtatgattatataagtattaaaaatctgagtgattttatgtcgggtgatctagatactacattaatataacatgtgcacaaacaaatacgaagattatggtggcggataagagccctatcgacaa

SEQ ID NO: 54669 - DNA, 452 bp, Oryza sativa
gcctcccccctataaagcccagtcccccctctctgaaatttcattatattcactaaaaatccaaaaaaaatgaaagagagagaggagagggcagcagaaggggagcggcgaagccctactggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataattgtatgaattgagacatagacagtagtgttaattgtaagatgtagtttagtttgatctggagaatgtaacatacttttagaattttggagaacaatattgtagagaatgtaacttagggcgtagtacagaaatgcgaggttaacgcagttattgttttcatcaggcacaa

SEQ ID NO: 54670 - DNA, 1498 bp, Oryza sativa
  unsure (1)..(1498): unsure at all n locations
tgattggtagaatacattgcaatttggtcatagaggaaaaaagagaaggaagaggaagaaaaaggacaggggctaaaagaaaatatttactggtataatataaaaagtgacatcgcttatactccttccggttgataatacttgtcgttttggataaggacacggtctccaaaaaaaacaattttgaccattatgtttcattataatatgtataaaattgttagcaaatatatgatcttattaaagtacttttaagactaatctatacatgtagtcaccatatttgaaagacaaatattttaaaaatgattcataatcaaagattctaaagtttgacttcagccttgtccaaaacgacatgtattatcagcccggagggagtagctataaattatagttaccctgttaaaaaaaatatatgaactaaaatgatataccttaaagggttagttagatcatatcattataaatttgacagttttaaagaatactaccattattcgtataactgaaatggtaccactacaataatatgaaaattggattcataccatactgtacactaatttaaataggtaaatagtaatgatatattttcaagtaaatttcagaaaactacaaccaaattatcgtaaaacttcatatttataatcttgtattacaaaactacaaatttagcatggaaattttcatagaactagagatttaaaatataatatcccaaaaataaagattgattagcaaatttaataactacaagttttgcatcaatttaagtacaaaactacaacgcctaatagttccaacataataataaggggcaattacatatctgaccctcttttgaaagctaactaccaatttaaccatcttatatcaagtttgctcatttgacccttcatttcaaaactgaagatacggtaggaccctattctatcaaaggcatgtaacggtcttaaaaggagcataaaatttctcttctgcccttgctcttttgaccctattttaccaaagcatttagttagtttagcatagttttgtatggtggcaataatgagaatgatttgtgcacttagtgtaagtttcaccgatttgtgacaagtttgactcagactttggtcaaatttgacctatatttgttatattaaatttttcaaatttgacttcagtttgacaaaatggacttcaatttgatagatgtttgacaaatttaacatagatttgataaaaatatgaataaacttcaataaaattttagactccatcatcctcgccaagtcatgcattgtcgcagaccggtgatttccggcaatggtgtgcccccatcantgaaccgccaccggtacacctcaggaccgccggatttgcagcccgcatggccagtcacctttacatccactgccaangcaaatttggtgccntgggcnnnnnnnnnnnnannnnnnnnnnncanatnccccggctatacacctcggggccgccggggcaaaattacagc

SEQ ID NO: 54671 - DNA, 1501 bp, Oryza sativa
aggcaagaccacggtcaaatgcggctttggaccgagatgatataataaaccaagtttagagacctcgatatgtattttgcaagttcgtggacctaagtgaaacctactgacaagtttaaggaccgctggtgtattttactctttttaatatattacgctattttccagttatttcagaggttcgattatatctcagatttattcatttttcacttaaacttcaacaaccatgtgcgaaatgtaatcgtgttgctcagtgctctcccatccaattttaaatgtggttgtgagtttatattcgtcttatttaaaaaaattataaaaaataaaaaataagtcagacataaaatactattcaaatttatcatatactaaaaataaaaatactaaccataaaattttctcaaataaaacagattgtcaaatgttgaatataaaaaagtaaggatggtttatacaaggatgtgccatcactacagcaaaagtaagttaggtatcaaatataacgcgagacaatgaacatatttatgtgtgttacacgctaataaacaactcatcgggattgaagactatgagttcaatattaaggtttgacctagttatgcctcgtggctttaggataagaaaaacattttcaaggtcacaatgcaatctaaaaaaaaagtcgcaatgccacatattagtttgacatagatggcatatgaaaatgataatcagtaagatccaatgttcgtgtaacaaacttcaattcatcttaagttttttttcttaaaaaatcacctgtaaaatttttggttattttttaaaaaatgacgagttatttttttgaaactaaaatcatgttcgatatatgtggaattttatttttaagaacactttatttcttggcccgtcactcccaggcaaggcgcagcctgacattatttagcccggcccatcagcccatgagcccatgatatctctgccccacgatcccttctactccccggagccgaagagacgtccatggagaccccaccagcgcagaaaaaccgcacaccccctcacccactcaacaaccgcatccaaaaccatgggcacttccgtaattccacgactcctcgtctgcagactttccatccgcacgggcctcgtacctagcccctcccatgacaagtgggcccatagccaaccttatccaatccatgtccccacccgtcatcattagggtaacaaatctaaggtaaccttagcgagttgtccttttcccatcttttcctcccctccccgacgaaacgctcccctctgcttaacaatagattagaccccaagaggagagagaaagagagagagagagagaggccggaggagagagagacaaaggggagagagaccaggcggcagagacacagagaggagaggggagagagagagagagaggggggagggggggggggaatcgtgcgagggaggggagggttttttgggcgagatttgagttttggcaccctcccgcgcgcca

SEQ ID NO: 54672 - DNA, 1099 bp, Oryza sativa
tcttcagggtttgaaaatagatgataaggatgcttggggtgatccgtttactatcacaccggatcacgtgtttatttaaggcttgtttggaggactgatatttgggccaaaccaatcatggtctttgatcaattctagcagtgcacccacaatgacaatcctacacagagcttgagaacaaataggaaggcgttcaaatttcactctatagtcctgttataccttgtaattctgggggctcaatattaaatcttcaaacctgttggaaatccccttcttcattgcgttaattttcgttgttgtggccattgcggtgtgctgacccgtcagcggcgcccggggggggggatttagcagctggttttgctgccttccggttgctcgtctcggtggccctcggatcgtcatccaacagtcgtttcggcccctcgtcttgctgcggcgtctggcatccgtccgtcagatcacgatccaaagctaactcattctctgcttgtttccccgttttttgacaaattgacccttttcaaaaacttatttcgaaactaacccctgccaaaaacttcaaccaaaaataggccgtttgctcagcgccaatacgcttggcgctgaggttgggcgtggcagctacctcagcgccaaccgcattggcgctaagatggcgaatctctgcgccaaccgcgtcggcgctgaggtgccaaacttcagcgccaacgggcctggcgctgaggtttggtacttagaggccggccgaagccgcccccaaccagcctctcctctattctcccccaccgcgcgctagggttcgtcgccctctcttctcccctcaccaaatctcccccaaatccactcaaatcgaaggggatttcgtcgggattgatttggggatcgattgagaaggtaaactcctctagaaactctaatttccccccatgttttattggatatttcgcattgttttggttccaaccgtggtttgataattattggctcggattgggatgttaattggataatgtgggtggggatgtagtgcggaagatacatattaatcttgctccatttggttcatgttgatttgtgggtggggatgtagtgc

SEQ ID NO: 54673 - DNA, 1501 bp, Oryza sativa
catcgaaaaatctagtacgcacaagcaaatgcagaaggggataatgaggcgatagagagagaagggtacctctcgagcgcttccctccggcggcgcctccgttggccgtgtccggccgggatctcttgcgggcggcgccggctccctccatggcgagccttcgcgcggagggaggaggagggaagggaggggaagccggtcgggggcgagatcgaaaccctagctcgtggttggcggagggaagcggaaggggaagcgaccagccgcggaatcgagagggttaacgacgagagagaggagagacgtagggaacggctggttcatatggggtagttgggctttgggcctccaccgagtcagatatttattggatctcgaggagagctttgtcttcgtcatgtcgtgtacgtcttgggctttgggccacaattcgtattggacagtgtagatcgaattttggttcgagatttcctcactgcgtagtttctcattgtctgccacttcactgcttgatttcttgaaaaaaaaaacaattcactgcttgtgaattgcgatggtaacaaactacttacaatctgattgataattgttgccttttcgggacagaaattcttgggctatcctaactcgagttttacattaccccaccattaacgcaagtatgccttccagatcgaaaagcaaccctctaaattcaattcagggcacaggctgcaacatgaacttgcccactgctaacactgcatttgtacttgcataatgtcgtcgatcaaattcagaagttacagagagttatttcacaaaaccaagctgtgcagtgaatcctccatggacaaaggaactcacatgctcctggccatcatctcctggtacctccggtacgactcctgcttctccagcaagaacttggcatggcacctcgcgatgaacctctccgcgagcctgtcgatctcgttcaccgcaccattgccgtcgccgtcgccgttgccgttgccgccgtcttctccttctccggcagccggcaatgcaccggccgacgtctcctcctccagccagcacaggtacccgcagtcctccccgtcgtcgccgccgccgccgcgcagctcctccgccgcgccgtcggccggaaccaccacgttccacgtcgagtcgtcgtagtcgtagtagtacgggtggtagtgcagctcgagatccttggcgcgagccggcgtgacggcggcggcggcggcccagttgaagcgcagcagcttcatgaagctggcgatcctcttcttgctcttctccggtctcgagcggtagccgatggcgtacttcttgccgccgccgcctctcgtcggcgccctcttcttgcggacgacgtcgaggagcagcgacttgaacttggcgagggcacggaagacatggccgacctgcgggtagatgtgggagtggagaatggaattgagcttgggagagatcgagctcggaagcagagcttccatgtgaaacaatggagccatgg

SEQ ID NO: 54674 - DNA, 1501 bp, Oryza sativa
tattccatttgggattatcaggactccttcagattattccaatccttccctgcatacagaaagtgatctagctgaggtgagatcagagagagagagagattgagctggttttaccaggaagtttccagtggtgtttgctttgctgcacatgtgatgcccttcaagttgtaagttcatctcaaccatgtgtgtaataatgcttactttttgccatgcattgcattgcgtcctctccttctccggcggctgctgctgctgcatggtgtgatggtggtggtggtggtcgtcgtcgtcggctgttttgcgattctggagattggttttgtacttttgtgcgtatccggggacatgcaccgccgtcgaattattctcgccgttgttgcgtgccacgcctcccctccttccctccctgcgaatataggccggtgcggattcccaattaattcccattgatctatcgtatgtgccactagcttcccgttcgttcgatcgagagcctatttaagcttcgccgccgcgttaatccctctttcctcctccaaattaatctcatcctaattctgttttaatttctggtgggaatttcgctgtttgatctggcctcttcacgtaaccgtaatgttctatgtgtaaattgaattaatggagttggttgtgaaatcgttgaattgatggtgattcggttgttgttagttcagttaaatgttgcaagatatcatgaacaccaagaagattaagctgcacgactgccacttcggctcgccgctatgtgacccttcgccggcgccgcacctgctgagctccgccgccgccgccgggctgtcgttccacccggggctcgtgagctcggcggcgcagcaccagcagcacggcgcgggcggctggctgcacgaggagtactacgcgccgaggtcgtcgccgccgtcgtcgcttctcgcgcagacctgcgtcggctccaacgcgaccgcgttctacgccgccgagaacctgccgcagttcgacttcccagctctcggtacggcggcggcggcggcggccaaggcgccgttccggtcgtcggagagcgagctgtaccggccggtcgacccgctgctcctccgtgcggaccactcggtgaggacgtactacgtccggccgcagaagcgggattccggcgagaggacaccattgccgccgccgtcgcagcaacagcatcaggacagaatccacgggctcttcgccggcgctcccaccactcggcttctcagcggcgaacccaaaatccactcgtttccacctcaagtaagcatggaacaatcatgaacagaactctactaagaattctactgtttgtctttaattcttttctttgagatgcctgtgaatttttttatcgtaatctgaaaattaactccgatgaaggtggcggcgaagccgattctgccggcgatggatgcgccgagcctgcagaaccagatggagaatcagctgacaaggaactgcatcggcgcggcaactccgg

SEQ ID NO: 54675 - DNA, 398 bp, Oryza sativa
cccacggtgcacacgcccacctgtcaagccccggccagattcagagcttgacaagaacaatttcagagaaaagaggcttaagtagctatcctaatgggattaaattgaaggatttgcactgaattgaagagtacacagtacaaggaaatagatgggcgccgcaagacaagagtaaagtaaattagggttcaattgttcgatacagacattgcggcggcactagcttataaagggactcgctaatacaagacaaaagagatgatgtcaacagtacggcaacaggggtgtgctgtagacggtccaagctcatctccatcgtccgatcttcataatctccagcccaagcgttatcgaataatcccagccattgggtaactgaacttgccttcccttccagc

SEQ ID NO: 54676 - DNA, 181 bp, Oryza sativa
  unsure (1)..(181): unsure at all n locations
tcttctattccttccaacagagagactcccaaaattccaccanagcatcctaccaaggatgacaagcagtccactgtcactcatacaaaattttctggcaagtgtttccgttgcaacgaaccctgggttccaggacacggcagagtctgtaaagctaccaagcaagtctatttggtcacaa

SEQ ID NO: 54677 - DNA, 801 bp, Oryza sativa
ctttcttcttttcttctttttttttttgcattgatttgactggctgactgatgacaactcagaatggtaaaccataagagaataccttgtagaaaattgggcattttgcctgatcttcgcttaaattagattctggaattgacaaagttcagctacagcatgaaatgaaaagaaaaggcaacgaacactggcagaccacacaacaaatggtgccatccattctgtgtgatccctagcgcatagttcatttcaaagatatgaaccattttcttagtggttttctgaagtttagcaatggagatttatatgttttagaatgaagtgactgatttgtcaaccatccttaattgacattctcccctgttggaatatgttattgattgtcaaaccattctctgttggtaatatttccctgttgaactatgggactgctgggcatagtattaattcgtcttgtacttgccatatagatggcattaaccatttaattatccctctgattttcagtatctcccaccaaatgatatgttctggtactttccgtgctatttgtgctggtgctaacacaacagcaatattatcgtgtctaacacatgtgttgtgtctagttcatttgctatttgaaatattctgttctgttttcagcttctttattcttttgctgctcctgaccttacattttagggaaattcagttcgtgcaacattggtgtttttgtgcacatcacaatttggcaatctttgtcttaataaatattctctgcatcatgtgacaatcctgctgttgacaaataattgtgtg

SEQ ID NO: 54678 - DNA, 171 bp, Oryza sativa
atctcatttggcagtttgaagaattctgaagcagcttcaatagcaccatccatgactgattgactgatcccatgacttataacctgcaaaatggcagaattagtagagacttgggtgcacaagtaagctttctttgttcccttactgcctgctagttagtgatgatgtagg

SEQ ID NO: 54679 - DNA, 178 bp, Oryza sativa
acataaagggttatttcctttggaagatttaagagtagatttcagagggcaatgcattgattagtccaccatgaattgattatttcacaatgcatttcatccaagtgtgcaactatatggatgtcagtgttactactacttatgcatttcctcacctctgagcatcttattgtgcagg

SEQ ID NO: 54680 - DNA, 1501 bp, Oryza sativa
aagtataatagtaggttataagccggctaaatgctaagttggaggaaagaagagaggagagagaggagaagcgggctataaacttatagccggcttggacacaagaaccaagaaactctatgagagagacaagtgggccctgtattaattgtgaagagctaactattatataggtaggctgagagaagactataaagaaccttatagccagcaggtcggctgtattattagccttgctctaacctacagagattagcttgctgcaaaccaacaaatcgctagctgctgcttcgcttttcccgaaaaggcaaaagcggaggaaactctactctgtccaccacccacatatcctactaatatctcatcatgcatctcatgtctggataagtcattgctaatttgatactgtactagtaaatccaaggaaatttgttcatcagttcatgtgatggttgagcaggtaaatcgtaatttattcacttattaatgtgatatagtcctaacggttaggttaaagacaggccaggtgtattgcgtttcatcattttctgtttctaactgctctgcctgttcacttgtgtcctggaataattaactttggccattgaccaacgaccctcatattagcattggatcgttaggttgatctggatcgaccggtacggtgatccaagaataggtgttgtttaattggagaagttgacttttctgacagcccttgtgtgtacactacatcctcccatacttcctgtagtcaaatcggggaactcaagcttctgcaatttagttgattgatcgaattaatcagatcgatgaactttcaagaaaaaattaatgagatcgattgttcgttgcaatgtcagcaggtaacaacagtgccagtgccgacagctggttaatctgtcttgcaaattactactacctccgtcccaaaataattgcatttctatgatttaaaatttattctaaaataattgtaattctagagtactaattgccccatcaatcatatctcattcaaatttctccctattttaccctcaactatcttcccactctcacataaacaacatttaatgagagacaccatagtcttttttctcaaaccttaatatatgctaaataacataaaattgtaattattttgggacggaggtagtactaattggcaatttaaatggttgcaagatgcacatgattatcttaagaaacaaatttgatttgatttaggtccaacaatggatgcaatcaccactgcccccatacatgatccatcactttccttcacttcattatcacaaggggaccctcaccctaccaaagaatcaccattaatacagtagtaatagtatcctgttatttaaaaaaaatgattgaaatcggggcgcaaattattgcgattattattggtttcgaattaaaatccccccgaattttgaattccaacttggcaatggcaaccactctccccccaataaatagccgcgcacccgctccccct

SEQ ID NO: 54681 - DNA, 232 bp, Oryza sativa
acctgcacgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgca

SEQ ID NO: 54682 - DNA, 555 bp, Oryza sativa
cctgcacccctgacgtggcttgtgagtcagcgtaggacccacgtgggccctacatgtcaaactatccatgttagcctcctctcccttcctcctctcttcctctctcctacacacacccagatgagtcgtcggctctgtcgacggcggtggcggaagcgcgtctgcccaggagcgttccgtcggcggcgacgactgtagcgcatcggcagcagcggcagtagcgcgtccgcgcgtcggcggcggcggcggtagcacgtctgcccaggagcggcttcgtcagcggcgacagcggatgtagcgcgttggtgcgtcttcgtcgtcgttgccgccaccgccgtcggcgacaacctcctagggccggtaccgtcatcgcgggcaccatcaaaggagcagcgggagcggatgaggacagcggcggcgaaaaatcccgcatgcaaagtaattaagatcgatcgacaaccacatatttacaacagccaccacgcacatcatctcttcatcatgcatatatatacgcccgcatgcggagtaattaagatcgatcgataacaagga

SEQ ID NO: 54683 - DNA, 378 bp, Oryza sativa
aataagacggacggtcaaacgttggacacggaaactcagggtttatctttttttaaggacggaggaagtatctcttaaagagattcaattccaaaaaaattatccggtataaaagcagagataaacggaagaatatacccacctatcatttttattatcttttctactaggagaatcatttttattctctcgttgaaatgcggggatggatatagcttgcagccacgggcaaccacaaaaaatgtcaaatttcaacgaaagcccgaccctcccactgaccctgttaccgcacgtttgagtaacccgaccgcaacgaaacacacgccccaattttcttggttcgtgatgactctcccataggttgatccgatccgtagg

SEQ ID NO: 54684 - DNA, 292 bp, Oryza sativa
atttagtaaaattgataattatgtgcctatgtttagtttgtcaccaaatattggtaatgcatatagaattttggcaacattattaagccaatcctacaaaaaatttggcaatgttgccaattcgccaaaatttggtaaggttcattttagcatcaatccgaatagccacttcatatctaccccattagcagtttaaaagccaatagccaatgctaaaagtgccctatgataaaaagaaccaaaatcaaatcaaaaattaacttttgaaatctaaattttggctaatgagaca

SEQ ID NO: 54685 - DNA, 457 bp, Oryza sativa
aataatagaagcatcgccatttttatcataatcttatacttttgcaaaggatttgaaaacataaacaaattgctcaaaatgcaacctaacagataatgtggggattgatggcatcaccttttggaagcacaacatatcttccaaggtgaacttttcacgaacatgtggtcccacagatttcttcgaaaaaaaaccacgttttccagctgaatggatctgtttttgcattgccttcagaaagccctctacctgtcatatactcatatttcagtactacgattaacatggcagtcatattaattcattatgcatgcgtactgacactaataatcgattctattgaaatatttccatgctcctattgaatcactgcagtctacaggtactgaacgcagggacaaaatttacaaataaacacagaactctaacgaactaagttaaatccaagattcaagta

SEQ ID NO: 54686 - DNA, 592 bp, Oryza sativa
tgtttacattacgattgatgaccatgttgtgcctttagtggtttacaagagcgtacactttagagctgaggcattgttttgctgaacaattgcaacagttgattgtttgagacggaagatgcccatcataattatcaccatgcaataaatttgacgagatcctgtaacaactaagaattgatgttttctctataaatggatggtgacatattgagagaaaggataagtattcatatagctatgcattttgcactattctaacttgaataaataggcttgtctacctcgttgtcattagtccttttgtccttaacattagtatttgcaagtaggaaacttaccaggctgaagaattgggaaaggctcctcacaatcttctcattggttgtaaactggatcatacttgaatcttggatttaacttagttcgttagagttctgtgtttatttgtaaattttgtccctgcgttcagtacctgtagactgcagtgattcaataggagcatggaaatatttcaatagaatcgattattagtgtcagtacgcatgcataatgaattaatatgactgccatgttaatcgtagtactgaaa

SEQ ID NO: 54687 - DNA, 341 bp, Oryza sativa
tgccagcagcttgctgtagtggacgccagttacaaattggctccaaatccaaaaggctcagggcgtcccattccgagcacgcggagagtggcttgcaacggataatcaatcctaaatttctaatcccaagttgatctgttctttttactatttagagcaggtacaatagcaggctataagccaactgcaaatatattttaagtggataaataaggagagagaagagtagcggactacagatttatagccagctgtagcacagactccaagacgcagtgtgtgtatgacaggttggaccaggtattaatagtgtagtatgtaactattgtatgaataagcta

SEQ ID NO: 54688 - DNA, 550 bp, Oryza sativa
acattgcggcggcactagcttataaagggactcgctaatacaagacaaaagagatgatgtcaacagtacggcaacaggggtgtgctgtagacggtccaagctcatctccatcgtccgatcttcataatctccagcccaagcgttatcgaataatcccagccattgggtaactgaacttgccttcccttccagcgttcaatcatggcttcagttcgtcagagttctcacaccaccggccaccgcgcgaccttgtctgtaccatgcgcgagtcatcttttccttttttttgctctactcctgatttttaccatcaaccatatggccataagggttcgttcaaattctatgtactacggaccctcattaaaatgactttatatcccactgataaaaaatgacttcatattcggggtcaacaaaccaaaaaggaagcgttgaatgttgatgtgttcagtaaaaaaaaaaaaggctaaaggtttcatcgtggcaagttatatatgcgatcgatacagtacagctttgccagctcgatccaactaattactcaaga

SEQ ID NO: 54689 - DNA, 171 bp, Oryza sativa
ctggcgccgccaccgttcatgctggaggtcgccgagccatgcagcggcgtggcggcagtagccgcgccgttgcttccaccgacgccgccggccgccatctcccttatccaccccgctcctcagagacgcaacccctcaacctcaagcctcaactcccatccaccacgcagc

SEQ ID NO: 54690 - DNA, 155 bp, Oryza sativa
tttagaagtaagttagggatcattaatatttttcagtccttcacattgttaagaacaatatatctgtccttccaaatggaagtgaaggcttttaaaagtgatgtgttacttttgcctggactaatccttcatacttaattgtgctttgatgtagt

SEQ ID NO: 54691 - DNA, 687 bp, Oryza sativa
ttatatggcttagttttgtttaaagtcacttatctttcaccgttgctacagaattactacatccatggagtatttgtttctagtcctctgtgtctactcatatggactcagtgtttgttcccttattggttactattgccatgaatttgagctacatgtaggctagtaatatgcagtcgcagtttaggacaatttaggatgtgtttaaatttctctttcttgactatggaactgttgatgaagttgttagatgttttttcagaatgtatctcatctgtgacctcagtatggaggtgcctatatgtgccatatatcatgttaatatgttgtttacatttgtttacatatatcatgttagtacattatttccctcctgtatagtgtatattcagtctgttctcatggtcatgtgttggtgaccttatggacttggtactttcgatgacagatcactgaggtttagtatggtgcttacctttatcatgtactggtgatgctgaaaatagtgttttcaattgctctgtcatgctgcaactgcgtagcataatgtctatataatctttacctgtatctctgttatgacgttttgttgtcaatctcctttggctaaacttagtatctgtagcattgcatatgaaactttcccaagattataatgaggtatgttttttccctgctttttctagg

SEQ ID NO: 54692 - DNA, 1002 bp, Oryza sativa
aaaattaaatccatccatgttttagatttaagaaatttattttcccacatttaacttcacttgtaacttaaagaacatttaatataaattctattaataatttattaaataatttataaatcttgaaacgaaaatcaggatgtgacagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttagcatatagacaagacaaccaatatagagagaatattgcccaccagaggtggcaaaaatattggtggtagggaagatagtgattccaatcaaaagtgatgaagttgcacagccgcagaggcgaagaaaccagtcggcagcaatcaggtcagctagcaatgaagatgaaggcccccaacaacaacgacagagcagtcggcggcgacgaaataatcagtcggtggtgatgaaagcaagccgacggtgaagatgtagacacgcatcaaagacgatgacgaaatccaccaatca

SEQ ID NO: 54693 - DNA, 201 bp, Oryza sativa
cagataaaatttcattaaatactttgcttaattctataattcctagatttttctgggatttatttgagctaaggaagtatttttaataaatggaattgcatttaagaaataatttaattgaaaaaggttttaaaaagtcttcttttggctttgggccgaaagccggcccaaaacccttctctctctttccctcggcccagc

SEQ ID NO: 54694 - DNA, 1501 bp, Oryza sativa
ttgttcaggatggttgggcctgtgcagcatgggtgtgctgttcagtgttgattaaaattcctgattaattactccactattttacttctcttaaatgttttgctaaatgctgtttttgcaaatgagccaatattacgccatcctttggtatacttgggcacttgcttatttgatgtcgtggttgatgaatatgatatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactggtgaatttccgggcgtgacaaaagctttatatagctgtcccgctgacttttttatataagtcaaggtgctgtttgggtttttaagcaattgattggatacaatatcattgcttttcgccacgtaagtgtgcatttttattgaccaatattatggcttaggctgattatatattgtggtcattgtctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactgtggaaatttttttattcacaatatacaagcttctttatagctattttgctatatcactcatcatattttacaaagcaattggtatatcactcggatcatgttatttggaggattcacaccgcatatgctatatattgatatcaagtcacttggttgactataattatcaaaaccactcggttggttggattatttattccttgactatatgtttggtttgttcgattaaccacatagtcgggggtttacacctattaggtgcatctagtcgatgcacctgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 54695 - DNA, 647 bp, Oryza sativa
ggtgatgcaaaggaaactgcgttatttctttgtacgtcatctgactctcatgcttgcccttgtcgttagttttcgcttttgcaccgttggccactgcacacatccgattcaggagcgcgtttgtgttttcgtccgcctacggttcccacgcgttcacgtccgtggtccgcctacgaattcgttcgcacgcatcgccctggaaaaggtggggaactttaatttctcagtaaactttatggatggaagaggtgcccggctgccaacacgagtgggccggttgaggtggcagcatcctcactgatggtttgtgcgcgagaggtcgggagctacaaggtggaccaaataagaccaaatccaagcagtagagaggaggaagaggccgaatccagcaaaaccaacctcatctagctgcaccgagcgacgacaactcatgatgtcgtcaaccccactccacatgaccgttctccaccactctccccttctctctcaccaagattttgccggcgacaacaactcgtgaagtcgtaaacccaaagcaccgtgcccatctttcccctcttttgtttctcgccttcggctgaggaagactttccctcttttgtttctcgccttcggctaaggaagacgatgaacagttatcgatgagg

SEQ ID NO: 54696 - DNA, 155 bp, Oryza sativa
attcctaattcccttaacccatgaacccatgacagatgcgccttgctctaccttctgtggaattacagtcagatactactactgacttcattatggtctactttgttattttctgactgaaaatacatattgaattattgatttttgcgggcaga

SEQ ID NO: 54697 - DNA, 469 bp, Oryza sativa
gagtccatgacatctaaggctctatgctatcttgcaatttgtactacttattgcaggcagtacattagctagctaaggttaatgcatggtactgtagattaatgtttggtactgtagattaatacatggtattgtagattaaactagctatttgatcaatcttcttttcaaagcatgcatgcgatgcaagaggctcttgtgtgtgtctttgtcaactgcttggacttgcaatcttttgctcatgattgacccaacataagtatctattggtttttgaaaacaaaggtttgccttaaacagaagtagtaacaccgaactgatttacgtgcttcatagttttgaaacaccatagttggattttgcgtaataattctataacagttagcagatttgagacacaatttattgtaataaattcttgaatttccccaaatttaatcactaagtgcattaactatatcttttcagt

SEQ ID NO: 54698 - DNA, 1501 bp, Oryza sativa
agttcttaaatatattatgaaaatgtacatatatgccttaaattacatcttatagtacccatatgaatgtatatacttatacttatagtacccttatgaatacaagcatgtgtttagtaaaatgctaacaaggtgcatagacctgtctagggcattgggcaatgacatgtcatcatttcttaagtcttgtttactgtccttctatgcatctatctaattagctccatgataaataattttgagttacatggatgcttcattgaacggaagcttctacagctttgattatttatcatggcttaaaacctttcatttcttctatcgttgtgcaaagttagaaaaggatgattgggtcgtgcgtgaatgtctgcatatgattgtctattgtgaaatacttgtcttgtattttgagtgatatctacatggtctccatcatgttacttaaattattgattggacgtagagtttatatcactgcatcagtacaagtttacaagaacggatcttgttcgctctgaaattaaccttctagcttctacaaatttattttatgccacataagtagtggtttttcttgcatcggtacctccaaatttagaatattacctttgagtgaattttttcaacatttgtcatatgaataatagaaacaatcaacatatcccttgtctccttcagaggtcacctgacctgtgggactcctggctgttttttcacctgtccacctcggcttactgtccaccgccagggatgcacgaagggaagctcggaccttgctagctcaaggtattcttggctcctttaccatgatgtttggcttagtatttccttgatttggtcctgtgcgcatttgattgatattgcctggacttacctgtgcatgaactacgtacgcaagctatgtatcgtaccatttaaaaattgctaagcggttctatcaatagagcagtctggaaaattttaactgatggggaatatattttatatgttgatgatgatcagtacaaaattaaaaatcatatcatctctagaagatctcattgatgcgttataacatctttctttttctgctaattgagataccatgcctaaaatgcaatgaaattaacaaaatagtggtcggatcaatagcaaaagcagtatctctaagatgcaatatttagttatttagtgaaaaatacatctaacacaaatataatgactgaccactgtagcagtatatggtatttctgttttccttgtgtgattgatatgaccagatattttgcacatattcttctcaatgtcaaatggccaatgaagggtactgatgttcattttccccatttggctgatctcaacattgccactccaacttaacattacaattaccatgcatttaaccatgaaaaattttactcctagcatatatgttacaccataaataaaactactgaatttgaaggctgggcgtattactgagaatatttgaagacactttagtcctgagtcaatatatcta

SEQ ID NO: 54699 - DNA, 601 bp, Oryza sativa
tagttttccattgagattaaaatgtatattgtagaattggtactcatctgttataataccttttgatttagtatttactctgtttaccaaaataacgacaaattttcgtcttctgatgccactggtgcagcgcgctgtgtgttccactctagtgttatagtacttagtgatgttgctgctacattgttccactggtgatataaattttggaaccgttgtatgcatgtactttgtagaaatgaagcatgtttaaatggtgtccataactttacaccacactttacggtcatgctatatgcctatagtctgtagaaatgaagcatgtataggaagttactcgtatcataactttagtgtctaaattttagtgctaaactcctatgcattctagttcggttgcttgtttgcttggccaatgaaatgaggtgggttggggatggggacattgagatatgttagtgcaatatattatggggacatcagattggtgttgcaaagtagccctatcattaaaaaactaatgtcgtatctatagattgtttcttgttgtttatctagcgcataaaaaaaataatctaacatatggttatgtactatcagg

SEQ ID NO: 54700 - DNA, 815 bp, Oryza sativa
gcgtgtatatatatccacgccattatagcggcgtgcacgtggcatgcatttttattttaagtcgcgactatttggggcacgatttttcactagccagataaacatctattttggcttacattttaatttttgtatgctattttatatggtgggcatgccttttctgaaaatattcggggcgtgactatttcgggtcagtgagaaaatcccacttaatggccatatgtttcaggccaaatttcgtatgcggatacaacgagaaagctaagtattagcgttcgccggtccgacgaaaagcgcatggaaaatatttgttcacgctacatatgtggaacgcgcatatgcattcctattttaagccaaaaattatttttgtccaatataagtgaattacattttatttcatggccatttatttcgtggccgctatttaattaaattacttcaccatctgtctctcgataaaattcttattatatatattttgtacgcactatatttgagataatacatcagtttataatttaacaaattatatttaggacacgagccaaaatccgtgtaaacactaggaaaagaattggtggccaaccggaaccactagggttcagccgaaccagggcggcgcccaatcagcctcgattttgaacttcagtctccccctctcgtctttaatccgttgtgatgcgcattcgaaggtagatcagtcgtatcattccagaatacatattcttccttttctcccccacttttgcaagcttcctctccatcttatcttaattcccttgctccatcacctccaattcaccaatagc

SEQ ID NO: 54701 - DNA, 270 bp, Oryza sativa
aggggtgggtgccgcggcccggggcctagggttcgcccccggtcgcccgcgcgtgaacgacttcttcggtgttccctcatacaagaaggtctcggtcatcttctttgcctgcaggcatcggcgtcagcctccttgttcttcttcttcctcctcgggctcctccttcgcgtcaggcgcaataagggcgcggtggagagcgatgggcggccagtgacgatggtgggcgctggcgcggcgttttttcgcggtagggagaggcgcgcggcacga

SEQ ID NO: 54702 - DNA, 1501 bp, Oryza sativa
gggtatggggtacccataatctccacagtagcccctgagaccttcacagtcaaaaagataatcttctcccgaactagattattccaaagccgagtgcttcaatcatctttgccatgatctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaagtatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaaatccaaattaaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccacggaggcgaagaaaccagtcggcggcagtcaagtcagccagcaatgaatatgaaggcgctc

SEQ ID NO: 54703 - DNA, 1501 bp, Oryza sativa
ctcaaatacaagtattatatctttaatttggatttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatactttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagatcatggcaaagatgattgaagcactcggctttggaataatctagttcgggagaagattatctttttgactgtgaaggtctcaggggctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggca

SEQ ID NO: 54704 - DNA, 1501 bp, Oryza sativa
aagcctgagcgaacggacatgagaaacacatatgattagctgtttcatcttcctgattgcagatgtcacagattgcctcctgaacaatggttttcttcagcaaattttcttttgtggacaggcgattacggaccagtagccatgcgaagagtttaacttttagaggtgctctgcacttccaaataagatcccagttcggagatggcatgcctgggggtaatcttgcctcatagaatttcttagttgtcaactttcctagctttgcactgaggcggaaatccatctcctcgctcggagagaagttctgcagcaattcctgtaagcagcacagctctgccgatgcagtttcagataaacgtggaacaagattttcagaaattcctatgtgaagagcttcctttacttagatttgtctgtcacacacatgggagaagagattgctgaactgacttgaaaagctttcagtcgaaaaccatttgtcgtaccaaaaggaggttcgctcaccatttcctaccacgacttccgtcaaagatcgcagttctggcaacaacttttgaaaggatgcccagtgatgccctagacgagttgagcacagtaacgaggaatctgaaatttcgtcccagacccatcgagtccaggaggtcttcaagttgtaaagagcaaggagtcgtttgagaagaagtgcctcgttctgaatctttaagttcttaataccaagtcccccatgttcttttggcttgcaaactgattcccaagaaaccagacattttgctcccgagcagacatcatcccctgtccagagaaaagcccttcttcgtctatcaatttcttctataatttttggtggaagtttgaaggcacacattgcatacaccggtaggctgctcaggactgcgtttatcagaacaagacgctccgcctgcaataggagagatgcttaccaaccagataagaaaccatcaaccttgttaaccagaggctacaagtcagctgcggacagtttgtgaattgataagggaagtccaagataagacatcggaaatttctccagcttgcactgtagcaatccgacaaaactagttccttgctttgatcgacatttagagtaatcatagtgcttttagcaaaattgatttgcagtccagttgccttggagaactgcagcagagtctcctttagagcaagaacatcagcctcctccgcacaacagataatcaatgtatcatccgcatactggatggtggtacacagcctgtcttggtagattgcatgtctgatttcagtatttctttcaagcaatctttgtagcacatcagcaactaagacaaacaaatatggagatagggggtcgccttgtcgaaggcccttcttgcagcgaatccatcttccagggactccattaagaagcactgcagacttggaggaggaaagcaaccccttaatccagctaatccagttttctgggaaacatctgacagcaagaatcttgaaaaggcttgac

SEQ ID NO: 54705 - DNA, 1501 bp, Oryza sativa
cggtctgaaaatgtgttaggaactgatgaacatgcatgactaaggtctgcaattatcttttttttttagagaacacaaaccaaaactatctcgacaatagctgtcagactcattctcaaacattcagagttcaggtagactaaacttgtaggctgatttaacaggaaagtctttttcttctcgaggggatgtcccatatgcatttcatcttttttatttttaaaaaatattaatatataatatattactccataaacatataatttcaaattcaatcactacaagttgctttaaaaaataagactgaacatacacgtaccagttatagtttaattcgtctttttacaacttgtagaggttgaaattaatgttacaagtttgtgaagtgatatatttttctatcttactatttttctaaaaaaatcatatgttatttgaatgatatacaagaaatgaggggacattctcttgaggagaaaagtcatctctgcctgaatactgcacctcttgatgtagaggctaaaataatctctattattgaaaaaaagtagactgaaattattttccagaattttccaacatcacattgatcttatttgtagtcttaagaaagaacataatctgcagagtacataaatgcacatggagtctatgcagtggaccttgactggcatggagagtctttaggaaaatgccagaccacttgagtgactcactgcagcaatacacaggcagttatttcctcacctgaaagtaagcatgttgccaatgccactatcctcgagatcacattcaagcctaaccactccgctagaaagacaacctaaaagcaagctaggtaactactactgtctgcacaaatgagaaagatagctgaaccatcaggacagaacacacacacacagagacatacatgtggtgtttggatcagggactaaattttagtccctattacatcggatgtttggacactaattagaagtattaaacgtagactaataataaaactaattgcataaatgagagataattcacgaaacaaatttttaagtctaattaatccataattagtacatgtttactgtagcatcacataggctaatcatggattgattaggctcaatagatccatctcgcaaattagtccagagttatgaatgggttttatcattagtctacgtttaatacttctaattagtgttcaaacattcgatgtgagagggtcatatctacactacaacttattccattcttcaattttgtattttctcggctgtgtttcagaatattctccagtcaccatcttgtatacatgaggccggggactctgttccaatatagtttttttttgtcaattccgaaccttatttcttagcatacatgtagtggtcaccgagtgagatggatggataccagaaccgacatgcatcactatactactcaagtatgtaacttaccatgttttatctctcatgatacataactgggtaaaacacaacgt

SEQ ID NO: 54706 - DNA, 1501 bp, Oryza sativa
caataaaaaatcctaaactttatcagaaaggaaaaggagattgggtagatgtgtgatgtgtctaagaagagaggggtagaaagccaacaacaagagcatctaaatggacaagtaaaaaggaggactagaggtggttcaattatcgattacttaaaatatccgtagtggtgatggtgaagctaacatagacacgtgatctattaaccgtggatcaaaaaatcggacgctgcagagcgacgcactcctcctccgcaccaccatcgcgcgactcctccgtacatgaccccacttttccgttcctactgcagctcgtttttcctattttatagtttccaaccgacgtggtttataattttgatcatacaacagtgaaatttggtaagccccgaggaaactgtcggcctaaaataaatatcggcttcagagttttggaattggccgatgggagttctcaagtcgccaggagtcggattcttggaggattcggttaaggaagtctatccagaagagaccgacttcaagaaggatgcggcatggcggtttatgtattaattatgaagagtttgttagtttccttttatctttaggaaagtgtgtttagtgtccaataaggacttcatgttttccttttatctttatgaaagtttttttcttgtccaataagggctagtatctactcatgggtataaatatatacacccggagtaattgtaaatgatctcacagattaatacaactactctcggtgcatcgccatcctctttaccgagattttacttgacgcggggttgcatcggctttcgatcttcggcgaaggggtaagtcctacgttccgccggccttggcaattgtatcggctacattggtgttgttcaaggctgcatcgctttggtctcttggatcgctctggttcggttgatattttggcctacctatttatcatatatcttagttaatctagtttggtagcttgatttacttgtatcggctgagattcactttagggtttatgccggtattggctaaatcgctttgctagattagattagctaaggtatctaccaccctgaaaatcagtcaagggcttgctggcttgattatctagatattgtgtttgttttcatacttagtgttgtatcagtacattcgacctactatgtcgtgtttagaaccataatctctagcctgcttttttattgccaataaggatttcatcggggtttcagctgatgagatatctggacgttgcatcgatttataaggagtacatacaagttggatttagccgatcgcaacaaaggttatactgtttatctaatcttgcggatttaatgacatcggacctccagccgatatatgctttaacctttggatcagtgcttattctatcatattgttagccgattggtttctactagattttattgttgtttcgttacattatcattagttgattgtctttatttacatcaagtgtcagattctacatcaaccatatagc

SEQ ID NO: 54707 - DNA, 1501 bp, Oryza sativa
gcttattctatcatattgttagccgattggtttctactagattttattgttgtttcgttacattatcattagttgattgtctttatttacatcaagtgtcagattctacatcaaccatatagccaatagctcaaaactctatcgctatcggctagtatcgacatcgactggaattactctattggcttgtcagccgatcgactcattgatctactatttgcatattttgtgagttgtagaatcaaactaactggcacgcccgcatctcatcaatctttggacctgcactggagctaagcagatctcccaggctgttgtgttcgtcgacttaattcgcgccaacacatacccgacaccatcggccatgcgcagatttttcgtcaacactatgacatcaaatttattcattttccggagattcacataaaaaaataatcaaaggaaaagaaggagcgtgaaacatcctcgcctcctgcctacccaggccacgtgataaggcccatcaagattaggtccaatataagattagccgatcaagaatcactttccatccattgcagaactcgtcgaataccaaggctcataaacaacgccgacgctgacgccaaattcaccgaaaccaatctacgtggccaccaaacgatgtatgcattgccctcaattccgctttcactgtcactgccgcggactccaccgccactgttgccgtcactgactccgccgtccccgccattgccgtcgccgctaccaccgccccaactgtcatcttcggcgcggccgccgccttcatagatagaagcaacactgtcatcacagagatcaatcctttggtaatgaagttaagcacctagctcaatgagtccatgacatctaaggctctatgctatcttgcaatttgtactacttattgcaggcagtacattagctagctaaggttaatgcatggtactgtagattaatggttggtactgtagattaatacatggtattgtagattaaactagctatttgatcaatctttttttcaaagcatgcatgcgatgcaagaggctcttgtgtgtgtctttgtcaactgcttggacttgcaatcttttgctcatgagtgacccaacataagtatctattggtttttgaaaacaaaggtttgccttaaacagaagtagtaacaccgaactgatttacgtgcttcatagttctgaaacaccatagctggattttgcgtaataattctataacagttagcatatttgagacacaatttattgtaataaattcctgaatttccccaaatttaatcactaagtgcattaactatatcttttcagtgttatataatttccctgtacaatatagatccttgcttaattttatgtggtactcaggtcaatcaagacgccattcatgctgatatgattacaacccaaccctcgaagaaagcaaaagattcggaatgtaaggataatgcatctatttttgtctcaatctatttaataatgccaaa

SEQ ID NO: 54708 - DNA, 1501 bp, Oryza sativa
tccctcaaattcccatggaatgtcttaatacaattgttcctatgttcttgcatccaatggtgacaaaactattttttgagagaaaacggtaacaacatatggaccctttcccccctcccccaattctcactcaatccctgcattaagaaaaaaaatggtaagaacagtttatacctagactatacaaaataaatgggaagatcttggtactacaatgtgtccgtgctattttactaaactagaaggtaccccgcggcgttgctacggaacattgtagaaaaaaattagaagaatagtttgtattggaagtaaaaggattctaaagtaagacaatatgtgaatattaatttgattgtatgatagggtacacaaaagttttgttagactgaaagggaactggcatatatcaaaattatgattatttgaaagcacctagagtatttagtttggacatagtcttgacaacggaaacaggatagaccatgattacgaaaatagtaaacaacggatgtgattattcggaagcatctgcagtctttaagctgtatattatgtattgacctgcaaatttcgctggacaatgtattagaataaatcataatcggatttgcttgtatgatgaagcaaggcttccaaacatgggtgattattaatgactaatttgatttgaactattagatggatgatggattgatctaaggtgaccaaacatggtctacaatttttgcttttatctcttaaaacatccgttacaacacacgtgcctttatctagttcttgttaatttcaatcgatatgtatttgttttttccatgtaaaatgtagtgaattggtttttttagataaaaaatgagattttgagggagagacgtccatccaaaaaatttttaagaagaaattataagcgtgttggggattgaacacgggacctcgagttgaaaccatacatcccttgccactgcactatcaagtgcatctctagtaaattggttttgagataaaaaaattgtagtataattgtttttttttgttttggaaaccaatatcactactgattcaccccttgaatcggcatatgatactgaccaacattgccagttgaacaacacacaatattaatgcctaatttgatttgagctattagatggatgatggattgatctagggtgaccaaaatcaggaaatgtgtattccacagtcgtgcttcgcttaaaatttaatcagatagtcatgcattgatgacaacgtggaaagctattatgaaagagaatatttaatgctacatggtgggaggcaattgtatagtaatgcaggattacaatacaaggtaagataatttaagcctcatttagatgggctttattctcagcacttcggcccataaaaacaatgatttagtgaaaaacaatatgcaccataacacatgtaaagtaggaaaagggctcaacatatgacataccacgtttggattgcagcaaacaactttattagttatgttgtt

SEQ ID NO: 54709 - DNA, 906 bp, Oryza sativa
catcagaaaaaaggtaaattagaggctacctatgaaaagcgattgcacataaacacacgcggcaacactatatgtttactgtaaatcatagggcaaaattatgccactatctaaccaatgaggactttacagtgcctggtatcacttatcaacggttgagttgccaaaaaggtaacttaggaatagaaaatagtaacacgaaaataggataaaagataacttaggaatagaaaatagtaacacgagaataggataaaaggtaacttaggaatagaaaatagtaacacgagaatatgataaagtaacttagggatagaaaatagtaatggttgagttaccaaaggatagcatagggatagaaaataataacacaacaaccgcaattgtattccaagttacaacaaccttttaacttcttcctggttttgtttgcagccagcccactccctcgtccagccattagatgatcacacgagctagttcaattattgctaaataccatgaaaatcaattgctcggggttagatgtgtgttttagtaagttacatcgcaggtataattacatactactttgcaaatttgttcccagcaagtcatggaatatatatggggcaattgcatccatgtccccactttgaaagccaattgttgttttgcccccattttttagggtttgcatttttacccccaccttttgaatttgaagcagccgtctacccccatttatgacagctatttggtgggtcccacattatgtgttaaagaaataccaaaagaaataaaaaaaggttttaggaattatgtaatgacacttctacccctaagggaaagtgaatggacaggattcttctcttcccgtgcgttgggactccttgagtggagtcaactcaaaaccctagctagtag

SEQ ID NO: 54710 - DNA, 1501 bp, Oryza sativa
tgcatccgatctgtttagttagatcttgttgtgaaatcccccaaaatcgctatgccgctactcttttaaatgggataagggaagtcgtaagctcaggcacgcactgacgatccctcccccaaacgcaaagcaaccaccacaaccatggcgccaccacctacccagccacgatgtacggacaaattaccatcccgctacgctcgcatagctaagtaaatcagcgatcaaaatggcagcagctcatccgagtgcggcagcgtcaagcccagatgagatgaagtggggggcgatctacggatcgacgacgatggggagcaccgatccgagcacgggaggcggcggatggattgggtaggagagaggtaccttgaggccgtcgacggagaggaggccgctgaggatgcactccttgaggcccgtccccagcacgatcacgtcgtactcctcatccatggcggcgagcggcggcggggaaggagaagtggggggttgacgaaaggcagcagcagcgtcgtctgggagtcgagaagcgtggatgggatggtgagatgagatggaggaagaggaagaggaagatgcgttggccgcccaaagacgattcgagagagaggatctggggaggggagcggaggggacgtccctttggcgtacaggtccttaggaactggagtatttgcgcacgatcacgtcatatgcacgcagcaaattttctgtttggtactcgggcatcttcaggcagttccaaaaactttttcaaaaaaacatcgaatctttgaacacatgtatgaagcattaaaaatatagataaattaaaaaactaattgcacagttagagaagaaattgcgagacgaatctttgagcctaattagtccatgattagccataaagtgctacagtaacacatatgtgctaataacggattaattaggctcaaaagattcgtctcacggtttccatgcaagtcatgaaattagttttttcattcatgtaaaaaaaactccttccgacatccggtcaaacgtccaatgtgacacccaaaaattttcttttcgcgaactaaacaggccatcaatgtttaaggtcgctaagcaataagataggacccatagcctcatgtttatttatataatccctcccttttaaaatatttgataccgttgactttttagcacatatttgaccgttgtcttattcaaaaacttttgtgaaatatgtaaaactatatgtatacatatacgtatatttaacgatgaatcaaatgataggaaaagaattaataattacttaaatttttagaataagacgaacgatcaaacatatttaaaaaaaattaacagtatcaagtatttagaaacagagggagtataacacatactacagtgtatatggccttttcttaatcttaagttgggactcgctcataaaaaaaactctattcaacatgaatgaaagagcaccatgacatactactgctcatcatgctataggagtgaaaaagga

SEQ ID NO: 54711 - DNA, 1501 bp, Oryza sativa
tgatgtttaaatgtgatggttgttagtgaatgatgatgtgacatcttgttaattagtggattagtggatgatgatgtagcatcttgttagtggatgatgatgtggcatcttgttagtggatgatgatgtgacatctttacatgttaagtttaaggagttagtgggggataactttatactaagataggataacacacttccctgtggtaaaaaaaagagtattaacaacattgcatacctctaggctcaaggttcaaagtgtgcctccttcaagctccctctgaagtgaaggtacacatgccacaaccaactcgctgtatgggcgacagtgcgaggcttatataagagtacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagttttgctctctctcttcatttaatacattccaagtaggaaaatatgctgacatggatctcttgtagagagcctatagataatcattgtgggtgccctaaagtagagagttaggattagctggtcatggaagcattaaggataataatttatgcaagcatgaactagtgtccgcagccggccactaactaaaaaacatcaaaccatttttgtttcattctggcgactcaactgatcagcaggatgaacgaccaccaatggatccagatggatcagtggttgccacacgttgagagatgggatccagatggattttcagtggttgccgcacgttaagatagggtacctgtgtttgtactgtattttaaaaaaagaaaaataaagaacctgttcttttaaaaccaaatacccctgttctttttaaaaccaaacagccgacctgtgaacctcttatgactacgaaacagatttcatcactcttaaaaaccaaatacacctgaagattctgttgaaaaaacaaaatgaaccggcggcgttctgcaaacactcattattaaaactttcctcataattggttgatagggttattgacaaatcaccatctgtttcctatgtgtaggtaattttcaggacaacatattgacttcagctctggggtcaactacaaaagtgtgaggaagagggagttttcctgaatgttgcatgtcgtactcttgagtcaacggttatgcaatcttttgctaatcatggatggagattctctaataggctggaataatgttttccttgtcatgttaggtctttcttttaattttggttggtttgatcgttttattttggattaagactttatataagtgtgttactatttgtaataattggctatagctctttggagtaaaggccgggatgtttcattccattatctaaaaaaattggtatcaatactttactcctaatttttacggatgatcaatttagaggatatgtt

SEQ ID NO: 54712 - DNA, 259 bp, Oryza sativa
ggcccatctccattccgggtctctctctctctctccctctctctctttccctcgttatgccggcgcgtgccggaaccgcgcagagcgcctcctccctccagtcgctcccccctccccgcttttatcctggcgagcaccccgcccgcgaaatcggcccccgcgccccgttgttcgcgcgcgcgcgcccgcgtggtcgccgcccgtcccgcgcttgcgccgtttgagtcatccggccccgctgccttgccgcgcctgcagc

SEQ ID NO: 54713 - DNA, 820 bp, Oryza sativa
acggcgttctgcgagcggagggccggctcgtcgtcgctgtcgccgccccgctccagatcccggagggtcgaggggaagacgaagggcggcgccatctcgtcgcggcctcggcggagtcgcgacggcagcaggacgacggcggcggcactgggtggatggggtggcgggcagggaggaagccgagacgggatggggaaagggggagagagagaggagagagggggtgggacccacaccagatggccagccgtcctggctggccaactttggctagtgaggtggggaatttagccagccggatggcttggagagccatttagctagtctgttggagtagatttttttgtccaagttagctaaattttggcttggagagccatttagctaggctcttggaggtgctctcagtgaagtcactttcccgaccattccttctacatgctagaggtctctgtctcaaaatataatataaaatgtaatagaatctaaaatacccgtaagaattggtttggtaatctaaaatacccgtaagaaccaaccgacaggtttggaactcgtttttttggacggaaggagtaaaacaattagaaaatctagaactttgattattgcaaggttgaaaaaaaagaccaggatgtacagtagtgcagtcaagtcagaggagtgttctctagctctagccggcaatgaaatgtgttccgagtcatagcagtaatttgctccgaaatgggagtacgtagatcggaataaaatagctaggaatatcatttgttccttcgtgaaaatcttgagcaaaattaagtccatggcggcgaccacg

SEQ ID NO: 54714 - DNA, 755 bp, Oryza sativa
aaggaatggcttcaggtccttttgcataaagctaattttacaattcttttcacaagcctaaaacctagcatagactgatcaaattttagtaccagtgttcactttaaacaacgacggttctgtcaaccatccattgtgatcccaaggatagcttcccgccattgaatcgtcatggttttctgaggatgtccaccttccctcctctcgggatgtggctccatcagcataaaattcatcatgcaatatcccattccccacaagttaagaatttagagtctagccaagtgtaatacatgtcccggtgctcaataaccgcgagcacggctattcaaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgcagggcacgcctctcggccctacctcaacggctgtcccatcgtagcgcacctgcctcactcaggggtgaaccatctatgcagggatactgcctccgctcggctatctaatccgctagg

SEQ ID NO: 54715 - DNA, 634 bp, Oryza sativa
ggctttgagggttccaaaattaattaaaatatcctaatgtggccattattattacaatagcacattgaatgaacttatttgtataataatgtattttacgtggatctagtaattcggtaaatataaattgagactcggtacaatattaatctaattgtctaattaaacactcacatattcttatttatatataaagcttaatttatttatgaccattattttatatgagtgattttcatgtcatgagtaactcggtgaaatgttctaagtatcaatctatatatattccggtgaattacttatttataaacacgatcattatagtggtgatcatcatttcatgtgttcttatatttcatgtgagattcgattcaaatgaataagatttaatcttactatttctttagctaattgtgacatcaagctatcaatcatggttcgaatatttaatacctgatttgtaatttgtaatagaaattaatatttgacttaactatcttgtgcataattatttgtaggattaacgatattatattctcgtaaatttatctattacttaaattttagacccttactttactttctttgtgatcatttacggtttggcaagcaatagcaatcataacaaccagca

SEQ ID NO: 54716 - DNA, 1501 bp, Oryza sativa
tttcaacttatgcattgttttctgtcacgcccggaatttctatccaaaattccaaacgctttcatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataagataaacggcgcagacgactccactccacaggcagcttgaccaaggctacacctaatccttcacaccatcagcatcattgtagaactcttcctctgatgaatgattgcaaggtgagtatatgacatactcagcaagccacgcatcaaatatgcaagtgcacaggataacaaaggatggcataatagggttccatttgcaaaagcagcatttagcaaacatttgagaatttaataaaacagttaagtaataattaaacaatattaatccaacactatacaacgtaccctgttgtataggcccaaccattctgaacaaccatcccggctgtacagatctatctccaaaccaggaatgtaccattccaaaccaggagctaatcaaattattaccaattatagcatcttctattagggtgagaagtgtgggactaatcacaaaagacattgttagactcgcccataaccgcgggcacggctattcgaatagttttactctgatcagagatgtaccactatacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaactatgctatacaaacgataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatcccaataatgaatcataagttatcccaatagagacttgaaccaactaaatcggagctaagatgaattagttatgaattgttaaggattaaatcggattaaaacacttatatcggtttaaattgaattatgacgcaataatgaattatttttgaaaaggaaaagaaggtttattgcgtcagcgcagcttagggtttcatatgaaccgggcgcacgggcgtcaggttcacgcgaacggacggccgagatcgatccaatccaaaacggacggccgagatcgaacggtccacgaccggctcacggcggacgaccccga

SEQ ID NO: 54717 - DNA, 1501 bp, Oryza sativa
ccacaagccagcatgggcaacggctttatcgtttgtatagcatagttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtatagtggtacatctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacga

SEQ ID NO: 54718 - DNA, 1501 bp, Oryza sativa
catatctaaataaccgtagctccgtttcaggtggttcaagttactaaatttttctaaaataaagatctacatattaaaattgtccataaattgaattaaatctatttaattctttttaaatgggctttaattagatttaatcttgtaaaatctataataaattcacttggagtcagaataaggccgttcaagtctcataattcatctaaaatcatgatctacatgtttgttacctttatatgtattgtttatttgggtttttattagccttttacttcgttttgcgtgttagcttgtcgtttccgtcgttgagaaggtttgtgagtgcgtcggaagtgatcaagaagattaattgaagatcgattattgcaaggcaagtcacagatcctaaacacaatcctttgagcatgttgatcctatatttaaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatca

SEQ ID NO: 54719 - DNA, 1501 bp, Oryza sativa
ttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccgccagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccggaagagttttggtatggctctagcagctcttgtattctcttctgtaatactttccgaattaatgaaatactcatttttatacatcttcggtattttgttcagtctgagtactggtcttacattatatctgtgttatattaattatgtgggtagcctaccagagaggtgtaatggtgcgggtttaatgtctggtttaccagttgctctatgtcgtgtgcgcgggtatagagtagtatttagtaatgtaagtgtggtacttagattattaaatatcattaattgggcatatatgctgcgggacagtagaggtgggccgctgatggtgatagctcagtactggtattcctccacgttagtatatattcctaagacaaattcctggggagggtactcctccgtatttagccccggttggacggccatgataggttgtcgtaaggaactgggcaacccggggtggtctctcgatgtaccaggaggacactgtaggggggtattggccatatgattgtatattagcagatgtaaactaggaattgagtgtatgttagaagtatagtaattgagtgctttctattttttcttccacttagttagaattattttattatgaggagttgaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagt

SEQ ID NO: 54720 - DNA, 1501 bp, Oryza sativa
tggatgcagggtttcttctagacggcgtggatcactccccaatgatggttggagggcagttccgaccattccaactgccacaaccgtcattggcagcctatttaaggagctcctcttctctctccacacacgcacctcaagcaagagttctctcatattcactcaagatagtttagtagtcttaagctagtggagtaggaatagagtagaaatcggagtccggaagccttcagaagagttcgggtatggctttagtagctcttctcttctctttagtaagctttgtacttttattagaatactcttctttatacatttatggtattgaaatactttccgagtacatggatgccaactttacattatgttcatgttatactgattatactattagcttatctcggagatgcatcggtacaggtatagtgtttggttatgcaattactctatgtcatgacaatgatattagagtagtatctgttagtttaggcgtggtatctagattgggggatatcattatttggggttatatgctgcagatgagcggtgggccgctgatggtgatagctcagtacgggtattcctccgcgcgtgaatatagtcctaagttaatttcctggggagggtactcctccgtattttgccccggttgtatggtcatgatgggctgtcgtaacgaacttggcagttaggggtggcttctcgaagtactaggagggcatcggttcgagggtattagctagtatgtcagataactagaatgtatgtatactatgtatactagaagtataggaatagatttcctttctcttttttttccacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtgga

SEQ ID NO: 54721 - DNA, 624 bp, Oryza sativa
tcaggattgacccatcgtgacttatcaataagccatcatgaaataatagtgaatcataagttatcccaatagtgtggtaatgtttctaagtagggctaagcaattatttctaatatctagttgaaccaatataaataaagttcaaccagtcaaattattataacccaaggtatcaaggaataaagtaatcaagaacaaaagggctataacaaacaataggttaattccacccaatgacattcgaaaataaatgcaatagttgaaaagaaacaatagctttaaacgggatcaacatgctccaagggttgtttggaatctgtgtgacttgccttgctggccttggaactcttcaaactcttctccggcgaaaacggactctccaaaaacgacggaatctaagcagaaaagagcaaaatcaccaaaacagcacataaacaagcatgaacagtacatgtggatatttttaatgtgtagatctcaattttagaaaaaattagagacttgaaccaactaaatcggagctaagatgaattagttatgaatttttacagattaaatcggattaaaacacttatatcggtttaaattgaattatgacgcaataatgaattatttttgaaaagg

SEQ ID NO: 54722 - DNA, 1501 bp, Oryza sativa
tctcgttcaaacgggcggatttgctcccgcaaatctcgccggcgccattgatggagcccgagagcgccgcgccggtttccttctcctccggccgccctctctcactcccaaccctatataaacactccccgtgcctcctccaccgtttccgccactcgccgctctctctccccgtcggaatcgagcccgcgccgtcgctctctctctccgccgtcgccgccgagctccggtccgccgccgtcgtcgctccggaccttctcccgcttcggcgtcgcctccttcgggttcgccgcgacctcgccgacctcgtcaccccctccgtttcgcccgccgaccaccggaacgccggcgtccccggcaacccgagccgcgccgccgccttcctccgctccggtcgccattcccgtcgtcgccgtcgacccggggtgagccgtggaccgctgtttcgcttcccccttccctcccctctctcggccgccgctccgccgtgcctatggccgccgccggcgaccataggggcgcgggcgctccgcctcccgtcggctgtgccggcgtggccgccttcgggcgcgtcccgcggctgccatgtggggcccggccgtcagccgcccgcgccctcgggtgcggctgacgcgtgggacccacggcgccggccggcgtaagccgcgtgcacccggtccaccgtggaccgtggggctgctgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggggtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttacaaaattaggttgatttaaattattgcattatcgctttatttaaattcccgcgttatcactgttttatttagccatgcctatttacctttgttatgaccttattattattgttattgttattattaccttattcaccctagaataaacaaaaccccaactagtggacactctactcatagtaccactagtataattttaggtagatgcttcgcaatttaattaggtaacattaggcggtttacaactctagactttgggaatattcatatcacctggacactttggaatggtttggttgttgtggaattggcttcacaccgccccctctattcaaaatccccaaaatggttttaggctgggctcggggtgcatggttttgatagtagcacctcggccatataaggaccggt

SEQ ID NO: 54723 - DNA, 1501 bp, Oryza sativa
ttggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgaccttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaagccttggggagacttcgcatcttcatcatctgaggagacttgatctgaatcttcactaccagacactctacctccattagctaaaagatgctctgtcaactgttgtgcacctcgggaggaatttcttctctgatgttttgtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgatgttgcatctgactcgggttcaaaattggcatccgatgctgctgtagtatctctataagcaattggttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcggatcctgcagtcttccggagcttcggcaaacaattgacgacatcttcttcttcgcaaagctgaccatctagtactagttga

SEQ ID NO: 54724 - DNA, 1190 bp, Oryza sativa
cagtggtacacctctggccagagtaaaactattcgaatagccgtgcccgcggttatggcgagggtctaccaatgttattcgtgattagtctcacacctctcatcatgataccaaatgctataaatggtaataatttgtttagctcctggtttggaatggtatattcctggtttggtgataggactgtgcagccgggatggttgttcagaatggttgggcctatacaaattgtatagcgttggattaatattgcttaattattaactgctttattaaaatctgaaatgtttattaaatgctgtttatgcaaatgaaaccctactatgccatcctttgttatcctgtgcacttgcatatttgctgcgtgacttgctgagtatgtcatatactcaccttgcaatcaatcatcagaggaagagttctaccgtgaagccgatggggtggaggattaggtgtagccctggtcaagctgcctgtggagtggagtcgtctgcgccgtttatcttttctttccgctgcttagatctttattgattgagaggaactatctacctctgtaatgacattttattcgtttattaattagagtaagaattgtactctattatcaatttgttattgtgtgcctcggatgattcctggatgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatgtatttcataatatttttttagtggttctcattcaaaatttattccagtgttattagtactgtactactggctcatttaccagcaaaagttttacaatattgttttatttaatcttgctgcaatgaaataaatttagcatgttgattttataactttcttttatttcttttgaaacctgttgttcaaaagtacaaaatttgtgaccttatttccaactatttcaacttatcctgcaagcttggtttactttatttacttaccttttactttgattttctaactttactcaaattaatccaaaaacttgtgctattaattggataaatgtcttaactccctcctttcacttgtctttaga

SEQ ID NO: 54725 - DNA, 239 bp, Oryza sativa
cttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctcccctcttcagt

SEQ ID NO: 54726 - DNA, 539 bp, Oryza sativa
gaacttgcttgctagccgatatatgcttataccacacagtccaactcttctcgggggaagttttctcaagagagggccaagacttgaacatgttcttccagtgacctagattcgggttggccaatctaaaaggaatcctattggtttcagcgatgatgaactcaataggatcagggttgccaatcggaccaagaaaatagtgatgctcatgcgacaggctaggaatcgcgaccagattggacagatgctacagatgcaaacaagaatagagaagaagaaaacaagatgagacaaagaagaaccaatctattgcgaaaggagaggatctagccgatggatacttacctctgtgtatttggccgatggcgcgatagacgggctggcggaagttgacatcgccacaggcggagatttggccagaagggaaaatcgccttggggtcatgtggtgcgccgaggggatcgccggagagagaaaagatgagtttggcttaagcggtgaaaacggaggtgacggtgtgaagtttcttaggggtgacg

SEQ ID NO: 54727 - DNA, 1331 bp, Oryza sativa
cagaatgaggccgttcaagtctcataattcatctaaaattatgatctacatgtttgtttactttttatgtattgtttatttggtttttattagtctttttcttcgttttgcgtgttagcttgtcgtttccatcgttgcgaaggttcgcgagtgcgccggaagtattcaagaagattaattgaagaccgattattgcaaggcaagtcacacagatcctaaacacaatcctttaaacatgttgatcatatatttaaattctctatttatttcaactgtgcatttattttcgaatgtcactgggtggtgtgaatctattcctttgttatggcctgtttgcattgattactttaatccttgataccttgggttattataatttgactaattgagctttatatatattggttcaactagatattagatataattgcttagccatgcttagaaacattagcacactattgggataactcatgactcactgttgtttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgcctctggtttttgagggggtgattatgatccaggaatggtgcactatggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatagatgttatacctggtaataatttgcttagctcctggtttggagttagatctgtacagccgggtatggttgttcaggatggttgggcctgtgcagcacgggtgtgttgttcagtgttgattaaaatttctaattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagt

SEQ ID NO: 54728 - DNA, 1501 bp, Oryza sativa
atttgtatatctaattcatagatattaaatatactaaggtaattaaagtactaaaagagatacatcaagagacaaattatataatattacatgtgagctcataaaatagtgattagccgatcttttatcatgtttataggtaatagattttcatacatgttttataatatgggacatatagacggatacatgtcatcccgtatcctatagaggacattttgaaacttttaataggcacaatcgtgagtcaacaagtaactcgaaatgcccgtaagaaaagagaattgattttcaaaatggtagaactagatgacgaagtttttctataaccttgatgaagaggtagttttagtttacgactccgatcaagagtgagaagtctttcatttcagattggactgctatagaatctggactcatcgtagagacgttcaaaaggctcctgatgataagaatcatactttcgtggaactccatggggctatgggcttcaacgcggtagacgttttgttccaaatttttctggagcaaacctccaacccaacaataaaattcgaatgaattcggattcgaactcggatagtatctggtatcctatttttttctcctatattcctcccacgagccttgagttgggcgagtggtcgagaaatacccgcaccattttcatccctagccgtgacgcctaggggcaaatatatatgggactatgacaaaatctaggcctttggtttaaatttgaaccaacggtataaaatttgcaagatttagatcctagattcctgtcaaattacatataggcagtcaaaaagaaatggcgggtacgcatatatatcgcgcacgttcccgccaaagtttttgtataaaatgatccctcaattgcatcaacaagaagcagataaatctcgctctgtcgtgcgcactctgcaagcaaattaaaccaggaaaaaggctctaatcgtgagagggcagagagacgatggaagcgacggcggtgagcttggcgaggtccgtcctcgacgtcgtcctgagcagcgttgggcctgccgtcgccgacgaggtcgcgcgcttcctcggcgtccccaaggaagtgaagttcatccgcaacgagcttgagatgatgcaggccttcatcaagacggcctcctcttccttgcaccccgacgccgccgccaccgccggaggcggggacaacgacatcttgaggacgtgggtgaagcaggtgcgcgacctggcctatgacatcgaggactgcctcctcgacttcgccctctacgccgccaggatctcgtcgtcgccgacgggcagctcctggctccggccaggccccctcgcggcgcgcggccgcatcgccgaccggatccgcgagctcaaggccagcgtcgaggagctcaaccagcttaggctgcgttaccatatcgtcgtcgacgaccaccaccacccgagccgcacgtaccatgagcgcgtcgtcgccatgctccccggcggccatggctcgagc

SEQ ID NO: 54729 - DNA, 977 bp, Oryza sativa
ggggtcccccaaataagccctatagctagaaggcaaattgctcgcttatatattaatatatggcatgcaaatcaaatccccaaataaacaacaaaatgcactgttgaatggagtaacgcaaataaatttaggccaaagcaacataagaataacaaaaccaatgcaaccatgaggaagaaagaggttacgaagcatatactgatgacgcggtctgcgagagcatgttgattagggaggaagttgctgcggtgccagtgagggcggaagagttggcgattcccgtagcagcggcagtggcggaagagatggatgcatcggaggtcggaggcacgagcaaggggaggaagtggaggcaagggagaaatttgcatgtgtgccatccttaggaaaaacggcttcgctagaaagccatagttaaaatggaattcgtttgaatgctactcttaagctgtgggtatttcctacaatgtaatttttgttgtttcttgcatttgtaaatcatttttcatccagttaattttttcttggatgtttttgctcctgcctgcatggtttgaacgaaacaacatcctctctctctcgtgaatcgtaactacgttttcaagaaccgaacaagcgcgagaaggggcgattgcaaccacgccagagccgcctaccacctgctccgcctgccccaccgagccacgcagcttccccacacggagccgcgctccctctccctccgtcgcattcgcaccaccgcctccctcgactccgatcacttgcccgccacgctccgcctccctcgactccagcgactagcccgccactccacctccctcaactctagcaacttgcccgcctcgctctagtgccaggagacggcgctgttccgcgggaggaagctacgcggctccgcgggggaggcggtgcggctcggggaaaggggtggttggggaaggtggtagagtaggtggtggttgtcgccagcgcggtca

SEQ ID NO: 54730 - DNA, 1501 bp, Oryza sativa
aaggccgccacacgatcgataagtgcacgtttatacgtacgctgtgttagggcttaattaaaactagaagagagagagcgcgtaagaactacgcgtttgtcgtttgcttttgtgcatgtgtggtaacggggcgaggtagtttctgtgcgtggcttgtgtgttctaaggttctgtggccgtgttgatctgcgtatatatgcttctcgatcggtgtggatttgttttacctttgtgctttggtgttgaaggctgtgcctgtgttgcttgttgcttctgtgtgcaagcttcatcgatctttttttttcttttgaaaccctctgccatttttatttttatatttttttctcgaaaatggaatcagaacagtagacccgaaaacgataacaatatcaataataacgatatattgaaaacgggactgtcggaatgaaatctaccgatattggtcggaagtcgaaaattcatgtcggaaataacggagtgtgacataaccacacatttaactatgcatgaagataaatttataacttcattattgaaccatcacacttcacgtaacaccatgatgtgatgattgatgatataataataagtccgacgaacaatataattacaaaggtcaacagttcttcaacatcgataagttgaaaagaccaaagttcagcaaagtccacatgccacactctagggttaacacgttttcccctggacacttctcctttctaataggctaaaagcttattaggcttcctcaattcatgggcttccgatgggttgggctggctgggacactaggaatgttttggaattttgatagaaattattagacaaatagggttatcaacaaaacggtcgaaaaaacctccatcccattttgctaccatttttggaacatattaccatttccatttccaacaccaactattgcctgcaccgactgaaatgatcggtgcaaaccagaaacagcagcctgaaatctcgaagattttcgtaccgttttcactcctattggagagagtgggtggcacatactactatcggaactcacttcggtgccagtagggaatcccatataggagctagatttttcagccggcaccacggagatggtattgatgagagggactcatcgatgccagattgaaaatctgcacctatgagttgtactacatttctgaaaaaacaaaacaggctcgtcttaattcaagcggaggtgatgctccataaaataaatcacaaaatccttttaaaaaaagagtcacaaattcacatcatagaatatgctgatggattgagagtagggagatgggagagggagagaggaagccaaatggataaggacagggagagtgagagaggtgaatggttaaggtcggtttcttatcccaccccgctcagcttcacctaccgctcaataggtaccggttttcaaaaaactagaatgatagctaattttaaatatgttgattagaagaaaaaaaccggcacctatattttagga

SEQ ID NO: 54731 - DNA, 361 bp, Oryza sativa
atgaagaagtgattggagatgatgtcgatcaagccgcagccgaaataagtgacacagaaagaacaccatcggcttcacccaagcataccccttcaactccttctgctccagttcacttcctaagtgtaagcagcttctctcgacttccttttgtattcgttttactttatagccgattcctcatagttttaataactacagaaaaagaaaaccgctgtaaggaagaaatcggctacatcaactcctaaaccggctgcaccagtaagatacttttcatcgtctctctagctaatctgaaccaactatgtctaacatttatcctttttgcagcctcctccctcttcttctcctcttgtgcagg

SEQ ID NO: 54732 - DNA, 1501 bp, Oryza sativa
ctggcaaactactcaatattgacaaaagggaagtacaacctggccctaaagttcctcgtctcaggtatgcaagaattgttgctgacacactgtacaaatggaaggatgaagatccaattgatgtgttgtttgacctgtggatagattttctgatgtatgcagccaaccgctgcaatagggaatcacatgccaagaagctcaacgctggcggtgagtttttgaccatcgtctggctaatgattgagcactttcaacaattagcaaaagcaaaaaaggagcacggcaatgaataatgcaggttaatgtctatattggcatatgactatgagtaatattttactttttgagattttctaaggtcttagaaaaggtacggggacttatcatattgttagagtttaatcatactttattactttgtatgttagcctaaacatgatcatctctgtttaatgcgaaaattaatctaactgaccttgtttgtaaagccattgaagccaatttgctgaattcatttgcttgccgttcttgctttccttttctttcttcttctgcttttcttctgttcttcctctttttgctctactttgccctgagcttcctgctgatgcaaaaaaaaaaaaaaaagaaaattgtagagatacctcatgaaccctttacaacgtcgaatcgatagagcgacttaggtttagggttttagagtgaagagagagagagagagagagcgggtaacccctctgcctctcctccacttttaatggttttaataaatatattattagaaacaatctgaggtcaaacatgtgtttggagatgttgtctgaccatgcaagaggtaaagtaaagcacgattatatttttccaaagacaaatatacctatcatacttgtatgaaggaagtcaacgcaactcagtcggtttcgttactacatagtccctccattttttattagataacgttgttgacttttaaacacatgtttaattattcgtcttattcaaaaattttatgcaaatgcataagatataaattgcgaattgcgcttaaaatacttgaagtaataaaacaactcacaataaaataaatgataatttcataattattttgatgagatcacggtcaaacgtgtactatatgataaacgacattatctattaaaaaacagtaattaaattaagttacatcgtttttcaagacatcaaattagtactccctccgttttatattataaatcatttgactttttttagtcaaatttatttaagtttgaccaagtttatagcaaaatatactaacattttcaataaaaaacatattatctaaatatattcaatgttaaatttaataaaactaatttgatgttataaaatgttgctaatttttcctataaacttgatcaaactaaaaaaataactaaaaaaaagtaaagcaacttataatatgaaacggaggaagtacattgcaatacgtcgtctcatagtcatacacggtgtctacaaa

SEQ ID NO: 54733 - DNA, 1501 bp, Oryza sativa
ccagggcaaattttgcctaatttattgtatatattataatagaaaaacatagtaaaatatatattttggagaccgtgttattattcaaaatgtcaagaattatggaacaggacagagtaggttattagttaattactcgagcacattttggcggagttgtttttcctagtatcatttgctaaaaagtatggagttagagaataattgaatctcagattagcagcatacacaaatgaccacaataatcttattagaggacttgattaaagtgaaggttgaggcaatgcaatcttcatccaattaatttattgggtcccacctcattagaaatataatattttttttgataaaacttaatggtagaaatgaaatattctaggacagaggaagtatattatctttaaaaaagttaggcctataagaaattctaacattaattaggacaaattctaacattagttaggacaaaggaaaaataatatggccttccactggctgtgaggtagaattagaatgatatagtaaaatataatacatgtaactgaaattccgaagaaaataaacacgcaaatatcagctaaatcagattaaaataaaacaaaaatacatgttagtcaattttgaagaaatacaagattcaaaatataataccacaaatactactccgtacctgtcaatttgaatttaaggatcattaaatcaaggatatacttagtatagcttgatacttgttaattctaaaattccttattattaattttgtaataattaatttcctaatttcggaataatgtcaacgacttcaatacaataacaaataggcaatgactaattataaatttctgtattattaaatcataagaaaaagcataattgaaactccaaacggagtacaactcagtactttttttttgacagggtacaagtacttattaataccagtcacagaattatgacatcatggaagaactatacttgagattccaagccaaatacaactccatatatgttacatacagaattcaaaattattaaatgattcaaaagctataaacaaggcgccaaacaatactcagtacttaattattagttttaaattactgaatgaagtcaagacaaaaactatactgagagtaccatatgaataaaaatcagtacttactcattcaaaaaatttaaacaattaaattaagaaaacagatagcaacagatggaatattgcaacatgttctatataattttttatcaccaagttttatttatgttaaatgactaataaaatttattaatctttccacagaaaataaaatttttaaccaatacacccgacacataattaaaatcatacggtttgtataatagtactaaaaagcccgtgcaacgtatttgttggcaaccttttgagatcaccgtaaaagtaattcgaggagagaagagagatatgaccaccacacaacgcagaaggaaaaaaaagatgttgtctttgcccacccgcaaacca

SEQ ID NO: 54734 - DNA, 823 bp, Oryza sativa
ttagctccgtggcataccagtgctccgcccgtgctgtgcctgcgcctcgccgccgcgcgtgtgccacaccgccatgcctgcactgcaccctcgtgcgagcaccacgccaccgcgctgcacagcgcctgcgctgcccttcaccacgccgactgcgcagctagggttgggatgggaaatttttcacgagagagagagatggggaggaagggaaggggctcctccacaatctccggtcaagcagagcacaagcgtgctagctctcccggtggcttgcctcgccggcggcggagacggcgacggtgcggcgcaggatggagccgcgggtggtgttggtgcttgcgctggtggcggtggcggcggcgggcgtgccgtcaatggaagcgccaagcggaaggggaagaagagaaggggcaaaactgtcattttacgcggtttctctctcatcaattcagtggatattatattttaatgtgcccagtgtcctgtggcaaattaccacacttttagagtgtcctcaggcaaattcacgtttttcgggtgtcccccagctaattacataacttttgagtgtcctgtagcaaattttgccaataaattaataaagttagtttatttttattgtagtacattgtaagacaaatttatatatgttgttttaatacctttaaactaaatagctttaaagttactgatagtcaaagttataaaagtttgattttaaccttgttctaaacgtcaagaaatatggaaccggagggaataccattttcgcatgtgcccgctctcgactaatctcggtatattacgtactcgtacagtgata

SEQ ID NO: 54735 - DNA, 1501 bp, Oryza sativa
gttccatttgtcatactcacattgtgtgtaagagtctgtgctgcagctggctataaatatgtagcacgctgctcttctctctcctcttttatcttctcgatatgtgtttatagctgacttatagtatgttattttaccagctgtaacaactgcatgcatgtaatcctgtggtcccacgcgtgtgcagctccacgtgcaggcagttgcgtcgcctgatcagttagggtgtgtttcgtttcttgcattcagcttggcccgcatctatggatgcattctctctttgtttggttgcctgggtgaccttcccagcctggctccactcgttcaaaaagggttcctcaggctggctgcggggaaacgctctatttgagcttcgcacctcagccaggcccgacagatgcaacgtgctgcacccacgcgcgcgtgcacccggctgcacccgcgtgtgcaagggtgcacccagcctcctcatttttcctccacaagatccaaactaggtttcactgtgctcaccggtgacgcgatgaagggagagagaagcttgacaaagatcggcgaccatctcttctagcagtaagtaactgggactgaaagttcgccaccgtcagatttttcgtggacaagcttgtcgcagccagatccggggcggcgacttgttcgagcggttgagctcggcaccaccagatctatggcgcaaccaattggaatggtcgaggtcgaggtcaaggtcattaacttcgcacccttgtcgtcgtcgccgtcatccttgccagatccatggcgcaaccaattggagtggtctagggatgcggcaacgatggcgagcagccaggctcagcggagcagatagcaagcagcgaattgtcgtgcttagtggcgaggaatgcgaagggactagcacgatttttcccttttctcctttttcattttttagctttctccaaccggtaataagtagccactattatagtaataaataccctgttagtttactgtgtaggactgcattagtgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacagaagtagggtattacttcttgaatgagaaggtctgaacctgtataaatcctttgtctccaaacccattcacttctccagcttgatagccacccccttttattattgccgaaatctagtttcgacagttggcgcgccaggtaggggtgcgtcaagcttttcgccgatcagtgcaa

SEQ ID NO: 54736 - DNA, 506 bp, Oryza sativa
aagttaacccatacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgtgatccaagcgacacttcatcttccccgccggaactctcgccattttccccactccctgctacagtacagagctgcgccggcaaactagggttcaccattccactcgaatccaccttcgaaaagttcatcaaaatccttcccgtgatccaccgcctcaatccctcacctctccctagccatccctcgaatcaaatcagcgcattcggaaaaaatcaa

SEQ ID NO: 54737 - DNA, 1501 bp, Oryza sativa
agttgcggataatcctggaattactccgtgaaaaggcgcattgcttggttttagctcggagcgaggaatctgcatatcatccaaggtcttggcgaagaggatattgagtgcactgcctccgtcgatgagggttctgcgaagcttgacgttacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaattctaccggggtgtcgccgtcgtccttcttcctcgacgtgctttgttcttcgtcggagttcttccgtgtagtcttggcgtattgctccgcgaattgcttgtagacgaaacaatctttggccacgtggttggagttaggatagtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttggctttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtaccttggaagttggcgatgaagtggtcgcgtaattcggcccaagatccaatcgtaccacggggcaatccatggagccaagatcgggcggaatccgctaaagccactggtaaatagttcaccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggcgagtgaacggaccgctcgtcgtgacccctgctcctgcgattggatcctgcgccagtgatgctgaggcttggatgacggtagtcatgagatcggaagtgggggagtcgg

SEQ ID NO: 54738 - DNA, 350 bp, Oryza sativa
cacaagaaacctcacggaaagcaaagcagcaagcaagcgggcgcttctgcctctaccaagagcaagaatgtaacgccccgattttcgttcgggattaaaaatcatttaataatgcatttcctagaaattaaataaaaagttaagcaatttatccaagtgaattattgggagaattaaaattttccctttaaaaatcattggtcgggaatattttgtaatattctttgtgccctaaaatactctctgaaatttcccgcgaattttcggagcacaagaagtaattataataatacaaagttcatttaaaccaattaaattaaatgtaaaacaaataaaatccctcccctctc

SEQ ID NO: 54739 - DNA, 1501 bp, Oryza sativa
cttaaataagattcttaaattaagttaagcgtgaattctatcacttgcttcggatattggttttcctctagtctgccaaatgaaaccgcctctggccaccaaccttctgagtgaggctgataagtgggccctcatgattgcgcatagtggattggatctccataatatcggttttgctctttttcttgggcgcttcaatccgcgtaattgtgtttggttggctggtggtatatttcgtcgtatgaggggtctattttattcataattgcccacatacaaatatttatgaatacttgtgaaaatggtttcatttcaattgattttatgcaggaattggcggtcaatttaacatttaaggaccatcaatggcaaagctgtttcaaatgtcgctcaccgttgttttcctgccccttctctggactggccttcaggccaaaggtttatatgcacattttattggtctgaattatttatttatgcattacaagaatgcgctccaattttttttttaaaaaagctctcttttactttatgtcatgtggtgtttgtttgcagaatatgttcttggcaaaatgaattaatattttattgttcttttaaatattaatctttaataagaattcgtagtaattctacttttcatgctaagctgtgagaaaatcatttgtacacaattgttgtgttgttacacatacaaataaataaacacaagtatgtgatatgaatagatgaacaggatcaatggaagagaagagcactcggaatattgttccaatgcagtccatgaacacgacgagtgaagccggctattttcctttatccgttacaagagagtgtgatccatgcacttgctgcaagggaagcaactgctttgcatcgtcatgctgctacgagtcaacatgtaatcagacgcaaccaccaaaccattgcataattcggcgaatttcgagttgcggttgtggttctagatgtatctaatcatcctattctggaataataaatggatggcaataaaggatgtgttttaatattttgagcatataaatagttttctaactaaggaatgacaaataaatagcacaaataggttaaatatgtacgttgatcagttcgtaaaattgatgattatgaaagtgggtataattgtataaaattgctagaactagtactatgtgcgttgcacgctaccaacctggtcgcgtgcctccgaggcttcgaccaaccacacctcccacccatgcaccctcttgaattgcattttggtctaggtttacttacctgatatgcagattagactaggtattaacaacttttcactttagaccagctattgttgcgtaccaatgtgcaatttagactagtggcccacatgtcagggtctcaaggaatcttcttcctcctcagacctccaatcagcctaagaggatgccactagctgagagctgttagaaaacgataggcaaataaacaataaagaacaatagatcaatcacagaagaca

SEQ ID NO: 54740 - DNA, 340 bp, Oryza sativa
tattgacctttgcaacggaggttaggtataataacgaacgaattgatgatcaacaaatgtagtcaagtttatcaatctggagacggattgattcataataacaacacacgtggaagaaataagaaattctgtagtagttgtattctaaactaaacttattcctttcgacgccttgccaggcccaactcggtgagaggcccatcagtctagctgatcctggccacctctaactaggccgggcctagcaatctgggccgggcaagcatagctggcccagccagccgaccagctcagcaaccgggcaagccgctgcaactctccttgctgtcctcgttgcagt

SEQ ID NO: 54741 - DNA, 360 bp, Oryza sativa
ttgatcccagccgttcccggcccaaccgaacaatgccttacagttttgtaatagcctggaaacagtgctactatggctccgttcaagtttactgcagtaaattaagtacgggcatgaaaagaaaatcattaacatataattaattaaactttagttactttaaacataaaaatagatttatctaatattttaaaaatagcttttatataataaattttctcatgaaatatgccgtttaatataatttaaaaaacgtgctaacgaaaactgaagtaacatctgtatctagccgggcctgtggtctaatcctgaatacgtggacatcacaaaccgatcctcacatggcctcttaaattcagc

SEQ ID NO: 54742 - DNA, 249 bp, Oryza sativa
ccggcaaaagaatcatgccagtaaccagatagtccacgctgcccgttattcaaaccacttaacacatgcaagctgccattgtgttatttgttctatgcttctataatagtcacaccctgagaccctctatatttgttgttcttcatcccagatgccgaaacaccaccacaacagcttgtatatatcaatcctttatattacaccaattgttatctctatctctctcacagacacaaacatcagctgcta

SEQ ID NO: 54743 - DNA, 1185 bp, Oryza sativa
cttgaaagtattttgggtgacgtgcaagaattcaaattggaccagatcagtggtatttcaacagaataattatcttgcttccatgtacactattgatagcgaaaataatggttgtgcacatcctagatggaaaggctggtgaagctttgattatcttacttatttattaaaacactactattagctattaagatgttttaatatttactctctctctctctcctctcagcatgttcagagagaggacagagttgcttcagttacttgtggatgcaaacatgtatgaatgaaatattttgttttcctaatggtcaaacctcctttcatggtaattatgcctaaatgatatcattgctatgcaattgtaccaagaacagtgcctaacaatataagatccttaaattaagtgtaaggctagcagcgagacaactttttagttgaaaattttacttaaaacaattcatgtgtttttgtttctgaaccagccagcccactattttttaaaaagatagagatcattttttatggcaagtatattaggtactacgctttaaaagcacacacacaaaaaaaaaagaattgcatataaaggaccccagaagaaaaaacaaaatatccagaactaaacgttgttgtaagttgtaacaccatccagtggcaatgaacaattttattcctattttcctgaataccatattctgtcgagatcacaaaattggctcattgcctgaatcgatatgtgtgattgaagacaacccaactccttatatcttttaacaatgagcatagaccaaacaaagaaaatcacaggcctctggttgattaaagtgtttaaacgaaaagaaaggggctgacctaagattctgtccaagcaatgctgttaatcggagctgtctagttctctgaacatcgctgcaggcacagatcacatcagtatctgtgcaccggccgttctgctgcttctcccagaataagcgcagtccccactctgcagtttgagatttttgtacaactacagctagagtcagttgctgatgcaagtagagagtattagcaatctagcacacacataacttgattgccggcggaatcccatacactgaatctggacgcgcaaaggctcctgtcgcagaggcatttcgtcgaacaccctatgggcgtcaacccaaataggtgcaccaaaca

SEQ ID NO: 54744 - DNA, 1501 bp, Oryza sativa; identical to SEQ ID NO: 37941

SEQ ID NO: 54745 - DNA, 430 bp, Oryza sativa
tgtttgttaaccaaatattgctcaatgtttcagttccttgcgttcctttgttggaacgaatagtggttgcactaaagggattttagacttagtttggtataagatgagaattttgtaggattacgattcacattatttgcgccttggtactgaaattgtaaaatcgagggttagggcaaaatttggtcactgctaaacattctaatgttaccaaatcccaactagacaaagacatcacatgttatctgtagtagtgcaagatgtgtctgacaggtggttcctgttattatgttgtctgaaatactgttgatctggttggagacttataacagatagcatctggtggtcatcctgaaaaaatataataaaatgtatgaagaaaatagaaatggatctttgtctgaccagggaacatcttcgagggaatctt

SEQ ID NO: 54746 - DNA, 1501 bp, Oryza sativa
agtgggctagttccaccataacaaatctaatctgttggcactaacttcattcttttttttattcataatatcttgattccctactctctctatcacattttaaacgtagttataagtttccgtgtctaattttaatcgtccgtgttatttgaaccatttatgagtacccgtgtctaactttgatcgtccgtgttatttgaaccagccataagtacccatgcttccatggcatgagatgggacgtggggtcgctgcgcgtcagcgctgctcacccgacctgcaggagatgtcccgagtaaattgtgagatggcaggcgctgcactcgcacagtactaaaaatgtgcgcgcccgtgccacgtacatgcagaatagcagaattcatatgcatcttacaaaaatgaacgtgtaaaaatcaaacagagatagcacctgcaaattaatgaaatacaccagaaccaaatgaaagtgccgatggatgaaacgagtagtttgtgagaagataaccgactgaattttattactactgttccatcccataatataataaattttaactatgtgtctaaacagtccaaaaataaaagtagatacattttaaaactctatcccataatataataacttttaactttttagaacagtgatagtatgttgataagttgatttaaaaggttttctaagattgtcgtcaaaattacgataattgaaccgtttagtatcttaaaaagtatgtacgcgataattcagtgtccatagtagtaataataaaaaaatagcaggctcattctatcaaaataacttgagagctatgttcatcagctcctggatatccaatgcatggcaagtactcaaggtataattgggcagaaatactctcaagcagatctagaaatgtgctttccggaagtaataattcatgtgtatcatgggtactatcacatcgtgccagatcgaaagggagtgtccaataccaatcatacgaccatgcacaagactacgtagagatcaagcaattcactacctgtcaacactagtacaatttggatcaatgctactggaacgaaagggatatgaatcgcacaaacgacctgccagaatcatgccaaaacagtgtcagaaagacgaaaaggcattgtcgattttgcttcaaaaggaagggatacggcaagtgaggaaaaagttcaggcaagaaagacgtccaaactccaaatcaccttcccttcggcggcaagccagtctcttttacgtacaaatttgacatgacaactactttggttcaaagaattggcaagatcacaaaagtcaggacatgaaaacaaaccaaattctggtacaaaagacacttaaaaatatatgttttggccgccaaaaagcactttaacaagtactcctgaaagcaggtaaaatgcacagaaaagcatagcctcttgttgcaaaagattacatacgtctacaggagaccagatcaaacttggcagtaagaagagaacatgcagggac

SEQ ID NO: 54747 - DNA, 458 bp, Oryza sativa
tcctgcagcccggttagtcagagctttacacaactagcgattatttctactgcttttgttttagaacttgtttgccttggccagttattcttgtatctatttgggagcatgcattctaggacactctgtttcatgcaagagagattccattgtctcaggttcaacttctagtccccactccctgtgccatttctagattatttggttctggaaggattcgttctaagcggggttattgaatggagatctccactgaccataaatgacatcattcaacgtgcacgtattgtctagcacaaagcattgggatttttcttctttaaaagtctgctgcatgtcttagttcttgtcatctgttattactagttctccaaatggtttgtctccaatgtagcctacgaagtatgacttaaggaggagagtattggcttacattttgtttatcttggttatccagt

SEQ ID NO: 54748 - DNA, 418 bp, Oryza sativa
gatgaatttattaagcctaattaatccatcattagtaaatgtttactgtagcatcacattgtcaaatcatggcgtaattaggcaaaagattcgtcttgcgattttacatgcaaacggtgcaattggtttttttctgtccacatttaatgctccatacatgtgtccaaacatttgacgtgacggaaaagttggaagtttgaagaaaaaaattttgaatctaaacacagcctttagcttctaccaaaccgagctgaagtccaagcgtccaactttggtcactcgttcctcggtctaatccaggggcgaaaagcggtgtgttgtggaggtcgtgacctcatttcatcgtcctaccgcgctcgccctcgccctcccgctcccgcgtgcatgagtgagtgagcacattgtcgtttttcctagc

SEQ ID NO: 54749 - DNA, 638 bp, Oryza sativa
acgatcttgccagatcctcgttgaattgccatcaccaattcggcgcacaagccccttgaacagaatatctcttctcgctaatatagctctccaagtatggcttgaatgtttcttccgagtggcttgtaagaactctgactcatgatagtatctgcctttcaacactcgggcacatagtgaattaggatttttgatcagtctccatccttgtttacctaacatagctaggttgaacaatctcaaatctcgaaattccatgcctccatcagctttcggtttagtcagtagttcccatcgctgctagtgaatgcgtctgctatctgccgagctcccccaccagtagttcgctatcattgatttcattttccgacaagtatcctttgggattaggaagcagctcatgggataggtcggtacaacttgagcaactgatttgaacagcacatccctacctgcacaacttgcttcacggccactccatgttccaactagatttctgattttggttggcataaattcaaaggtgtcctttgttgcccgccccaaggcagtagggaggcttaggtacttctccgctaatgcttccatatcaatatgtaaaacttctcttacctcccgtttgcatgcattatcgcagt

SEQ ID NO: 54750 - DNA, 195 bp, Oryza sativa
caggcagggtgtttgccacggagtcataggtacgggacatgcatagagaatgataaaacaatgggggttcccagttctgataaacaaggatagcggtagacttccttcttcatccggtgctacagtgcaccaggatcactccttcagtttccaccaaagaggtagcccagggaagatccaccaccaggggcagca

SEQ ID NO: 54751 - DNA, 1501 bp, Oryza sativa
gtggaggggtgaagtaccagccattccttgtggccctgggcgccctcgggatcccagagcttgacggcgatggcctgcgggcggaggcccggcttgacgccgtcgccgacgaggcccttgtagaccggcccgaagccgccctcgccgaggaagttgccggagacgaacccgcgggtggcgtcgcggagctcggcgacggtgaagacgtggaggttggaccccaccagcgacaccgacaggtcctggtccgccgcccccgtcaggtccgtgaacgacagccgccgcaggccgccgccgccgccgccgcggggacgcaccttcttccccccgctcttcttcttccctccgccgccgccgccgccgaggcagccggtcaggaggaacccccacagcgaccacggccacgccgccgcctccttctccttcttcctcgccgccgccgccacaaccttgcaatcgctggatgacctcatctccgccgcgggctatacgcagctagcatgcgccgtcgccgtcggcggcggggcgagctcgtcggcggcgagcgagcggagctgatcggagaagacgcgggggtttgctttttggttggcgatttggtggtgtgcgtggcaagcgagagggggctgtgtgtgtcacgagtggatatataggcgaaggcgagaggctgcaggtggggcccacctgtcagggcgggatggaatggcctttgatcatctcgtgtgtgtttttgtgtgtgtgttgaccattgggggatatttttaattttgattaatgggttataaatttggaggggatttgatttgtttttgtgatgatgcgaaatttggatgaggttgatgtgacgatttttatatgtggtgatggtgcgatgtgcttcccccggcctttacctaccttgtattgcgacatgcaaagactagcgtgctaattaattgtgtccatctttttcttgttcatttttgtatcgtggaaatggatggatggaagcaagcatggccatacactccagtgtgtttcatacttcgtattagatttttctcatcatatagaaaattcgaccaaaacatgtttaagtattacatttttcatgtctcgaaatggtgcaaatctttataaaagaaactttgcgtgtataaatttaaaatttataagaatgctttttttagaacaaccttttgactttgttttattcaattcattcgtttatattctcgaatattatcatagaaccaaattattcatcgttaattcatccattcagctgcatgcaaagaagtacttactccgttttacggtgtaagtcattctagcatttcctacatatatattgatgttaatgaatctagatagatatatatgtctagattcgttaacatcaatatgaatgtgggaaatgctaaaacggaattgctagaggactgtcgacaattttcttgagtgaaaactgtcaaatttcttagtcgttgattccgctttaagatttgtgctgagatatttt

SEQ ID NO: 54752 - DNA, 550 bp, Oryza sativa
caatatgcaagtttagtgtcacaaatgtggtaccattagatatttttctggaagtaacttcttgttggcaatatatttgaaaaaaatattatacatcaactttcaaattggttttgttattatcaatatatactttcagtaagctcagttctttaattgctgggcatcttttttataatactattgaatgaattggctagtttccacatccagaatggacaattgagtaattcttgatcattttagcctttagtcctgaatattgctaatttcacatgctgatctttatgctgcaaatcgaagttatgcatgaggtatgatttggacacttgattgtccttgtaaaccatctctcttccttttgggcatatgttacgtatgtctgctggtaaattgtgaatgcttggttggtgtctggtaagaaaggatcagtctacactgagatagaaacatagttacttatccactatttgcagtatgagattgaataatttctgattcatggggcttacttatagttctctctggcaatttcattgtcatttcgcag

SEQ ID NO: 54753 - DNA, 1501 bp, Oryza sativa
tatacgtacgtacacacagggacacggtcaccaatttggtactccatccgtttcacaatgtaagtcattttaacatgggactagctaaaaaactgtcgagtgttttttgaggggaaaactttcaaatctaactatagtatataatttcactagaactatattataataataataacttatatatatgtattaaaataatatatgcaactttatatgtaatttatatagagataacaatatagttatagtgtagttacactataattacaatgtaattacaatgtaattacagtgtaactacaatgtaactagaatgtaactggaatgtaacttagatataactttgaacaaatctaccgtaaacatacaatgatgggactagcttgtgaaaaaagggtttagatttaatagcaaaatatctcagcacaaatcttaaagcggaatcaacgactaagaaatttgacagttttcactcaagaaaattgtcgacagtcctctagcaattccgttttagcatttcccacattcatattgatgttaacgaatctagacatatatatctatctagattcattaacatcaatatatatgtaggaaatgctagaatgacttacaccgtaaaacggagtaagtacttctttgcatgcagctgaatggatgaattaacgatgaataatttggttctatgataatattcgagaatataaacgaatgaattgaataaaacaaagtcaaaaggttgttctaaaaaaagcattcttataaattttaaatttatacacgcaaagtttcttttataaagatttgcaccatttcgagacatgaaaaatgtaatacttaaacatgttttggtcgaattttctatatgatgagaaaaatctaatacgaagtatgaaacacactggagtgtatggccatgcttgcttccatccatccatttccacgatacaaaaatgaacaagaaaaagatggacacaattaattagcacgctagtctttgcatgtcgcaatacaaggtaggtaaaggccgggggaagcacatcgcaccatcaccacatataaaaatcgtcacatcaacctcatccaaatttcgcatcatcacaaaaacaaatcaaatcccctccaaatttataacccattaatcaaaattaaaaatatcccccaatggtcaacacacacacaaaaacacacacgagatgatcaaaggccattccatcccgccctgacaggtgggccccacctgcagcctctcgccttcgcctatatatccactcgtgacacacacagccccctctcgcttgccacgcacaccaccaaatcgccaaccaaaaagcaaacccccgcgtcttctccgatcagctccgctcgctcgccgccgacgagctcgccccgccgccgacggcgacggcgcatgctagctgcgtatagcccgcggcggagatgaggtcatccagcgattgcaaggttgtggcggcggcggcgaggaagaaggagaaggagg

SEQ ID NO: 54754 - DNA, 1501 bp, Oryza sativa
tacaactacaagttctcacttgagcatcctgcaatcctacctatgtttcgtcttgttcttttgtccctcttttgccatgcataccgctgttgcttttccagttttccatgacccatccagtcaaaccaatactccctccatcgcaaaaacaaacaacctatgagtaaatttgacactatacaatgaatttgaataggagtattctctccgtcccataaaaaaccaacatagtactggatgtgccacgtcctaatatatcacatcagttctagattcatattttttggaacggaacgagtatatcatgattagttgtactagttagtatcaaattcacttctaggttatttttatttttgataaaaaggagtacatatgatagcatgataggaatacgatgccactaccctttaacaaaaggagtattcttgagcaagagaagcaagcagccattcgttcacaaactctggtgattgatcgtgatggccattttccttgtcttccagagacaaaatggctctgattccctcgcctcgggagagcacgcaagattgagatagcctcctccaattattgggtcactcacacacacacacacatctacactgtactactctactggtcactctcgaggtcttcttggcccatgcagaagatggaaacagggaaagcaacagagaattgacagggttggtctcgtcctgctactcctgtttgccgtatctgaatcctgccaagctttcagcagttcagaccttttctttttcttttgcggaggaagttcagagaaattttcctgtggttacaacagcagccagcaatcagtgagaactggctggctgtttatatccaaagacaagtccgttgtttggtccaaagacaagtctggaagaggcccctccaataattggtgtggatcactactcatcccataaaaaaacaaaactaagacatgatgcaacattttttagtacctggttcagaggatttgatcagcgtagagactgcatttacgttaggttacggtcagataacagtaattctacagttcatcagtgtttaactggagccaagggtgtgtttagttccacgccaaaattgaaagtttgactaaaattaaaaatttgaagaaaaaagttgaaaatttatgtgtgtaggaaagttctgatgtgatggaaaagttgaaattttaaaaaaaagttgggaactaaaccaggcccaaatgtgcctttcggacggtcagtgccaccaaaacgagcgaccgaaaaccaccgaattttttttatttataattttttttattaaaagttttacaaaaataattttccattttgaaaattgacggaagtagtcgcctaccgcccaatcgccctctcagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 54755 - DNA, 1501 bp, Oryza sativa
ttttcatgcatgacagctactaatagaagatagctagttgatgtgactatgctaaagggacagaaccaacaagtactagtaggtgcttccatgcatgcatgtagctgctgttagccagagtattagtcttttcactaatatattagtatattttttacactaatctatctattctatagctagacatcaggtgtttattctagccatgtactcacaaaaaccaaaggacaatgttccatacattaattaccgggaaggcttctactagctctaatcactcaactcatggaccttgccacagccagcgcagggaaaagtactactcatgagacaagagctgtaggatcacgtacggcttaaatagagcagcttccttcagtctgaagcggacatctgtccaaagccatgatgatggagataggattcaccctctctcttccttaccctagaagatcctatccatcaaccctcagtgatatttatctgtcctcctccccaaaaacaattcaagaatgtatttaaggtcacgtatcgaacagtctcctgctgctgctgctattattattattgttgttgttgttattattattattattattattattattattattattattattattattattattattattattattcactactacataatttcatagatgaacataaaccaattcagatggttctaatttctagattcaaacattgtctgattacaatatctagtatctcgataccgcggctgtcaaggttatggataccacatacctaatagtagtcgactacatctcggcaggacgcaccacgtaccatgtcttatacggaaactaacttcagatatggagggagttccggataaggaaagacaaccagagttctacatggaaacgacaagggctactcggattgtatccatattggtttccctagttctacttagacaaggggacacctatatgggtataaatacaaggcccctagaagaagaggggacacaatacacgggacaacatacaagccaacatacgccaagacaagacgccggatatcgacttcagagaaaggcacggctagtcccatacggtgtctccagatactgtcaggagagacgaaagcgctatctctgatctcgccgggcacggattcgaggaggaagactaccctgtcatcgactacgagtcagacattcaaaccgccatgtcgacgacggttagataggctaccccacatattgtactggtgtgattatggtgaataaaagcaactccggctccggccaacaggatgtagggttattacctgacaactcagggacccgaacctgtataaaaatccctgtctccgtctcttttacctcagtctcgcgtatatcctagcaccgacgatccccatactatgtaaataccagaattgcgacatcaaacgtcgacagtagcgcgccaggtagggggattttggtgcttcagggtttcgacgagatgagtttaagaga

SEQ ID NO: 54756 - DNA, 1501 bp, Oryza sativa
catgaagtacaaaaagtggcgaatggagcaatctctcgtccctaattacctctgtctttcttccaaaaaaaaacccactaccacacaaaaaactaagaaagttgttctaaaagaggcaggatagtttaccattcgtcgacatagagtgatccatgaacagattgtgcaatgtgaatctcgttctccaactgacaggggccccaaacttctagttttgtaggggaatcatcctcagaattccgtattagtaaaagttttctcccagatggcgatggaattactgctgaaactccactcatttcgattgggaagggagaccactggaaatccacagaatttgaggaattttttgagatgtgggaatttaataggaagctcctctttttgtttgccaacagatctgtttggccaacagaaactatcgccctagatgtgttttctgcacaacacgagaagaagagtaagaaacctaagttcagtaaaaccagatagcaataacagcacataccagtcttggaattgaagatccaagcgttgccaatagtgggaattttaacgaattcctgcagcagcttggactgggaagcatattcatccaccatggagacatccatccccaaaggcaatcctttctcagtggctgcttctgaggcttgtgtggtagccatagctgttgggtgcgatgatattctactaatgctgccagatggagtcaatgaggttaaatcagcattgccagaaaagatgggtcaagtgatcactacataaagcagaccaagaatttcgagcataagacttgctactaggtcctcaacataaaaataaaaataaaacaatacatattctaagaacaaaacaattgtgcgtcattacaactgatttcttttcatcgcgctgtccccatcatgtggcactttttttttttacaatacaagtcattgtcttagcactatcaaaactattgcctctttgcaacaattcaattaattcttttgaacccaataaagcaaccacggcactgaggctaatagatcactgtccactgaataaaactgattttacattaatacagcaaactaagaactagccgaagtggacaagacatattatctgcagcaatggtcaatcacatgttatgtaaattagtaaattacatccccagctagctagtgattcatattactccctccgtttcaggttataagacgtttagactttggtcaaagtcaaactactctaagtttgactaattttatagaaaaaatagtaatatttttaacccaagacaaatgtattatgaaaatttattcaattgtaaactcgactcctttatctttatacccaaaaaggagacccgcacgtacggttttcagggggatccggccggccggtgcccacccgattagagggactgagaaattaattgagtacaaaacttatcttcaagctttgagtgctattccttttatgaaattacaccgggaaggaattgagcaagcca

SEQ ID NO: 54757 - DNA, 1501 bp, Oryza sativa
  unsure (1)..(1501): unsure at all n locations
aggaggactcaagtgggataggctggtgttcatgcacagtctcagagctacacccacatgcacttgtgaaacctagggcgncataggcttttttcaccttcgtgcaatgcgtgttttgctgttgcagaatgagctggaaatctagttatccaaatctttcctatgatgagccactaacagggacttttctggtggggtttggtaagtgtattacactagtattttgtatttggagatgcacattcaaccaaaaaccaatagtgagagtgggagaccaagaaggtgctgacaatgttgctaaccattactttctatgcacgcacctcagtttcagcaagttacttgagatagtgatcaatactatgggtcatataagactcttacttgtggaagaaactgaagcatcaagcatgtttgcttgactgcaaaacatgcatgtggttaaccaactacaagggagttccagaagaggcccaaatgtgttgcagtgctcaataacagcataaatctaaggaacataaatctatacaaacccacatatgacttcttacaatgtttgcagttatttagcgttatcacttcctagctgtaactgaaatattctcatataagttcttggtgacaagtactttattttcttctatatagtagttgcttcgtgcttataaagtatttttaaattaagagtaattgcatcatgaataagtatgatggccgtcatgcttcagatccaaatctgacaatataaaggtcatgcctatgtgtatctgtgtcttattcagaaatactgaaactgaggttgtcaaatgataaaagatagctaggatgcactattgtatatttaaattattatatctacctgagaacagttctagtgcgcatgcacaaagagtgtcatgatttaggagctaaatcattgccattttcctgatgagggacagataagttattagaaagattctgaaagaaatccagatattacagctagcatcctaacgtacagagtacagaccacaagcaaaacaagtggttaactctcacatatgtcatatacttgattgcagttatgacagtatcatattgtttattgtcccaactaaaagttggaagggatcactttcaggaagttggcatgtctatctactgtctagactctgaagtctgaagtccaacatgaacacatacagggtaatgaatattgacacaaacaaagcaactagctatgagttgtcaaggacaaattaaaggggatgtgatcatttagataataggcataagaacatcattaatatatttagtctaccattataaagtaattattaaatgccttatcagatgagggatagcaatcagaatttctacggaagtactaatgtacctctgatgatgatgtttacagatgaagctttatatcttgagcaattttacggttcttgaggaggtaacatgaggtaccactttttctattgtaaatttggtacttaggtactgtgaggtacca

SEQ ID NO: 54758 - DNA, 157 bp, Oryza sativa
ggcatgcacgtcatctcacggagtgtattggagcccgttgaacctatataacacccgagacaagttgagggacccaaaaattcattttaatagttcagggacctagttgacacacccatacaagtttagggaccatccgtgcacttcactcctcaga

SEQ ID NO: 54759 - DNA, 386 bp, Oryza sativa
ttcatctcatctctctatattgtttatatcgggttattatccattaccaaagagagaaaagattgaaagatcttggattaaacaatttgtgtaattgttgctttggtgatagatgataaaccaatgtttatgggattaacctctcttttacataagttgtcaactaggttatttcctgataatgaaatgtggtagatatgtattcttttgtgatggaccttaatcatgataaggatgaaatgcatggagatagagcgatatgtatcacttcttatctcctactttttgataggttcatatatatcatttccatgttattgttatataagtgtgagactaatgtttacttgagtcttatcttatttagtctcctttacattgagaca

SEQ ID NO: 54760 - DNA, 407 bp, Oryza sativa
tctttatagacttctctcagcctacccatataatagttagctttttataattaatacgtagcccacttgtctgtctcacggagtttttttggttcttgtgtccaagccggctgtaagtttacagcccgcttctcctctctctcctctcttctctcctccacctcagcatttagctggcttataaccttctattatacttgctctaagggacctaagatgaacttattcctttatttgattcgtcgattttactttagctggagcaggatggcttgatgtgggccagacgaaactggcataggaatggtcgacaggccgagaacccagctcagtattcgcatcgccatccttcggaggattcttcggcggagttattttagtactcccaacacgggtgcggcctacca

SEQ ID NO: 54761 - DNA, 1501 bp, Oryza sativa
tccattagtcgatcccttgcaggaaaccccataaatataacaacttaatgcacacagaatctagctctagttgctgcaatgtcaccaatcattagggtcagggcgcaaggaagaaataggctgctactatgataatcatgagggctaatccgcgagacgaattttttaagcttaattaatctataattagtaaatatttactatagcatcacataggctaatcatgaattaattaggctcaatagatttgtctcgcgaattagtcaaaggttatggaatgggttttgtaattaatctatgtttaatattctaaattaacgtccaaacatccgatgtacaaccaaacagggctatatatattttgtaacattaactgcactagggaaatttttataaccaatccaaatggcaagtgtctcactctctctaaagctatccacctcctttcgcccaaagcattctcctaaatggacgcccacttctctccaacatttgcaccaagtgggctgcatgagagatcaattgagccaaaaaagatgcccaagatgcatgcaggagtacgctaccttagaatgcatgatttttgcgcataaaacagttcattttcggtaggaaccgaaagaaattgctgttttgaattaaaggaaccttaaattaaaaacctcccttccgttgccgttgcccatgatcaccacactacacacggactgcctctgttctattttatttgtcgttttttatattgacacgttgttcccaatacgtatatcttatcactaaattacatatttagtaaattacattcacggtacatcagcttgtatggtgggtataaatagatacaacaatttacaacatgcctagcctgtgtgaacctgggtcaatacaatctctgcaagcaaaatatgatctaatgtggtgcatattgatgagtaattattattgcacatcaaattttatatggacaaaatgtgtaactattattcgcttgatatttttaagaattagatcgacaaaaagcgaaacaattaaaaatgcccaaccatgaaagtaagcttttaaaaaaacatttttttggtgaaatgagtttctgagcatgaaaattaaaatgtaattttcagcagttacttgtacaaaggcatggcagaaattaccctggtccttaacatataggttaaccttatatgagttatatagtgaataaattttttccaagacatgaaataaattctgttatgtacatgaaaaatgaactttcacatatttctatttttctttagatttcaaataagatctctaaaacatggtcatacatgtaagctgtcgtgccatcagtttgcaacgttgcaacaattttgtttgcgtggatcatttcgtccctattctcatagactaatcattttgtaatttttttacctatttacacctaccacgaaagttcatgtaatgtgagcatagtttactcttatgtagtatttattaaaaaccattaaaagtaaac

SEQ ID NO: 54762 - DNA, 1501 bp, Oryza sativa
ttagaaacttgataacaattcaactcacgtgggtgaaatcaattttcttttttttttagctctactaagaatgcaccatttttataggcctgtatagtcacacttcgtggtaatgcaggataatgcaaaatttactactgacacttcggctgagttcgcaaggacatgttcccaactcctcctcttgttttccgcgcgcacactttttaaactgttaaacggtgtatttttttaaaaaaagtttctatacgaaagttgcttaaaaaatcatattaatccatttttttaaaaaaatagcaaatacttaattaatcacttgctaatcgctgctccgtttttcgtgctggggagtgagggttcccaacccttacttccaaacgcagctttagtttgtggtatttgctaaaataacatcgcacagaaacatgacacgactggcgggcacccaaaaaatggtaatagcggtgggacaacgaaaccattattttattatatttggttcaaatgaagagagaaacaatgtggaaaagacaaatgtaccgatggggccaaatgcttgtaagacgactgggtttggtttcaacaagaattaggccaatcttcatccctgatcccctctccaaaccctattttttaatcagacccagttaggttagaagcatatggccctagaggcaaaattgttttttttctaaatgtttctctttttatttggaccaaaaaataataatagcctcggtgtcccatagctattactactccttccatttcaggttataagacgttttgactttggtcaaagtcaaactgctttaagtttgactaagtctgtagaaaaaaaacattttcaacccaagataaatttattatgaaaatatatttaattatttatgtaatgaaacttatttggtattataaatattaatatatttgtttataaacttagtcaaatttaaagtagtttagctttgaccaaagtcaaaacgtcttataacctgaaacggagagagtaattttttaggggtgtctaccaattgtttcacgttttacggtgtcttttagcgaagactataaactttagatgtgctgtagtaaaatttgtctaatcaaaatgatctctttctatcgatcctccctgtttatcaacatagtatagtattaagtatgatttccctatcaccactcaaagcagttaaactcgatcccttccattgttccactggatggattccacttggagtttggagaaagagtgacaaagcggccacaagggaagggaaggggccggagaaccggacgagtgtagagaccacataattgtaccgtggacgtacaaggcatagtgcatgggcggacgggccccacagccacaggagagagagagagagagaggacgaggacggacactagcggcggttgggtggggcatcacttcagtagcagccttgtgcgacgcaaccgcgcaatctgcctcaccgccgggccatttattgtgcccaca

SEQ ID NO: 54763 - DNA, 252 bp, Oryza sativa
acctcccaatagcaccaataacacacattgtgaacagggttgcaaatagagcaaggataagtttatctagctttttttccaatgtacttcttttggagggaacattcatggaattcatcataacctgtaacaatgttccacatccagtaaacttcaaaacagcagatatcatgaattcaagttaaatatacagggaaaagtgaaatgttcatacttttgtctcatgacctgtgaatataacaacccccacaa

SEQ ID NO: 54764 - DNA, 1501 bp, Oryza sativa
cattccctttgctgtcttggtaacttatgaagttttcaggctgactcaaggttttattttttataaattcactaattggccatttttctcctgctctttcttcagagtctattattaaagggctcatgaattttattcctttagaatgcattttttctatcacatcatttacattgattttgtatttggaggcacttctattagtcaatcttcctataaattctatacttattaataaatttgttcccttaaactcttagtatccttttgtttggaaaccaaaactcattttatatatgaattcatttacaggcatcattgaatcaggcgctatatgggttatcaacatattttcattcatatctccttctagatagcctaaagatgctttgtttattgtgtcccatcttttatctaataaggttattagcactttagctcctaatttctttcttgtcattcctttgatatctattatgtacataccttggtgaatatacttatatcctgaatatcttaaactattttcaaattctttagctactatttttaattctactggctttgttagaacacttaattctacttctctagatattctataaagcccattcttattctcaaaaaatcccatgcagtatacttgttgaggccttattgcccttaaagtatctcgttgatatctttcgagctgcttatctacttgtgcaacatctttcagctcatctatgtcatcatatttgcctttttgtttatcagaacagttatcatctctgcttgctattcttctaaagagactcctagatatgtccatttttcagaattaatggcttgtgaagatgagactatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccacacttatgcttcagacacttatgcttcagacaaaatacaccacacctatgcttcagacaaacctatgcttcagacaatatacactgttcaaaacactatttattcggctgaatactattcagtttactgtttattcggctgattactattcaaaaacactattcagtttactgtttaaattactgttcaatactgttcacttcgagagatattttaactttaggatctttgcagg

SEQ ID NO: 54765 - DNA, 1501 bp, Oryza sativa
aagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactctggagacacacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatcttgttaagttgcttctaaaaagatagataggtgaggcttacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtatattgtctgaagcataggtttgtctgaagcataggtgtggtgtattttgtctgaagcataagtgtctgaagcataagtgtggtatcagagcctggtaatcatagagaagctaaatttagaagctaatattggaaagttaataaataccaaagataatatcaacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaa

SEQ ID NO: 54766 - DNA, 1501 bp, Oryza sativa
ttgtcagtattatttctgcactgggtgcacatcaatgcaagagagatcgttatatgatttgtacctggaagacttcctgatctttggcacaggacaactggatgttttcttccttggagtagcctgctttggcagtttctggttgcctctcggtctccaggctttctagcagtatcgctttcgtcatcacttgacaccaacttccttttgcgtaaatctggctggattggaagtatttggccgggcttcagaacgggtcttgggaccccgctcccttgaccggtttggcggtggggtgatcggcattggacgactggggggtccgatttcatcaaagcaaattcctggtcgtaatatcattcattgttaattgattcaacaaaaagacaagactatattctgtgaaaagttgaaatgtttgattacatatcggtggaggaggattgaaagcattgaatggcatgactagcagcaagtgcgaatagctgacgacgatagcattcgagaagatcttgtacatcctttccttcataatcttaaagttaagagagtctggatcttcacgatttggatcatgtttgccgtcaaactcaaaagctgtgcgggacctctctttgattggagctaatcggctttttatgaagtgccaagtgatctgttctccctgcaaaccttgctctttcagctttatcatgcgctccattagttctacagcctgggctgcctcatctcctgtaggcaatgaattccatgtatcttggtagactggagggagacaagagtactcgggaagggctggtttaggattttgaacatagaaccagttggcgtgccagcctttgtttgaggtcttgaagggcatggagaaatatttttggcttagtgttcccctgagttggaaaccagcacccccaacaacgcacagtttgctcttgtttggctagggtttgaggaagaagatgcggcgaaacaaggcgaaatgaggcctaatgcccagaaaagcttcgcaagcatgaacaaaattggcgatatgcactatggagtttggattcagatgatgcaagctaattccatagaagttcagaattccccggaagaatcttgaggttggaagagaaaatccgccatagaagaagtgagagaataccacaatctcgtgtgtgtcgggggtcgggaatgctttgccgaacgctggtcgccacccgatgatttccttcgtcggaagaacgccgtgcaccaccatttctttcagattctcttccgttacatcggagggagcccactgactctcgaaactttctctctcctccgccatggatgcgagttgcatggttagatttggtccaagatatagctggaggggaatgaggaattggtgcggtggacacgcggagaagtttcgtgggattttttgagaatggattgggacggattgatgaaccctagtttcgacggtgcggtttgctactgtagcaaggagtggggaaatggcgagagtctc

SEQ ID NO: 54767 - DNA, 1501 bp, Oryza sativa
tttctgtaaaagtggtaccattatcgccagatttgaatcctagctatatacatagaatttatatcctctaatttttcatagaaacaatattgtttctggtcgtttataagcattttgatcccaattatagcacacacgcatgaaaatttagtaatatattctatccatccaaaagagttagatatattacttttatcaccatgaccaaaactacatgtaatgtaacaaagatcaaagaacactctcatcggttcaatgttgcagaggcagattttcagcaaaagtccatcggttagcttattgggctgattatgcatcagccattggtagtgggacaatccttcccgacacctttctacggccacatcgctaggagaccaacctcgattccccactcccctctctcgaaccctacctctcaacgatcaccatgccacagaagatccactaatcagccattactctttataagccaaacgatggaaacgcttataccgataaacatcagtctgcttatgctgaaacgcaacaacataagccaaccgatgaaggtgtaagtgtatataatgcaatcgatgagtattgaatgtgtatttgggttccggtaaatcatttaaatttcagatatatacatgaaaactacaaggtatgacccatttactttgaaaaatcaaaatataaaataattctaagtcttatcggcttgtttggtaactcgagggaaggggattgagagtttacacaagggaatttatgatgagattaagatgggaatttgatttttaatcccagtatcttgtttggttggagtgatggaaactgatagggagtttagttggagattatgtcattaataaaaatggatagttgagatttgcatagacaaagtaaaggaggaattccctcccaatcacctgcccctacccaggtattgaaaaggagggagttccttcctcaattccacatccccatccccatcccaccaaaattctcatgtctcctaaataaacatgtggagattatggataccctatatctacatggcggtcatattctagctgggtacaggataccgaataaagacagaatatcttcatgaggactcgggttagattctaaacttgtatgtcaaggaaatacccgagatcctagtcggttacgattatattttatctgtaattccatgttcttttaggatatggactgtattttgtaaagcggaccccttcccctatataaggaggggtccggatgcttatcggggcacggttttttgacctagattatacaatcaataatacactcggcggaatcatccccggacaggagtagggtattacttcttgaataagaaggcctgaacctgtataaaattcttcgtctccaaacccatccactttcctagcttgatagccacccccttttagtattgccgaaatcttgtttcgacagttggcgcgccaggtaggggtagcgtcaagtttttaccggctaagtgcga

SEQ ID NO: 54768 - DNA, 1501 bp, Oryza sativa
gtgattcaaaggggccctaagtgttttgttttgtcgaaacaagatttcggctatactaaaaagaggtggctatcaagctagaaaagtggatgggtttggagacgaagaattttatacaggttcaggcctttttattcaagaagtaataccctactcctgtccggggatgattccgccgagtatattattgattgtataatctaggtcaaaaaaccgtgccccgagaggcatccggacccctccttatataggggagggggtccgctttacaaaatacagtccatatcctaaaagaacatggaattacagataaaatacaatcgtaaccgactaggatctcgggtatttccttgacatacaagtttagaatctaacccgagtcctcatgaaggtattctgtctttattcggtatcatgtacccagctggaatatgaccgccatgtagatatagggtatccataatctctacagtaacccccgagacctttgcagtcgacgaaatagccatctcagaacaaaaaacaataatccgagtgcttcaattcaacctgctccagcctgccgagtgctaaaatcaaagactgtgaagggcgaaaagaaaacatggtgcatcgagtagatgcacctaattaggtgtagcccccgactatgtggttagttgaaaaactaaacatgtagtcaagaaccgagtggttttacaaccaaacattatatagcaaagcatgtgtggtagtcagtaaaacacccagccgtctgcttcttagctgcaatacatcgagaaaaaaatatgaaaaggcccgagtgataaacactcaaaaggtcctcaaatagacatatttgacaggaatccgagtaaaaactctaaagacaacccatcaaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatcca

SEQ ID NO: 54769 - DNA, 344 bp, Oryza sativa
atcataacgtgtattctttgtgtgacattcaaagcatgctattgttgtggacagtgtgcccaacaccgacagatgtgaggtctgcataattgaagatcatcacatgtgcacatggatatggcatgagtcaacaggtttaaagaacacaagacgagcacaaaacaaaatccttgggcatgaacgcggttataccgggaagacaggaactcaagtactacaatactctctcctagttctaaaacagacaagctatcgtatgcacaaagtacaataaaggacaaccaatgacacttaaaaagtaaaaaactagcataagagcacttactgctcaaaatccagacatg

SEQ ID NO: 54770 - DNA, 904 bp, Oryza sativa
cggcgctcaggtccgctgctgacggcgccgaccgcttcgtggaagctgagccgcgcgctggacgccgtcgtgagggacacggaggacggcgtcccggtgccggccacggggccccgcatcacgctgctgacggagctggcccgcgacgtgtccacccaacggccgccgccgttcctcccgcgcaagtacgtcgttgctgtcgtcgaggcggtggacatagggaggcaggcggaggcgctgagctactatcggtactccggcgacagatggacgtcgccggagtcgctggagtactcgatggcctacttccggcggacggcggagaagacgagggcacggatcgctgccctgttggggatgactatcccgttcgaggatcctcccattgttatccacatcctcgaggtctcaagttgggaagccagatattactccaattcatcgtaacgtaatgtgtaacccaatttttgtttaattggatccatgttattgcaaatatgctgattcagataaatgttactacaattcatctatttgtacacttgtcatccgaatatctacaaatcatattatcatcgttatatttttcgtcatcatatagaccaaaatacctataaacgtaggacccacgtgtcagttctatttttttttccaattacggctgctggtaaggaagacgttcaattgagatctgcatgtgcacgttggcgatagaggagaatgagtgagggaggctgatgacgtggcttcgcgcgatagtggattgacgccgatgggaggaggtcaatggcaacaattgctccctcagcagcgtgacgcggggcaccgtggccggcgccggggctccgtcctccgtgtccggccgcgacggcgtccagcgcgcggctcagccccacgaggcggg

SEQ ID NO: 54771 - DNA, 575 bp, Oryza sativa
cccccatccccctgtacgtcctctcccctttttctcttcctactacaccataaattttaaaataataaaaaaacaaatttagaaaattttatatataaaaatactatatataaaaaatatttgaattcaaatttaaatttgaatcgtatataaactttttacttataaactttgggtctataaactttaggtgtatagaaatactatatataaaaaaatgaattcaaattcaaattcaaacttgaatcgggtatataaacttttaacttataaactttgggtctataaactttaggtgtataaactttagatgtatagaaatactatatataaaaaatatttgaattcaaatttaaatttgaatccaaatttaaatttgaatcggatatataaacttttgacttataaactttgggtatgtaatatttaagtgtataaactttagatgtgtaaattttaggtgtataaactttaagtgcataaattttctaaaatagaaaagtaatgtggtgtaaaaaaaggaaagtggagagagggggggattgatcgtccggagcgatttatcgcttgttagg

SEQ ID NO: 54772 - DNA, 433 bp, Oryza sativa
ccccatgcgcacgatatgttcggtatcttcggtgaagtcagttcacagcggacaaaaaccgatctatacatggacaccgatatacataaaaataaatgcaccaaatccaaaaacgcgaaaactagtaattcggttcgattcggtgttcgttttatttgtgcccatacacccctcaaacattttttaatataaattgtgagcgtgttgggattaaacactagacctcgggggttaaaaccacatacccttgccactgcactatcatgtgaattgattactacttcggtttcaaccgctatggactcatcggaaccaaggccatcaccaccccgcatcgcttgagcgcacagaacccctctacgtggcggtgcatgcaacaagaaaaaaaaaggtgagacgagaaagagaaagaacgagagggatggagaagcga

SEQ ID NO: 54773 - DNA, 1501 bp, Oryza sativa
gtttggctacattgcgtgcaacttttgcttcaaaataaactaagtacttcatccgtcccaaaataagtgtagccatggttttccacacccaactttgatcgttcgtcttatttgaaatttttttaaaaaaaattaaaaatataagtcacgagtaaattactattcatgtttatcatctcataacaacaaaaatactaattatataaaaaaataaataagacaaacaattaaagttgggcacggaaactcatggccgcacttattttgggaggaagatagtaaaggttatggagaccagtaccctcccatcaatcatcatgcatgcaactaactctctgcatatagacaggcagctctggcatataggcttggaatgatgccatctgtccttttgcaagtttgcagtctttcttttgcatatatggcctgtccgttgcagcttaaacatctccttttgtagttttgctagctaagaacaagcttttttagttagttaaataggtggctagtgacacttatatcaacattcatctcacagatgaatagatgtcgttatgtaatacgtgcagttaaacctcgaaaccttaaataattaatttataaaatatattaggagttgatacgagaaaagtgtcaataggtgcagtcaaacctcgaaaccttgtatgattagttaataaaaaaatattaggatttgatatgagaaaatgtcatttgtagatttgtcatgaaaaacacatttatattgtttacttttaatggtttttaataaatactacataagagtaaactatgctcacattacatgaactttcgtggtaggtgtaaataggtaaaaaaattacaaaatgattagtctatgagaatagggacgaaatgatccacgcaaacaaaattgttgcaacgttgcaaactgatggcacgacagcttacatgtatgaccatgttttagagatcttatttgaaatctaaagaaaaatagaaatatgtgaaagttcatttttcatgtacataacagaatttatttcatgtcttggaaaaaatttattcactatataactcatataaggttaacctatatgttaaggaccagggtaatttctgccatgcctttgtacaagtaactgctgaaaattacattttaattttcatgctcagaaactcatttcaccaaaaaaatgtttttttaaaagcttactttcatggttgggcatttttaattgtttcgctttttgtcgatctaattcttaaaaatatcaagcgaataatagttacacattttgtccatataaaatttgatgtgcaataataattactcatcaatatgcaccacattagatcatattttgcttgcagagattgtattgacccaggttcacacaggctaggcatgttgtaaattgttgtatctatttatacccaccatacaagctgatgtaccgtgaatgtaatttactaaatatgtaatttagtgataagatatacgtattgggaacaacgt

SEQ ID NO: 54774 - DNA, 1501 bp, Oryza sativa
cgccctgccgcggcggcggcggcggcgtcgggacgttcgagcagacgatcgcctcgctaatcgcgtagcgcgccgccatgcacgcacgcatgcacgttcttgatttgattggctgcaggttaattaatggaaaggcaaatggatttaaatatatcctgaaatccaagcatagcctctggatataaatcgtcaagtaaaagaatgagaaagaattaatggcatgactaatttgtgagcctaaatcggtcagaatgtttaattactggccacctgtatttcctgagatcgttggatatttctatgcttaggttctcagattattagcactgatgtcaactggcgagacacatcagaactgatttcatttttgaccttcttcggaattgatgattttgtcgggaattgaactgattttcatggaagtctcttttaagttttttgcattccaatttccaaacgatatctgatagtcttaagagagcctacgtgtgaagagagtactccacctgcagaaagacgttttggacaaagatctttcataatctcataaagattactatttggcctcgtttagttcccaaaaagtttttcccaaaaacatcacatcgaatctttgaacacatacatggaatattaaatgtagattaaaagaaaaactaattggacaattagggaggaaatcacgatacgaatcttttgagcctaattagtccatgattagctataattgctacagcaacccacatatgctaatggcggattaattaggctcaaaagattcatctcgtggtttccaggcgagttatgaaattagttttttcattcgtgtccgaaaaccccttccgacatccggtcaaacgtcctatgtgacacctaaaaatttttatttcttaaactaaacatgccctttgtttgtaaatttattttgtacaaaattatgaccaaatttgcactgacaaaaaaacagttcaaatgtcaccttttttaatcgtagggagtaacgtacaaaatcaatatagaagctctcgacacagtccattccaacaatatgattccaatataatcatcctctaaaagttacatcgtcggctacaaacatagccaacacatacacctacaataaatggtgaccttgtttttttaaaaaaaaacaaaaaaaatcaatgtcaccccaacaaaaccaaattgacaaaatttaaattaagtcccgtgcacaattagaataagatcattaagccagttgctcgacaagttaattaggcgcatttgtcaaagaaggtagattaagctggcccacctatatagatctcctcattagattattcttttcgatgaaatggttaatacattatacatacaactgaataatatttcctcttccttgttagatgaggagcactagaacatatctttctcattacatcgtttttgttaccgaatctataccactacatatcaatccagcttccaattggcttctatcactatcttcctgcccttc

SEQ ID NO: 54775 - DNA, 1501 bp, Oryza sativa
tatagccattattaattaaagtaagatacattgacctaaccaagaaccttccattctgattaaagttccatctaaaacaatcagaagaatggttcaactggatatgtacaatagaagtacacaactcatgtcaaaaataagattctgaccaattgaagctctcctaaaagaaacattaagttgaacagatctcataaacactagcaattgaaaaacctttccttcggacaatggcatataaagaaggatacttatctttaaaggctaagttacataaccatttatcttcccaaaatctagtttgttctccattattcacaatccaggaacccatgtctaagaaagtacccttagctttcatgagactagaccaaaaatgagagtcaccttacttcttatcaacttgggtaatagacttattatgaagatatttcctcctcaataagtcttgccaaaccccttgtttattaattaacttaaacaaccatttgctcaaaagacatttatttgtatttccaaattatgaaccctaaaccaccctgatctttgggctggcagatgatatcccacctagtaagtatgtattttttcttatgatcatctccttgccaaaaaaacgagatctataataattaattttttgaagcacccctttcggtatctcaaaaaaggaaatcataaacataggtaaacttaaaagtacagaattaatcaacaccaatctaccaccaacagacatatacttacctttccaactactaagtttttttctcaattctttgttcaataaccttccagtctttgttaccaagctttctaaaatgcattggaataccaagtactccttccgtttcacaatgtaagtcattctagcattttctacattcatattaatgttaataaatctagacatatatatctatctagattcgttaacatcaatatgaatgtggaaaatgctagaatgacttacattgtgaaacgaaggaagtagtttccttagtattacgtacacagtccgtagtctataactctgtagctccatcgttgaaatcctacgtccgccacttattatcgatgtttttttttatattttttactcaatattttcactttgaaacggataattttatctttgtagcattttagaccaatattaacacttcaattttatctacatctaatttatcatatattaaaggagtagtacatacaactgtgactttgagagtttatttacaagtaggagcatgtatactcaaagtcattcatatgcttaaggaaatagttagggtggtataaagtacaaacaaatacatcctccgtcttataatataaaaaattttggtgggatttgatatatcttagtactatgaataggctctctatccagattcgtagtacagatgtatcacatccctaccaaaatcccctatattatgggacggagggagtataagactatctcgttcgaattttttttaaaaaaatggttaaatta

SEQ ID NO: 54776 - DNA, 1501 bp, Oryza sativa
atgagatgttttctagtacaatgaatctggacagataatagaaaacatcatatttaatactaggttagcttttttttaggacgaagggagtacgacaaggatggagattaagtatccacacagaatgagaaaatcattagcgtacgtttaattaagtttcaattatcataaaataaaaaaatgattctatttgatatattgaagcaatacaccattaaacagtttgaaaaacttcccaatgaaaaccaagataaaatttatatattagagtgtgtttagttcacaccaaaattaaaagtttgattgaaattgtaacgatgtgacggaaaagttagaagtttgtgtgtaggaaagttttaatgtgatagaaaagttaaaagtttgaataaaaagttggaaaactaaaccagaccttaattagaaaagaagagaataaacatgctgctgctactactacctttttatgaaccaattactcctccccatcagtacccagcagtatcacttcacagaaacattgagcccaaaaaatcaataaaataaaaataaaataaagaaatgacagcaaaaaaagttactccactaaaagaatgaaaggactcctgctatttaagggccaccacctagccctacctctagtctcccaaagagccaccatcccataatatatcaccacacacttcctgcctcctactagaaagcacacactacaccctcctcactctcaacctcagcctcactgtgactgtccccagcaatgctcaccccctcctcttcttcttcttcctcctctcccctcctcctgtccttccaagatgtttgctgacttctctgctgctgccatggagcttggagaggtgttgggcttgcaaggactcacagtgccatccaccaaggagggtgatctgagcctcatcaagagagctgctgctggtagcttcacccaggctgctgctgcatcatacccttccccctttcttgatgaacagaagatgctcagattcgccaaggctgctcacacattgccatcaggtctggccttgctcatcaccacatacatacacacttccatgttattaacttgcaataggttagaagcaaagatcatgtgtgcatgtatgtatgtaaggccattgatctgtgtatttctctgcaactcatgatggacagtgtttttttctgttcacctgcacaaatgagagggaaaaaaagtcagaaaagataaatcaagtgatacatttattgaacttgatgagctctcatgagtgctacagaacgagtcatggggatgagcacaaaccctggggcccccttcccaaacctaaggctgtttcatttcattgctttattttaactttacacttttgtcttgactctggccggtgcatgccttaaccatatccatatctatctcaagataaggtttttgattctttcgaatatattattgaccacactaaaatgtttttccttgacttatccaggtttggattttgggagg

SEQ ID NO: 54777 - DNA, 1501 bp, Oryza sativa
ataaaagcgaaataaaaccgtatataaaaataaacaaacatgtagatcttgaatttaaatgaatcttgcaagttgaataatctattttagagtttacatgaattagttattaatttcaaaagtgctgagacaaggatatatcgatttatgatgcaataaatgaaacttattgcatcagccgtggcgaagccggtgacgatggtgacaagtgggtcccaagcatcaacaactggaagatggttgtccatcgtgaacccggtccaccgggaggattggcagggacgaacggctaggatcgaccaaggccgattgacggtcgggatcggacggcgcctggtgagcacaggatggccacacggacgaccgtgatttgtcgaagagcagatcagacgacggagaagaaaggatgctcgattagcaaagccccagaatccttgcttccttctgatcctacccacgaggcacgcgcaatatactccatccgtttcaaaatgtttgacaccgtttactttttagtacgtgtttgacaattcgtcttattcaaaaaatttaagtaattatttattcttttcatatcatttgattcattggtaaatatactttcatgtacacatataattttacatatttcataaatttttttaataagaagaacggtcaaatatgtgctaaaaagtcaacagtgtcaaacattttaaaacggagggagtatcataccagtgcatatgtttgtgtgtgccgctagcaagctggcaattgctatcgacttcttccttcctcatcttgaagtagtcattaacaacaatagtctctctatctactaccctaccctgccatgatgcccaaagtaaagaagggagtttttttcggttttagattttttttaatatttacagaaataatctatcggccaaaaaaattacaaaaatagaccctgccgcccacctctggggcggtaagctgacgtggcaaacgggggaggaacgggcggtgacggagggagggttttttgcaggaaaacccttgccgccctctggtggggcggcaaggggcccgaacgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatatgctagtttggaatcaatacattaccgttgcattggcttacacaagaagatattacgttgtagatgtttattgcatgaaagagtaat

SEQ ID NO: 54778 - DNA, 1501 bp, Oryza sativa
ggggggggaatgtgacatactgtcagacaatggtaattattatagacaccacaatgtgttatatgtaaggaaaaaataataaggggaggttcacctaaaaaaccattgatccttaacctcccatgacatctccctgcaacaaacaatatataaataatgcaattaatttgcatgcagcatccaatagccatatcacgtagtctcattcaatacttcttgctagataatatgaccatattttttatttttacccaaatttctattaattttagttatcctgatcagatggcattgatacatagtacattaagaaaaatcaatttaaaactggatatgacatattctagtataatgaatctagacggatgtatgtccaaattcgttgtaagagcaaggataataataggctataagcaagttatatgcttatgtggaagagagagataaaaaaaagtggatagtgttggctctcatgcaagagccagctccacacaagctccaagaaatatgcattaaattcatagagtgagaaagagagagaatggagaaaataaggttaaccttatagctgacctattatacaagttagctctaacatagacatagtaagcagtgagctctactattaaatctactctaataggatgtgtcacatctaatactaggttggttttatatgagacgaaggagcaggacagtaggttattctcccaaacaggaaaaagcagaaaacaaaaagtcattcgttcatatcatcatacgctgtactgtactccctccgggttgataatacttgtcgttttagacaaggacacggtcttcaaaaaataactttgaccattattttctattataatatgtagaaaagtgttaacaaatatatgatcttattaaagtattttttaagaccaatctatacatgtagtcaccatatttgaaatacaaatattttaaaaataattcataattaaagattgtaaagtttgacctcacccttgttcaaaacgacgagtattatcagcccggagggattacgtttcaaacttgacaaaaaacgccgttatcgaagcctccgtgaaattccaatcaaattcagggtgcaaaccacaaatgccccccatttggaccatttgcctctcttcctcctctccatctccacgagaggagagaagaagaaaaggagccaagcaaaaaaaaaaaaaaaagcgagcacgcgaacgccgcgtgatccaaatcgaatcgaatcctcctccgccgccgacgagggcacccgccgcccgccggtgagcccgcgcgagcccggccggattcgattcggccgccgcccggttgatccgcccccccgaggcggcgggtggtggttccgagatctcccggcgagccggaggctcctccgcgtcggatttggcgccgcgggggaggaggatgggctcgcggataaaggagatggtgcgggtcgccaccgcgcggctcggcggggagccgtcgccgcgtgggggcg

SEQ ID NO: 54779 - DNA, 1501 bp, Oryza sativa
gcagtactttttgtagcaaaactatgttgatgtgtctattactcctacttatcatgatactttctccatacataaatatttaatgtttaagataaaatttagttaaacttttaaaactttgaccaataatgatttctcagatgcttaagtttaatggtatatgtgaattgccttgaaaagtattatcgtaatatcgtaaagttattagatttttttttctgaacttgttctaatataaaattgatgatcaatgttttaaattttggaccgaaccttatcctaaactctaatgtttatagtatattttttgcctcaggcctgctatagtaaattgaaagaatcgctcaacgcgcataggctttagaaacaaacaaaaaaaaaagaattgttttgtttcatcgtagacctctgtttattacattccacatcagaatcagatcaaacttaaatcatccatactactcttccccatttcaagtggtaacaccataaagcttgttggtcactcctacctggatatgagttcttgagaagaccaatgacgaaccatcaacgaagttcttttgtttcagagaaatcttggatgagccatctgctgccacatttgtttcattgtagacctctgtttattacttcctccgttttatgttataagatattttgactttggttttttttaaatttgactaaatttatagacaaatatagtaatatttataatactaaattaatgtcattaaatcaataattgcatatattttcataataaatttgtcttgggttaaaaatgttactacttttttctataaacttggtcaaatttaaagtagtttgactttgacaaaagtcaaaacatcttataacctgaaacggagggagtacaaaccactatcgatgcacatttcttctagaaccatagcgtaatttgagcgaagaatctgacaagccgagctccaaagttgtcgggtgaatccatctgaaacttgaggctaactcttctcagactgctgtgcaaagcaggtgaacgatcgttcactcaacgcgcggggatgtcgtcatgacgatcaccattgctgccgtgccgataatgaaaccgccgtcgccggcatccatttccggcgtgtgaagggaccaatggacttgtcgaaatcttgttgaaattaattgtgcatgaaatgacatcgagtatggtgtaggcaacgtgtcgagcttgaggctgaggtctcgaagagaagggcagcaacggatcgagtaggttggcgatcgctgccgccgccgtcctcatcgccggcagcgggcagccgcgcctccgttactagcttgaggcgctcgaggtcggggaaagtgcggaggtgctcggctctcgtctcgccttgccggcgacgaggactcgaggttgtgcaaggagcgtagcttcggcgcgtcgatcgcgatgcagccgccgccgttgtcgttgtcgtaggtgcttgaattgcacagtgccagcacgggtgtggtggcc

SEQ ID NO: 54780 - DNA, 1501 bp, Oryza sativa
ctcgtcgccatcttttacctcagtctcgcatatatcctagtaccaacaatcctcatactatgcaaataccggaatcgcgacatcaaacgtcgacaaatttgtctttggttgaaaatgttactattttttttataaacttagtcaaacttaaaacagattgacttcgattagagttaaaatgtcttgtaaactgaaacggagggagtattatttacaatacatgcacaaatatcggtgtgtcgtgcgcgtacgcacttcgatgtacctagtatatgtgattatagcttttaaaaagaacatcaagctcttttttgtgtttgatgtaatgtttcatctgcaaacgtggtaatatttaacaattttgattacgaactttgtgaggcactggcagatgaatatctaattaagtcgacggcgtacacacggtctactctatttacctcggtcaaattatctttacgtgtacgttgggtgtgtgccagatatatgactatctacatccgaaattgccaagcggccaaacttcggaagagcgagtccgatttgtgatagaaaaaattctatgtgaaattaccatgtactctgtcattttcttatactcgctcggtccctctccctccagttataagtatttgactttttgggataagatctggtaaagtctttggagggagtagtccttgtcccaacaaatatggtaaaccgcttgattataattacttttacattagtagtacttcctccattctaaaatataaggcacaaccactcttagcccaaagatcaagaaacaattattatcatcccctagtttagattaccctaataaatataatgcatgcatccaatagaattagtgtagtgaccctcgtattctacttccggggtagaataccggtctacggctcattccttagtaagaaccaacttaccaagaaatgagtacaccagagtagcataacagaaacaactgtagcgaaaaccattaaataaaaactaaagaaattagcttttgctaaaataatcactaacaataccttgctattctatatcttcgtgaccttcaactctcagttgatgtagagatatggaacgagtctttgctttgatcttgatcaatcatgtagaacatttcttcacctaattgttagctcaacactacaaggaataatatatataagggatgagtacgaatggtactcaacaagtacaactatagcaatccaacaaatacatgcctataattcacctgcataatatatatatctccaaatcccataatcgaacaagtagttttatgcaagttcataaaacagtgtagtaaaaactcatattaagtaattataaaatctattgcatataaggcaccacaggtattagaacctccgataggttcctttcctgccgcgttcgcagtttctacccgaaacagggagtgtcggagtgacatatcataattcatatactctgcagaggtgtgtcgctgtacccacagacgcct

SEQ ID NO: 54781 - DNA, 269 bp, Oryza sativa
gcaaaaaaaacaaaaaaaataaaaggaagcgaaaggaaaggagaatctcggcgcggcccccgccctcttaaatactacgccgccgcggccgcaaaagctccgagcacatagcacgcgcgcactcgtctcgccgcgtccacacccatcggctccaacaccgacgagtagctcggtcgccggggccgccgccgcgcgcgcgcgccaccgtgtcgcgacttcctccgtgaccgggccgatcgatcgcgaggcgcggcgcggcgaggccggca

SEQ ID NO: 54782 - DNA, 1501 bp, Oryza sativa
cttgagttcttgactcgtacaattttttctctgaactttcgtttcgccaaggttgcggatcttgccgtgtaccgcctacacaagctatggacgaacggcgaggagaagccgggagacctcgccgcggacgttgccaagagcacgaaccagagtggacaagcgtcggcggcggactactaccagacttaccagaacgcggtctctcaggcgtatgcgtatgcgccgccgtacgtcctccagccaggatggagccaagggtacccctacgatgtcgcggcggcgccaccgaccgcgccctggcctgtctgttgggcgccgccgtccgcgccgggatcctatgactgctgctacgcgtccacgttttcaaggccgccgccgccaccaccaattgctgcgagcacgctggacaaggcgccgataaccagtaccgaccacggcgcatcaacgaacacttcggcggcgacacccgtggcgaacaacaagccgccgccgccaccagttgctgcgacagcgaccacgctgggcaagaagggggagggcaagggcaaggcgccgacgaccaccagtaccgatcacgccggatcaacgaacacctcggcgccacccgccgcgaactaccagccgccgccgacgacgactacgccgccgctgcagggcacgcagcacgtcttcgcacccggcgtcgtcgtcgggcatgaggacgaggagggctacctcatcgtcgacgaggtcaacacgtggcgcaacacgcagcagctcgtgctcgaggatgacgacgacgacgacgacggccgtgccgccggcgccggtgcaggtgagggtggcgcttcagcctcagggcggtgacagtctgacatcagcagattaagagagaccctgaggcgtatcagttaatcatgcgtgtagttactagttaggctccgatttgagcattggaatttccagatttcccgactgcttagcttggttttgatctgcccgacaaatttccgccaaattcgtagtgttcaactgatcaacttcatgctctttctgtccgttggttattactttacttgttctacgtgagattgcaattctgatctgcaactgcttgtaatctggatgatcaatagctgcttccctgctttatgattgtggttttgctggttttgaaatgctcgagttaaattggctctccgtgccacttgatttggggtaaattaatgtttgatagatgaaccatacttttctaacatgggagccatcttttaattttatgatattgatatcaaagtgacatgcatattcatcaaaaagcttttttatgaaaaggtgacagaaataagtttgtggtggtgcgtgcctggttaaatcatgaaattttagctttgggctctaattgattgttcatagtccaaagtactattcagcaaggaaacaagatcactgaaattcgctccagtcaaaactatcttgggtgaactcaacttaggccctctttgtttaggcttataagcca

SEQ ID NO: 54783 - DNA, 1501 bp, Oryza sativa
aggactatgttgtggctgctgtcctgttgggggaaaattttgactaggatcccaattttctacatcaatgtttgaacccaacaaattaacatagttgtccatgtattcacatcatagcaacataaataaaatgaacataaaagcacagtacaaatatagcaacatgaatctaatttgtactctattcttattacttttctctactatgtgaatataaaatcaaagtaagtaacattccaatatattttctctccttctctgctattactacttaacattccactgtattttctttccttctcttctacttttcttctctaccttctttgctagtactactttgcagcgggatggccgataggcggcggccgagctggcaacaggcgacggcgggcatgcagccaaggggcggcggcggacgaccggactggcgagaggcaggggggatgcacgcgacggccgcggaggcggacaggcagggaagagccatggatggtcgggaagaaggcagccggcaacgggtgggtgagaggcggaggaggcaagcgacggctgcgcgcttggcaacagcggtaggcagctgccgcgggcagggcgacggcggaagtctgcaggcgtgcgcatggcgacgacggcagacggcagtcgcgcggctccagatctggtacgcctctccctctccactctcactccaccctccctctccaccatccgctgaaaaaacaacccaaaaaggtgcatggaggactcaccttcgctggccggccacgacggcgatggagaggaggtcgcggaagtttggataggggcgggagctcgatccagatgcggttgttacgatttggcgtgaggagagagacacgctatttttggcttttctctctctctgtttagcgcatccgacacttttagcgctttggatggcacatctcctggaccttgttttttcgctcctatacgccaaaatgcggatggagtagcgggtagcgtatgtcctgggatgctctgacagggaggtacctagtgtgcttatcgcctctgcacccgctctgcctctccttcacttggtacgccgtacgtgtatggtaaaaaaaaaaaagagtactagctggcaagctgctgtttgttaatgggcctaccccaatttgcgtgagggccttaatgggctcaactggcgcgcctcggaaagttgggcctcacacaggcccatatcttacggggaaagtaaagctacggcctaaatggaataacgtctttgcgccaccgttttcttccgcagctggccaactcgagccacctcatcaggaaaaaaaaaaagaaagagagaaaaaaaaaatctcgcctccctttcaaatacgccgccgcggccgcaaagctttcgctcggagcacacgcacgcgcggcgcgacggcgcgacctcgcctcgacacgagctctcgtgatctcgtctcgccgcgtctagctcgccggcgccgccgcgcgcgcgcgtcccctcgccgcc

SEQ ID NO: 54784 - DNA, 1501 bp, Oryza sativa
gacagatgggattgatgaaaagcttgtgaccttagccttgccagcatacaccatgaagtgtgcttcaagcgccgacaggcgtgggcattaaaaggtttaaggcgtctgtgggtacagcgacacacctctgcagagtatatgaattatgatatgtcactccgacactccctgtttcgggtagaaactgcgaacgcggcaggaaaggaacctatcggaggttctaatacctgtggtgccttatatgcaatagattttataattacttaatatgagtttttactacactgttttatgaacttgcataaaactacttgttcgattatgggatttggagatatatatattatgcaggtgaattataggcatgtatttgttggattgctatagttgtacttgttgagtaccattcgtactcatcccttatatatattattccttgtagtgttgagctaacaattaggtgaagaaatgttctacatgattgatcaagatcaaagcaaagactcgttccatatctctacatcaactgagagttgaaggtcacgaagatatagaatagcaaggtattgttagtgattattttagcaaaagctaatttctttagtttttatttaatggttttcgctacagttgtttctgttatgctactctggtgtactcatttcttggtaagttggttcttactaaggaatgagccgtagaccggtattctaccccggaagtagaatacgagggtcactacactaattctattggatgcatgcattatatttattagggtaatctaaactaggggatgataataattgtttcttgatctttgggctaagagtggttgtgccttatattttagaatggaggaagtactactaatgtaaaagtaattataatcaagcggtttaccatatttgttgggacaaggactactccctccaaagactttaccagatcttatcccaaaaagtcaaatacttataactggagggagagggaccgagcgagtataagaaaatgacagagtacatggtaatttcacatagaattttttctatcacaaatcggactcgctcttccgaagtttggccgcttggcaatttcggatgtagatagtcatatatctggcacacacccaacgtacacgtaaagataatttgaccgaggtaaatagagtagaccgtgtgtacgccgtcgacttaattagatattcatctgccagtgcctcacaaagttcgtaatcaaaattgttaaatattaccacgtttgcagatgaaacattacatcaaacacaaaaaagagcttgatgttctttttaaaagctataatcacatatactaggtacatcgaagtgcgtacgcgcacgacacaccgatatttgtgcatgtattgtaaataatactccctccgtttcagtttacaagacattttaactctaatcgaagtcaatctgttttaagtttgactaagtttataaaaaaaatagtaacattttcaaccaaagaca

SEQ ID NO: 54785 - DNA, 438 bp, Oryza sativa
acataactaacagctgagattttcattagttgaactgttatcctgaaggacctagacccattgactgcccatggagtctttagtccttagaaatgcgtagtgagtacattttattgtctaatagcatcaaaactatgaaattgagactatcgatctatttctgctggacgagctattgtatggctagaaaaatcctggttgtttggggtgatcctgagagctgaatttctatatccaaggtagaagtggttgtggtgatagtataaggtagcatcataatttgccacagaaaaccttgcaatctcttagctttcaagtccgtatgtttataacttatgatatactttttttttacttttgttggccattgcctatctctcatgactcatctctgggcactaacctcttcatcccatacttgtgatattcaattacagg

SEQ ID NO: 54786 - DNA, 853 bp, Oryza sativa
atgttaaacaaaccaacagatcaaatccctaagtaagaatacacaatttcttaatatatataggaaatatatgttcaaatcccaaaatgtgagtcatgttttgtacacccagtcatcaatttcagtaaggaaattatatttctcataggcatatggactcgattattacataatttgagtataaatgaacagaataaacttgcagggatgtgagcgcatattacttgcatgtaaggaccttgttgatattggcctgcgtcgatagttggattgggctgcactgaacagcaataagatgaatttcatgagcataaacgggtaggggtgggcatttggtctaaccgaaaattttggtctcggtctcggtctttcagtcttttcggtctttgaaaagtgaagaccgaatttcagcgcaaaaatgttaggaccgacaaattcggtctcggtcctaaccgaaattcaacaatattttcatatatgcaaagaaataatggaaattttcaacacaaaaatcacaaaaaaatttcgtaagcacttatgagtaaagactcttgttaggttgcatgcctagaagaagtagggatgtgaaaattagagttcaatcctattaaacatagtggattgtaggttgcatttagacgtttttttataattcggtcttttcggttaaccgaggagactaaccgaattgaccgaacaaaattcggtctttcactacctaggaccgaattgatgaccgaatttctcggtctcggtcttttcggttcggtctttttctgcccacccctataaacgggaatataatattgaccaaatgtaaacctcactctaataacacaaacggttccattta

SEQ ID NO: 54787 - DNA, 1501 bp, Oryza sativa
tgaacggctgatgatgcaagttttcttaacaggaaatctaaggaacggagtcctgtaaatacagaataactaccaatactcgtaaatatctattcaatcttatccggcctatgttatcctcacaccacctattcaatcttatcctctatgttatctcttcccctttcctcctcctctctctctcttcaactatcatgtgcacggaggcaatggtagtggctggccatgcagggaggtgtgttgggcgtggagaaagctaccgtcaccgccgtcgctgctggtggtggaggcatgggtgtaaaggaggaaatcgtgaaactgtttgtggggtaggtgcccggccaagcaaatgatggaggcgaagctactcaccacattctaggaggtggccatcgtcgacgagatcactgacatgaaggacaaggcctctcgaggtgtggatccgtatgacagatttgggctcatgaccccaaagcactcatgttggctttgttttggtgtttgatttggggctttttacatattctatgggtgtttttatagctatggcaacttttttctataattgatttattttgtcggtttttattgacctctctcttgataaatatatgatttttttgttcttattgcgatgatactttagtggcatcatgatattttggtacctataggtatcagacatggtactcatgtactacggctggtacatatatgtcttgtactgggtccttataggtacaagacttggtgctcacgtattatgtttggtactattaagtatactacatggtaccacataccgacatacgtatacattgacatcatcattgacgtgatagatatagtatattagacctgatactcgggtatcatgttttgtaccaataaatatcatacatgatattccctccgtttcaggttacaagacattttgactttggtcaaagtcaaattgttttaagtttgaccaagtttatgggaaaaagtagtaacattttgaacccaagagaaatttattatgaaaatatattcaattattgatttgataaaactaatttagcattataaatattattatatttgtaacttagtcaaatttgaaaagttaaaacgttagggagtaccacgtaagtataaggtgacgtcaattttaacatgaatatgacgtcattacttaagtatcccgtccgaacggggtatcatttccgagctgctctctttttctaaaaggatagagttattacatagtaatagtaatgatacaatattgaaatattttacgtcaaatataaaatgataaaaaatataatttaatttaaaattaagctctaaagtccccaattctttttttttcaacgtggcgatgttattttctatgttccttaacaacttttatactactctaaacaaattagcaaacataagggattaatgaacaactgggccggcttgtgcggttgtgcctgagtggaatggccgacgctgcccaggaagaagg

SEQ ID NO: 54788 - DNA, 1501 bp, Oryza sativa
tggtagctagctgtatgtaatgatgtgattattccaagcaagtggatggatgctgcatgaacagtaagaagatagcgatgcatgcatgcatatgcaggattccccctgcttttttcaggtgtttgcaggacaggttagatcgcgttgtttgctggatgatgatggatctccttttgactgctgcgtggggcccttttaaagactttaatcaatgtactgtaataagcgggtgtaatttttttttgacatttttattaactttaattctctgctctgaactattgtttttcattctaatggaaatgtggagatgttcttgcgtctctcttcgataaataaaaggaaaatgaaatttaattctagacgacatgtctcgacacagctgattgcgtacggacatgtcatataagcaatggaataagtaatttatatgtatgtttcttagtgtattgaaagccaaacctgaaaaacaacttagcatgagaaaaacgttaaaatcaactctaagattttgttttaagatttaatttttttgttacggttgataagtcgaagaggaaacaatgaaattgatattgtcattctatatcatataggccatgtttggcaaatgggataggaaaatgatttcccacccaccaatagacatctttaaatcctaaccattcattctccccctttcatttaatcctaacccttcattcatttcccaatctcaatcccacctctcatttcccattatctaaacacacccatagttcatgtaggattttaacagataatcaattgatttaaatttggacagcctttcttattcattggggagtatgtaattagttgtggcatactcttaactccttttcgatccaacggctcaggcagacgcacgtggatttaccctaacgaggaactgatagcgccatcggcgcgaacaaacaaagagaacacatgcaagcatgtgcttaattatatttatacataatgttagttacattgatagatactccctccgtttcattataagtgcaaccataagttttcgtatacaacttcgatcgttcgttttatttaaattttatttaaattagcatttttattgttataagatgataaaatatgaatagtactttatatgtgacttactccctccgtcctaaaaaagacaaaccgcgggttcccgtgccaacgtttgactgtccgtcttatatgaattttttttataattagtattttcattgttgttagatgataaaacatgattaatactttatacgtgacttgtctttttaatttttttcataattttttcaaataagacgaacggtcaaacgttggacacggaaaccagggtttgtctttttttaggacggagggagtatacttttaagttttttaaaaaattaaataagatggacagttaatgttgggcatgaaaaatagtggacggatggagtctggtttggtgatttggagagaaagaaattaaaatttgaggaggaga

SEQ ID NO: 54789 - DNA, 189 bp, Oryza sativa
aatcgccctcccagagggcggtaggcgactacttccgtcaattttcaaaatggaaaattatttttgtaaaacttttaataaaaaaaattaaaaataaaaaaaattcgccgatagaggtggccatgcgtggcccaggcggacggacgggcgcgcagcccatgtgtggctcgtgggcttttccggcccagc

SEQ ID NO: 54790 - DNA, 1501 bp, Oryza sativa
caagtcttgtacctataaggacccagtacaagacatatatgtaccagccgtagtacatgagtaccatgtctgatacctataggtaccaaaatatcatgatgccactaaagtatcatcgcaataagaacaaaaaaatcatatatttatcaagagagaggtcaataaaaaccgacaaaataaatcaattatagaaaaaagttgccatagctataaaaacacccatagaatatgtaaaaagccccaaatcaaacaccaaaacaaagccaacatgagtgctttggggtcatgagcccaaatctgtcatacggatccacacctcgagaggccttgtccttcatgtcagtgatctcgtcgacgatggccacctcctagaatgtggtgagtagcttcgcctccatcatttgcttggccgggcacctaccccacaaacagtttcacgatttcctcctttacacccatgcctccaccaccagcagcgacggcggtgacggtagctttctccacgcccaacacacctccctgcatggccagccactaccattgcctccgtgcacatgatagttgaagagagagagaggaggaggaaaggggaagagataacatagaggataagattgaataggtggtgtgaggataacataggccggataagattgaatagatatttacgagtattggtagttattctgtatttacaggactccgttccttagatttcctgttaagaaaacttgcatcatcagccgttcataaattctactgtatatttggttttatatataagagggaaatacatgtgggacccacatgtcatagttttaagagttaacattccattattcacattcaaagtacatatgcttttcgaagaaagtcacccaccgttaggaatcgacttaaacatagtaagaaaataaatttagaggaggaagactaaaatacctatatgggattgaaatctctgggcgctcgctgtcttgacttcaaccagaacactcaaagcatgtacgctagggagggttcgaataatggcggcggcggcggcagaggcgtacgtgcggcagctgccagcacaggtgcagagggaagcgtacgagtggcgaggagattgctctcgatcggcggaggaaggcctgcagcgaggagccgatcgaggagagagctagctaggcattcggcacagggctcggagggatgtacgtgtgggtgctcaccgtcgtcggccgggtgcagagggtggtgcaaaagctcaccgatgctacgcgcgtagggaggcgccacaagcacacctttggcgcagacaaatccagccgccagatccgacggctgcgacaccggccgttgaggcaacgagaagctctaggtctgatgcagatgtcatcggtttagaatacaaaatacaaatcaacttgtagatattatttcatatgtatcgagggtattcatctaatatatggaccaaagagggactacttcttctggatccaaaattaataaaata

SEQ ID NO: 54791 - DNA, 1501 bp, Oryza sativa
gtgtccgaaaaacccttccaacatccggtcaaacgtctgatgtgacacccaaaaatatttttttccccaactaaacacacccatgatgcagagctgcaggcgtgtcgcgtgttactgcccagcctagctcgatctgtagcacgtggccggcgttgcatgccgccgtactggttgcatcggtacatcctgactcctgagtcccttttttttttttttgagaaccacatcctgagtcctggaccttcacatgcatgctcacacgaaccgatcttttctcgttcaattcctccacgaaaaacttctcaaaagaagaaaataaagaaaaaaacaaacaaaatctgcatgatgttgaagcaccgcgggtgtactctacgtgttgcattgatatccgggtttatcgaatcgttttaaatggggttaccattatcctaggtttcggtggttaccatggtagccgtacggttatcgtgagatatactgtagttctataaactaagaagattattacacccgcggttttgtaaacctgccatggtcctcatcggtaaccctacagctttagttgatcagtcaaagttggcctttttagtttagcataatcagtcctaaaaagttgtccagaaagatcggatccactaccaatagctggtgcttatttagcccaataagctaaccgatgggtttagtgttgaatatcagtctcagcaacagcaaaccgatgaggtcccatgacttctcacactgctcctcttctgacattcacaagctctcattcaatttgtgcataatgggggtgcaagatatgtaaaaagaactgtactcctgctgctattttgtctgcataagtcataggctgttgccacctcgcagtgcgccgtttcatgatcatgaacatactgccgatgcgtgcacccggccccatgttccaacaatatcttgccctcggattttcacggaaaatttccaacgaaacggttgattaatttcgttcttttatatgaatcaactgcaaaaaggtgttcccaattaccataactaggggggccacacatttgcattatcatggacttaattatctctgtaatgtaactccgttttacttttgaatttttcctaattaaactaaaaataagtttaatcaagattataaaaaaagaaaaattggcaaaatctaaaacatcaaattagtctcattacaatttaacatgaacgcattccagtaaaatatttgttttgtatttaatttgtctcattacaatttaacataaacatattccaataaaatatttgttttgtgtttaaaatactactgtgttattttataatcttaatcatatagtaatttaaaatggagggagtaataatatataataataaagcactgatgagcatttgcttcgcacaacgcaacataccaaaacccaaattaattcattaattaactctgaccgatcgaaatcgatcacagcgcgcgtatatatatagtacaagcgaaaccacc

SEQ ID NO: 54792 - DNA, 302 bp, Oryza sativa
tctccatcactcacatgaatactgtacgtaggacagtaccacctctctctctctgggtctgagagactctgagtctctgagacagtctgactctgcctctgctcaaagagaaaggggaacccaaaccccaaacccctgcaagagcaaggcgtacggcgtcctggtcactggtcagccgatgcgacgctagatagggggggtagctagctagtactcgagtgatgaaagccggtctcgccattcacaggcacctaccactgttctccaaaaggagccgagctacacacacacactggcagaga

SEQ ID NO: 54793 - DNA, 1501 bp, Oryza sativa
agatcgagtttggaagcagagcaggaattggctggaatccagatcggctacagttaggatcggctggatctaagtcgggctaaataagccgatataggcgattccgacaatacaacttgtacgcgacatcgggttcaagttaatgtatttcaaggtgattgccacgcacagatagagtcctaggaaggtaattgtatctattaattagtatatcttatgtaaattccttatagataaatgtgggcaaaagtctgccgcaaagacttatagtatcttagagtttgttatagataatggtcgtgtccggtatgggcatatcttgtaattctcgggtataaatagaccccgagccctatgtaattttttaacacacacgttcaatacaatctcggcgcatcgccacccttttttgctttagttttgttttgacgaattcttgctttcgggttgagctgcatcgatttcgatcttcaacaagaggtaaaattcgttatgacggattgcgttcttaggattagtgcttccatctttatgacactctaatcttgtttatgtaattcgtcgagttatcatatgtcttacataatctctagcaatatcgccatctaatctactatcggccaatatctgtatgcagaagacagctgattaggttagatcttgacgttgatctagattatataacatatctaccattctatgaaacttctagcggcttgattgtctaaatatcactcttcttttcatacttaatacttcatcagttgagtttgatctattaagtcgtgcttagaatatcgatctctagcctgccttctagttgccgattagaatagcattggagtttcagccgatcgtatctgatttaactatatttgttttatatgctttactgatatgttaaatctgccctttatatcaagatattgttgtatctaagtatgttaggcctttgattgatatattatacctactttaatatcctgatatagagttgtatcggagtattagccgatacatgctagatctatctgatcagctacgctacaaacatatatagtcttgttattgatatatatttcgatctaggtgatttatattgtctcggtatggtgaccgatctatcccaatcatttgatttaagtatatatcaacataaggagtatatatcgttaatatctacagccgatcaagtagatttagttcttcttcacttattcatgactgccgatcgatacacggatgacatcggcccaaagataaatgatatgtcatcggcatatagccgatcggctatcatttatagatttaaccacggtttctttgcttctatttcttgttgattacaggatcaaatcaactggcacgctaatacatccgaaggcaagcttttgacctgcactggagttaagcagatctcccaggccacgtgttttctgtcaacacgcttttggcacgcctggtgggacctgattagaagtcagacgtcagttcttcctca

SEQ ID NO: 54794 - DNA, 710 bp, Oryza sativa
tagaaaacttcgaaaggtggccacgcccattgcagccatggaagcggtgatccacgggcgccagccttgggaagggcttctacacggacacggtggcagcatgcgggctcgagaacagcggatccaccgtcggcaggatcgggagcaccaaatccgtcctcgtgcgtggtagagaggaggcggaaggagccacggcgaccacgaccacgacagtggcgtgcatgttctagagcattggatccgccgccagcgtgctcgggaagggcggatctgccaccggcaggctcgggagcgacagatccaccctcacgcatgatggagaggaggcatatggctgtagtggcgacgcctgacgacggcgacctagggttttggatttcttttattattattattattatttcaaagtatcattgcagtcgggcatccttatttggttgcctgcaaaaatcgggtctttaaaagtggtctccttaggacgctcatctgcaaaaatggtttctcacatgcggttgtgatgaccacatgtgaaaatgctgatttttgcatgtgaccgccgccgggccaccgcccgtccctgcgtcaccgtgcacgccttgcaactaagggcgtgtttggttgcctggaccgcacttggcccgcatctggcgtgcaacctgcaggttgtttggttgcttggacgggggactcagccaggcccagcagatgca

SEQ ID NO: 54795 - DNA, 1501 bp, Oryza sativa
aatcgtgctctattttcgcatgcgactctttaaaatgaccacacagaaaaatcaattttcgcagacgagcctcttaacagagcctattttcgcgtgcggacctgttaagtgatcagcatgcaaaaatagcccacccacctttttagctcctgatgccactagatctcctcccatcctcccactcggccactcccactccctctccctctccctctcatcctcccatctctcctcctactcctcccatctccctctcactctccagccctctccctcctccctctccccctctacccactcccggcgatggtggcagcctcggctagggcggcggtggcggcagcatcggtgagagcggtggcggcattgatggtggcggcatcggctagggtggtggcggcggagcggatccgtcgtctgccaccgtggggagggcggatctgtcaccggccaccgcggggagggcaggtccgtcgcctgccactacgggaagggcggatccgtcaccggtcaccgcgccgcgggaagggcagatctgtcgctggcgaccgtggggacgatggcgcgggcctcaggcagggcggcgatgacgacggcggtggcagcagtggtctcccagcctcgggcgtttggatccgtcgtgggcgactgcggggatgacggcggcgggcctcgtgctggctggcaacggcggcggtagttggattagggttccagccttccagggcgtcttttgattttcttttttttgattttttattttctcgtgcacgtgattttcgtgtgcgggtgtgtcaactgcacgaaaaaaattggattttctcagacactttgtttcagacgggtggaagatccacacctgaaaatcgctttcggctgcacggaaaaatcgttatcgtactagtgataatgagatcatcgcaacatgaagctcgttgctgtcgcaccgaaattcacgcttcgattcccatagttgagttggaattaatatgagtcgtcgttctggtacgacgacattaaacgaattctgaactttgattccttgattcgtgtatatatatatgcatatataaattgggaaacgaccatcaccgattgatttgtggactgaaagtaaactcatgcatgaattaattgtatgatatatcatagctccattagcagcaactaattaatattcgatagatccgtctattaaaaataaataaccatttttatacacaacaattattattcgacgtgcttgattcttactacttgactatatatatatatatatatatataggtatagctaatctttgcctgttggaggtcaacatattcggtttccgttgagtagcaagctagttttattttttctttatgaaagaaaacaagtcaggagtcgtagcataccaatccaggaatccatcaatcgttcaatatatactttaaatattaatcaaggcaattaattaactaaccgtgattaaccttttctagatttaacatgaggccat

SEQ ID NO: 54796 - DNA, 236 bp, Oryza sativa
ccggaggtgggcatcgtctggggttggtccagatccatcttgacgcggacggtttcgtttgatggcgagatatttcaggatttttcggggatgaaccgagacggtttgttgttaggtcaaagaaaaaaaagaaaaagagggacatatactcggattcggagtgtgctccacgatttaaaaaagaaagaccaacaccaggtgaaatcgcagtaacagaatccgagacacgaacacga

SEQ ID NO: 54797 - DNA, 764 bp, Oryza sativa
tcctgcagcccctataaaatatctcgtccgattcttgattgctatattagagacggagggagtaacatgcatcttactatcttagggcatgttcactttgataccattttcaaccatactaataaatcctggtaaaattttggcaatattgacatgttgccaaaattttggtattgccaggtttattttggctacagtctgaatatgcccttgattatgcaataatgctgtacacgtacgctagttagtactttagtagtgctggaaccagcacgtacgtgcgctcccgtggcccgtcgacgtccctcccagcaaagcatgggaaaacgatcgagctagcatagatcaatgcatcaactatcgatcagcaagtatacatgaacacatgacattatgttgcaagttgcaaccacctaaatagaccaaattaaatggaaaatttaatttccttgtgctctttaattacagttgcattgcgcagcatcaacgatcgatcgatgcctagacggattggctgttgtattttttttagataatggaatataacatctcggtctttactcaagagagttacagccaattattatagagaagcacctaaacaagaatgtagttcaacaaatcattgaaaacacccaatgaacaaaataagtaacgaatctaaaataaggagaacacattattgaagtctatttgtgaatctccaaccataattgataaaaagttgcataattatcgtctcaagtttgcaacatgcaacttgt

SEQ ID NO: 54798 - DNA, 1467 bp, Oryza sativa
accgagaaattgcactataatcctgccctgtccatgggatgaacagggaatttgggtctcccagatgatacctagagattatttattcccacactgcatcataacagtactaggatctgcttgttttttatcgttagtccaatcagttgataagcactgatgtactgttagaggactgcctgaagcctctagctgagtggtagggcatatggttgcaaacatgtgatggttgtggatgtgtggttaactggttattctcaactcttttgagaaaaatatctcactaacaattggattgcaaaggtttttacataggaaaatacatccaggattggctagtgaggaactgagcctagctcagttggtcgatggtgtggatgtacgcctagaccacccaattccgattccttgttgaggcaaatttgggtgccaattttcttgttagtacaatgttccctagttcctgctaggttgatccctagttttgttaaagattagcaggtacggtcttggacacttgtcagttagacattatgttttttacttccagtatgcagaatctttgtagctttctagagcacaagatctttgtttaatcagataaatcgggactacaataagaacttggtacagccatttagaagttctgtgcactattttgacctaggtcatttgtgcatattgcttatggcctgtccccttgaacattcatatccttcagtatcagcgcctctcctgacttggcatgctagaaaactctcaatacttctgctaagttcttgtgcacaatctttgtattttgtagtgcttttgctcaccacgccctttgcaaatgtaattccttttttggtggttagtttgaatagatggcactcaaatttttaattcatgtgatagatgccgtcgcataactaaaatgtatatctgctaacagaccaaattaatagtgtaggtttgttgctccatgatactttgtccaatatatgaaaagagaattattgattgatcatagtcatagatatttgaatgaacacatttgatgtatctttatgttttccctgtttgtagtgataacttttgtcccatatctggaaagggattttttttcagatctttgaatcaatacgtttgttgcatcttcatatatttcccctgtttctagtggtaattttgttttttttttggcagactggtgcaaagaaggcttataagaaatttaaacatttcaagggcaccacagttgatcagagatgcggaccaattacatatagatgtggtctttgtggagcttcatcaaagtcgttcgagttgctgcctgttgaacctgagcaagagatgaaaaaacatgatgtgaaagattcagagttgagcttacctgataaggtcaaactggcaataaaattggttatttactgttctgaataaattagcctaaaacaataattttttttgggagatgaatgcagg

SEQ ID NO: 54799 - DNA, 680 bp, Oryza sativa
ttcctgcagccctacggtggtagagtggtggaaccttatgttggtgcacatgttgagtttgaggatatgtcattgaacggcatgtttgtttctaccccccccactcttatatgaactaaggtcaccagtgaaaaaattctttggatggaccaagataatgtggagattcgtttttattggagatccaatgttggtcaagggcataagtatatattaaatgtgatagtcagttggaatgggaagtttactttgatttggtaaaagagtctcagtttagatctctagaggtgtttgcatcaaagttagttcgtaccgtaaaaaatttggatctaaacaaatctccttcttatcattacgttgagaagaattttgtgacatattattctcgtcgtggagggggtacaagtaagactgagttggtacgggaagacttggagggggaaggagagaagaagagacctttgcttggaaatgatttatgggaggcaggaccatcaaagagacattgcggtagtgatgatgtggatgcagcgagggagatgaaaagggagttagtacaagaggggcttgatctaagtgaacatttgtcggtgagtgttcattggtcgtcgtacggagtcaaccctgaatacccgacagaagtagcaggccaatatgtgaatccagatgattactttgat

SEQ ID NO: 54800 - DNA, 1501 bp, Oryza sativa
agatctgtcagatattccattttgtactttctcatgcctttccagccatctttctttgcaaatcgtatctgagtgctttgtttattagccacttacatttgctctggctgtatactgagaacaaatcctccttgccttggctcaatagcttcttttagatctacttggtgtatttgaaaggtgaggtgagttccgcgttatctttaaaataatggaaggaaaaaaaaggacaatagaaacgaaaggacaatgaatttcatagctcgtcaatattaatgcaacaatctgagacataggagatcagcctgcagggctacttgaactaatttgcttccaggccctcatttcaatttttagtgggtccatttggttttctaaaggaaggtctacaaggctgtatacaaggaaagggtgcccaacctgttaccaataattgctaattagggcatattcaaggagtagtagctaattgggcctcataagcggtcttttaggcttgtataattgctacgaagtggctgacctgtaaaaagctggatatgaaaggaaggacttccatgttaatggtattaaggagaaagtgggtgatctgtagcgtacgaatacccacttactagcctttcagaaccttcataccactgtttttctgccaggaaaaaaaactgaacaagttctacttcattgctttaccttgatagaaaagtttatgaatgattaatcagataacaacttggtattgaatagacagtagttcataattcaaatttcatcacattgagcctcatttaaacataatttcacaccaaagttcttctccctaaccaacctggcagcacacttctcctgattcctggatatattttattctaatctaaagaagacagaatatcgtaattcgcttgatctgcatttaggtgtggttgctctgcttccatgcatgaaaattctactcaccgtcttcattaacattcttatactgccattttagggacaaagataaaccagtttgaataaggacagaacatttttcctggtagagtaagcggttaaccatatgaaatatatttgtttgtattttatttgagtctggaccaggtctgagttgtgaactattcacattagtatacgggtgtcctgattttagtctggcttattgttctggtacaaatcaaaatctgtccctgcgtgatgcctgttccaagatttttgaagttttttctcttgatggcatgcttaagtgtattccatgtcttattaaggtattagggttttatctccttaaaatagcccatgctactctttagttagctgcctcaaatatgcttctgcatcatacattttgtaaccttgaagaaatccaaaggatggcttgcagtgctgtttttttagcgtgcatgctcttctcatgatttcttgtatgtcaaacctgaacttccaatcttttcctgcagaattaaaggagatacgaagtttgttgcatttagatgacataagacagaga

SEQ ID NO: 54801 - DNA, 1214 bp, Oryza sativa
ccccactaccacccctgggacagtggagaccccctaagctctcactaattttttttccatagattcaaaagatgtggggactgtaggttcgatttatactgatgtagtttattcagctctcactattatttttttttaaatccgcgaagacatctaggtgtttctcatgaaattaattgggtgaccttaacaggtagacaagaacattatctaaaaaaacaaaaaacaggtagacaagaacaaaattgctacggaaattagatggaggaattagtgaatttgccatggttaggggaagggataaactgccgatgccacgttcgccacgggctgagcaagaaagttgacgggctaagcaaaagcaaacgctgattttagctgatggttggtgttaaaacacatggctgattgatcagcaatgttagaataaaaggggtacatgggttacggcaaatgttactggtgtcagctgaaaccactcatataacgctggatccgccccatacgttgttctatggtccaacgcaccattctcttcaatgaggcgtccaatttgcctattacaaaccatatatcaactccatgtatacgtcagaccttttgtgctcaggtataaatgcaaggccattccttgactactacctccatcctaaaatgtaacaacagttattcagattcatagctaaaaatacttatattttgggatgaagggagcagctaactagcttaccacacttatttttcacaagtatcgcctctgtctcaaaataagtttattttcatccatcgcacacataccaatacaaataccagaagactagaatacctctactttatccaatctcaatgttactattactcactttatctatgtcggagcccggaactaacaacttagacccgactaagataatgtatcaatccttggatcagtaaatattgatacatacaatataactggttcttcattgcatacgttaaagttttacaatactaagggttttacaataataggtactcacctaactaattaattaataattaatacacagcggaagtttctatacattctgactagggaggtataacctttatggattctctaagtaatcggggtcatcatagtaatagtcataagggtgctcctcttgacccagatctgaaaaaggggttataagagcaaggatgagtattcataatactaagcaagttat

SEQ ID NO: 54802 - DNA, 1476 bp, Oryza sativa
ttacggactgaagataaatacataagatgttgtatttaacatttgaactcttaaagttcgaacataatcatgtaagagaggctccatagctcaccatcttgatctctcttgcatatttccaattgtaaatgtctccaatgatgctgaaggaatccgtacatggagcatatcttgtccaaaataattcagtggaagaactccaagtacacaaaggaaagcggctaaggagaatatgcgtatgctattgaaaagaaaaacacataagcatatcttggatataaaaccaaaattgaagacttaagtaatatagtgagaatgcagtaggcaaatgaatacatataaagtaataactttatgtggcataccatgtgagaccccgatgaatgttggtatgcacattatcaactttggcataagattttttattatcattaacttttttgaagttatttgattcccatattattttgtgtttttttttacctatcctatttgacagaggaaatgactcatcataccagtcaacaattagagattaaaaaccactagtttaaataatcgtatttagcttgattttcattttcaaagcgccacggcgaaccttttaagtgaaagtataagttgattcctgatggtctaaactctcaaggcacacaaagaaacagcataaaaagaaacatctatataaacttcaaataagataaaaaatattaaagtggaacagagaatcaagtaattgtgtacatacctaaatacaagaatcctattgaagacaactgcatccaacccagcagtagctaagagttcatcctccgtgcatcgaagacttctcaaaatccagctagcggatggaacaaatctctccaaaataaaagcctccctgagcctactattctcctcagcaatccttcttccaaaatagaccttaacattttgcggttgcttcctcagaacggaatacagtgacaaaaaaagtatacagaggctaatgttgattccagctgaggtcaaaagagcgccgactttcatctctgtcttatgtcatctaaatgcaacaaacttcgtatctcctttaattctgcaggaaaagattggaagttcaggtttgacatacaagaaatcatgagaagagcatgcacgctaaaaaaacagcactgcaagccatcctttggatttcttcaaggttacaaaatgtatgatgcagaagcatatttgaggcagctaactaaagagtagcatgggctattttaaggagataaaaccctaataccttaataagacatggaatacacttaagcatgccatcaagagaaaaaacttcaaaaatcttggaacaggcatcacgcagggacagattttgatttgtaccagaacaataagccagactaaaatcaggacacccgtatactaatgtgaatagttcacaactcagacctggtccagactcaaataaaatacaaacaaatatatttcata

SEQ ID NO: 54803 - DNA, 1501 bp, Oryza sativa
tagggggctttgtttgttccacgatgatatttactcatgctgatcttactctagtgttttgcaatttaattttaacaattagacaattaggataaatatatatgatcaaacgatcctgaaaagagaattgttagaaaattacctacatgtgcattaaactctagcgcctacggatattgtgcacgtacgtggatttttatttcccacgggatttcagtgagatcgggatatatcgttggttttcgtctctttgagtgtgtatgtcacggatgtattattcgtgggtgtgggagtgtggtgttatgtgaatagtgatgcatgtccatttacagtataataaacaaaattaatacatattattaatctgctagaaactatgtacgttgtgaccatcaacccctgtcattatcgatctgcaacaaattgccagtacaattgacctatttcttgtgctatcattttcatatagctttcaagagaggaaaaatgaagacagtatacggttcaatgtcaaaatcgtggtagtttatgatgatctattttttcaatgcctccatcgcctctttctcgcgagcaattgtttaactaaccatttataaaaatacggcctagaaaaggttgaaaagtcagaatatgtctcctttcttgtcattcatataggtcattcctctgaaaatcatccacattttttccatggcatacttaattgtgcagagcactaacttaattgggcttaaaagcattgcgtatattctatttacgaaccttttgctacttgacatttataaatttataaatttatgcaccagatgtcaaaagcaatcttttaacaaaagctgcttccaatactatttcaaatcatattaaattgctagtcttctaaagaagtacataccagaacattgcaattcattaattatatctataacgtcggtggatacgtaattatttattccttctatataagttgaaattcattcagcctcatcttttcgcttatgcttatacttatcagctaaaatttaaattttcaaccttaaatttagagttgattttgatatttttcatcggagtttatttttcagcctttgcttttagatcgttaagaacacacatatataaaagttttattcacaaattatttttcatttgcaaatataccgtttcgcttattccactgataagcaaaacgatgagaaccaaaggcttataaagcagaacacacaaatatcaccactcactattaattacttctattattataaaacatattaaaacttttttaaacctaaggcggaactttgttccacttttatatttagaagaagagaattgacccagtttataaggaaaaccagaaccgaaaaccaacaactgcacggttaattacaggaaaaccggctgaaacccactgctacataactaacaatagcggcggagcccaatcgcaggacgtcgccgccaagctaaacacaaaagcaacacaattgctcccacatcg

SEQ ID NO: 54804 - DNA, 1501 bp, Oryza sativa
gaactagaatgttaaagctgaagcgaaatgagcgtagttcaactggttagattttatacggtggaacaaatccatctagatttaagttctagatttgatacgggtgttcacatttatagttaattattctttcagtgatatgcagtatacctatcgacagcgagatgtccgtgtgagcgtgtcaagggagcaacgcgaatcgagcaccatgatggttgttcttgccatctgtgtttatctttgttatgggttagcaattagaactactcacttcgttccaaaatataaaaacctaggaccgagtgtgacatttcctagtgctgtacagattcgtagtactaggaaatatcacatccggtcgtaggttcttatattttggaatggctgtccagattcatagaattaggaaatgtcacatccggtcctatgttcttatattttggaacaaagtgagtatttgtttgggatgcttagggtcatgatccatgagttggacaattagggcttgtttggcacagctccagatccacctcttctggaactggagctcagcctaacaattttagcttcacctaaaatgggagcagagctgggtagagctctctcacaaaatgaactagagaggtagagctgggtttaggcaactccacaactccattccagacccaactcctggagctaaatttaggagttgggactctaccaaacaggccctaaatatacccattcatcaatttaaccaatacaccagatatatttcatgtctggtgttttggttaaattgatcactttggctactcatcaatcgacaaccccttctccgatgaggtgcggaataaagtagagttaagagtgggagtacaagaaggaaaaggaaacttatcaagccaagccttggagggaggccttgaaagcagatccaatacgcttcatgtgcaacttctgacaaaaagagaaaacactctaatacaacaaatgcaataagatattgattataaaaataatcatcaaacttcaacaggagactacccttcaccttcttcctctactacattggctgaattcgccttcttcctatattccagttgccaaatatgggctccccataatataggctcacagcgagacagtgtgagagcccaaatttatagaaatcgagcttgcactagagagaaagggcctcacgatatcagctcatatggaggtggcacgtaatagatcaagttcttcatagtccgaggctccgatgtgtatggctataaccattgtggtccgctccatatcccttgttctccattgttcctcacaggatcaggggtggagagtgaagagagagcagaacgagtattatttctcgtcgcatcggatcacaatggttaatctaattcctgcaaaaagaaaaagatttactattttttatgctaaattcttctgaaattcatacctctgcattcaaaagagccttcaacggacgaacgtgagttccctcaatcagaatcag

SEQ ID NO: 54805 - DNA, 1501 bp, Oryza sativa
ccccaagccgctccgtcgcagccggcagcggccccaactgcgctcactcctgtgcaagcccaagtcaaccctaaccctgaaacacaaaccgaagccgacatggaagccatgcaacaaaacatgacgggactccaagacatgcttcgccaaatgtaagaacaacagtaagcatacgaggcggcaagacagtccaaggtcgcttcggctccaatcctccagtattcagcaggctatatcccacaagtctatccacaagtgccgacccagccccttccgcacaagtcgcgcaagcaccaatgtacttcgccgggcaaccatcgaccgcagcagcgcatccggcctctcacatgcaactgcaagctcaaccggtcgctgcccaagtacaccctcaaccgcctggccaagcaccacaaacaatggcagaaggggcttcggctctgtaggcgcagctccaggctttccttcagcagcttagccaaccccacaacatttcaggtacagccccttcggctcacctggaggggaatacaagtcaaggtgcgcctagttggttgccgtcgaatcggccaggtcaaggggcttcgccgtggagtcaaggaccgcagttcgacttcatcaatgctgctcaggcaccaaccattcggccgcaagcaccaatgtcaggcttcggagcaaaccaggcaccaaaccaggtcgccatgacatggtcacagccaactttcgacccctccatggtggctcagcaagcattaccaatcggagcggggcagccgaatgccatggcccaacctcacgcgcaagccgtgatttagccctttgccacgccgtactcgcagcaaggtgccgtgaacagggcggggggcgaaaaggggctaccgctgagtgggggaatcaagaaccgtccaatcccactccagttcaagttcccacccgtcccacgctactcaagcgaaactgacccaaaggaattcctctccatttatgagtctgcgatcgaagcggctcatggcgacgaaaataccaaggcaaaggtaatacatctcgctctagacggcatcgcccgttcttggtatttcaatctgccagccaatagcatttactcatgggagcaattgcgcgatgtctttgtccttaactttctaggtacctatgaggagccgaagacgcagcagcatctactcggcatttgccagaggccgggggagtcgataagggagtacatgcgtcgcttctcacaagcccagtgccaagttcaagacataaccgaggcgtctgtcataaacgccgcttcggctggtctactcgagggcgaactcacaagaaaaatcgccaacaaggagccacagacacttgagcacctacttcgcatcattgacgggttcgcaaggggcgaggaggattccaagcgatggcaagctatacaagctgagtatgataaggcttccgtcgccgctgctcaagcccaagcacaagttcaagttgccgaaccaccttctctcac

SEQ ID NO: 54806 - DNA, 1501 bp, Oryza sativa
gtaagaacctgtaataggggctataaatagtctcatagggccatgtaataaggggatcccaagaaaaattctctaattaatacactttacttcttttccaaccattgttgagtaaccacgtctttcgacgtatgcggttgtcgtttcgacaacagaggcgtacacgcataaattggactgaagaagagaatctacaccttcttagctattggatacattactcaactgatcctgtaaaaggcatcgacaggaaatcagaattttactggaaagctgtagctgatgtgttcaacaccagcgcgccaacaaatggacacaagaggtcagtcaagcaactgaagacacattggggtgatgtgaagagagatataacaaagttctgtggagtatatggtagacttaaagctacctggaagagtgggcaatctgatgacatggtcatgaactcagcccatgcgatattcgaaaaagaaaacaaggacaaacctttcaccttggagtacatgtggagagaggtcaaggatttgcctaaatggtgtagaatagtccaagaggatagtggaaataagaggaccaaggtttcatcatcagaagcatacacttcttcatctaaccaagacacaggaggaaaccattagcaaagagaagcgccctgatggacagaagaaagcaaaggccgggctaaaaggaaaaggaaaagatgctgcaccatctcctttgggcaaccaaccaagtcagaatatgattctatatcatgaagctatgtcacttaaagcaacagcaatgataaaatcagcaaaagagaagaagtaccagacttacttaaaactgttggagaaagatacttcaaacttcagtgaagcacaccacaagaggcatgaaggagtcctggaccaattagcaaaagaacttgctggggagtaaataatcagcaagtgatgcttgtactaccattacctattgtgcttgtcatatttagaggtgttgaaagtgtaattttcatatttagaagtgttgtaagtctatttgtaacccttaagttagctattgtaacaggtcgatgctctatattgtatggccatgttgttagtgtatgtgtaagccaaattaatcatattgaacagtagagaaatcacctttgtttatccttagttttgatccatgtcaaggtccatgacagttgtggaacagggcataaagcaaaataatatcagttgtaaaataatatcagtacattataactgttgtggaacagggcataaagcaaaatatagctgttgagaaaaagacaaacaaagtacagttgttgagaaaaagacaaacaaaatatagctgttgagaaaggtggcaaacaaaatatagctgttgagataaagcaatagatagctattggtatttagcagctataaatatgagatgcagtctaggacaccactccctcattcatacaacacacactccctcattccaaaaaagaagatgtccagtgactctcaagatc

SEQ ID NO: 54807 - DNA, 1501 bp, Oryza sativa
cagtgccaatgatacttttgtcaataatagagcaagtttaatagtatagcctactactagctttaattcatctatagtcaatctaaaagccaattcatataataattgcttactatactattagtatatggtcccacatatcatacacacattacgtcttagagtttgtggtacagctggctacagatctgttgcccgctactcatctctctcatcttttatctcattaaaatatgcttatagctgactaatatagtctgctactgtacctgctctaagcagggtaagtggcacatgtattgatagcttacttaatcattgttgggtcagtggtcacttaattacttactccatccaaaaagaaagttacaccttcgtcccaaaataaatttatttttcacacattctatacatgtcaatataaaataaaaggattagaataccctcactttatcaaatccaaatacaattattctctcctttatatactcttaatgtatttatctcctacttttactgtgaaatcattgtcatgattaatatttgtgatgaacaattggctatgcaaatgatttaatcaaagaattggtttgagagtttgtgtgaatgttggtgtgagtgcgtgtgactaatgtgggtcaggttgtgatatctgtgcccagaaacggttgttttgtctaattgtgtgcaggtgacttgaggtcagccttggtcaatggtgaagaccgggactatgctcagggaggagcagaggtctattgcggtctggataccatgtgagaaggtgagtagagtctggattcttggaggtcaagttcggtcaacggtggggatcgggactaaactcaggaaggagttgaggtccagacggtaaagtataccgggtgacgaagttggatacaagatggcatacggtggatggacatcgtgtgggagagatctttgcaacgggcttcacgaggtgtgcgtgcaagtgccagtgtttgcgaagggaattgtaaagttggagtagtatatggtgctacagtacacgaggtactgtagcgtgcaggtatgcatacatgtacgttgctgtacatgtatgtgtgatcgatacatgcatggtgaagcatgtatgtgtgcatgattggttggccgagcagcaggagagcgcctcggtgggcttcggtggctgttggcggcatgccaagtcggcccaggagaagcaagggcccagctggcagcgagtcggagacggtcacgcgtggacgtcagcttgggagcgaatccgttttggatttctggtgcggccggttgtttgctgcacgtttggaaattgtaaaacgtatggaaactgaaggatggagtcctattgtgtataagagttctacacctattttgagtaggggtttttgtggtataaatagagagggagcgtgaggcttcctgtatcgctttagagagcaatagagttgagttttggtttagggtttcgagtttagtcgaaatttttgtaaggagt

SEQ ID NO: 54808 - DNA, 491 bp, Oryza sativa
tgtttaatctagggtgaacaaggtaataataacaataacaataataataaggtcataacaaaggtagataggcatggctagataaaacagtgataacgcgggaatttaaataaagcgataatgcaataatttaaagcaacataattttataaactgggattcaatatgttcaaagatgatgtgacttgccttgctcgctttcccaaaacgccggcttcaacttccacgaaaagcggatcctccgaagctgcagcgtctacacgaccaacggaaaagaaaaggcttttactctaataaactccatataacaagcagaaacaaagcacaaaaatgggttcttgacttcttagggaaaaattagagacttgaacggtccaattccgagttcaaatggccaagttatggccatttgaagtttatatgctctttaaatgaatatttgcgaatttcttcatttaaattttaatttaaaatggattttttgcgtcagc

SEQ ID NO: 54809 - DNA, 217 bp, Oryza sativa
ccaggtactatcgctatctacaattgcacatacgtgtattatccggattttttttcttctccaaaaccaacacaatgcccttagatattagttctccagatccaacaaatttgtgctgctcttgtatagctggatttgggacttcatttgatttggggttgatatgcggttatgttttttaaatttgagtgggaatttttgttttggtttaatcaga

SEQ ID NO: 54810 - DNA, 233 bp, Oryza sativa
gctaaatgaggctggctcggtcggatgtgctactataataatgataaattaattagaataataatgttcatagattgcacatataaatggtataataatttgggcatgcagattttccctgaaaggatttgtctgaaacacaaacaatctataccaacaaatcggttttgatcaatttgaagtactaactccagccgttcactaaaattgttcatctatctaccattaccagc

SEQ ID NO: 54811 - DNA, 680 bp, Oryza sativa
gccagtgtaacggggctggaggacggcagcgggccggtgtagacggcgggggcaaagcggaaagagtggtagttgaaggcggccggtggtggcgccctgccgccggcgacagggaagacgacggacagcttgccgccgtcggcttgaggcaaaggagaggagggggaggggggcctcatcggcgccgttgacacctttcggccagccggcgaggccgggcggcggcgcgctggggcagcggtggcggcggaggcgggggaagcgctaaggagcggcggcgtgaggaatcgggagaggagagaggatttttagggtttggttgtctacacgaatcttaaagcaatcgaatggtctaaaatttctaagatctgtgagggggttttctgtcaaatgatctatagacaggccctataaagtttggtctcaatactggatttgttttatgaggcttagagatgcaaatcactatttctttgattatggatttgacttattataaccttttgattctgtacgttaataaatttcccgaaaattaatatgccgtacagccatagtggtctcctctactgtttttgggtcaaacaagtgttatatgataaacttcttcatttgatttgctgcgggcaacacgtccataatgctataataataataatacaatatgttaacgccgatta

SEQ ID NO: 54812 - DNA, 469 bp, Oryza sativa
tcctgcaccccaaactttttttctcataccttaattttttttgttattatatttttcttctgtttcattatgtttttgcaagtaatttttttactcatgcatgtctatttatattaggtgtcgatactactgtacgcctgtacccaccattctcattctttaatttctcatacgatcctgatttttcggatcgacgatgagacatatgagaggagatcctaatatccctcaactatcgaggcggatcatgggggattgacgccctgttcttcctagccagtggaggagcgttggcggcgacgtctctgacggcatggactcgtcagtgcggtggtgccgatggtcttctccctcgggagtgagattttgtttttctgtttcttttttattttctttttgtattttttacagtaccaaggaggctaccacgatttacgctgatctggcgacagtgcggcggtggcagcca

SEQ ID NO: 54813 - DNA, 1501 bp, Oryza sativa
gtcctcggcgacgacgacgcgtcgccaccgtcggagctccaggccttcgagtaccgtggcgaagtgccggacgacttcttcctcgtcaccaccacgaagcacgggcacggcgtctctctggagacggtcacggtcgcctactgcaagatcgacatctgcggcgacgaggtgacgtcgaggtcggagctcgccatgctcggcgcgttcctccgccgcttcgccggcgtcgagcacctccacctcgcgtccgctcgcctcggctccggcctccacgacgccgccgcgttcgcgactctcccggacctgtcgaccctccgccgcctcgagttaggaggatgcctccccgacgacgacgacgacgacggcaccatcttcgccgcactgatcaggctcctcgacctcgcgccaaacctggaggcgttgtcgctcgtcttccacccagagcctctcgacgacggcgacgacgacgacggctaccgcgcatactgttaccacaaggaggaggagctccatgacaagcacctcctcagatacaaccggcacagcgtcctcgccgcgccgacgagcggcgccgccatggtggcgccggcctgcctgaggaggcgggtgagggagatcaacctggtgcactaccagggcggcacggtgcagagggcgctggccatgtacctgctccggagcgcggcggtgatccgtgagctgaggtgcgagctcgccatggggcccttgtggatccaggacgagctggtgcgagagatcaagggctgggtgatgaacaaggcggcagttatcaacttcggatgatatgcttgcatgcgcaatcgtgcatgaaaataatcttaagtaatcatttttttagtggagtaccagtaccagtattagattgtgcgaaaaattagagcaagaataatattgagctctaagaaggctgaatactgaggtggatgagagagaagaggagagagatgagaagcaagccgtaagtttacagccggcttaggcacaatcaccaagaaaatttacgagatagataggtggaccatatgtttatagtgaagagctaactagtatataagtgagctgagagataggtataaagatctatacaaccagcagctggctatattattacccttgctcttatcaaacatatctagattgtattttgactgatctaaatggctgagttcttttttgaagtttccaactcaacctctctttttccgtgtactgctttccaaactaccctccatctcataatataagggattttgagtttttgtttgcactgtttgactactcgtcttattcaaaaaattttggaattattatttatttttttgacttactttattatccaaagtattttaagcacaacttttcttttttttatatttgcacaaattttttcaataagacgagaggtcaaacaatataagcaaaaaactcgaaatcccttatattataggacggagggagtactaaacattcatttttaaat

SEQ ID NO: 54814 - DNA, 1501 bp, Oryza sativa
gtggaatatatttatctccttttaaagaagcaccttgtttctatatttcatatccatacctttaaaaacatcacgttgtattttgctccatcgtttgcccgttagcttatgagtcaaagcaaaatttgaatttttagacttaattctagagttaattttgaggcatttttttattatagtttagttttcagcattggtttttaaaattgccaagagcacatatatacaaattttatacataaatcaatttttgttgcttcattctattttacaacttaatggcagagcaaacgatgaaaataatttatatcgtgtgctctagaaatgttgttttcactatatcatggatcagtttaggtagacgtgtagatatccttactccgtaataaaacgagccaacaatgctagcttagagccgttaattattgttacaagtaaatgcaaccttaatctatatatgcttatctgacttcaaaagaagtactccaaccatgtaaccaaaatccaaccgtgttataagtcgatttaattattctctagctacttactaaagtttgatatactcttatatagagaaaattagcaacatctacaatacaaaattagttttattctaacattcaatacattttgataatacgttttaaacattagtatataattctaaaaaataaattaaagcaatgtcgagtggaaaatacaacttttatcactgtgatgcaatcctatatacgactacctttatatactactctattcatttcaggttacaagacgtttttactttggtcaaaatcaaactctttcaagtttaactaaatttatagatacatatagtaatatttataatactaaattagtttgattcaatcaataattgaatatatattcataataaatttgtcttgagttgaaaatgttattatttttttacaaacttggttaaacctgaagcagtttaactttgataaaagtaaaaacgtcttataatctagattagagggactagcaccagtagtcggcaaacacattgcaactatttgaccagagtcaagtcaaacaaagcatagcacactcctccttaatacaccctacatacacaaaaccatactactactactagtaggagtctccaccgttctgaaaaaagaaaaagaaaaaaaaaacctccatctcccgcccagtgccgccgcgccacgtcacccctcccccgccgcgcgtgtgtgtacgcgtagcctttccggcggagacgcagcacaaaaatggttttacttgcgatacccttcgtctccctcacgtcccatccatccctccccccccttttccctctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagta

SEQ ID NO: 54815 - DNA, 1501 bp, Oryza sativa
aatatgcattatgatcgccacttactaccatttgccgactaggcgactacactctctgtttctcttctcaatttccttctcttttcttccccatataacgcatgcaagtatttttttctgaaagaaaaaaaaatcaatctttctttttaaacttcgcgggcggtagaacgtccaccgatccacgacgccctgcaaagcgtgtgctccgctgcctcgtgatacggatagcccatgctactaaacaacattcgtcctctccttaagagtgttgcaatacatacgacttacacgactagagatatgcaaccatagattaaaaaaaaacatgttaatatgcaaaatactccctccgtttcataaaaaacgaatctaataccggatgtgacatattatggtactacgaatatgtccagattcatagtattatgatgtgtcacatccggtaggttggttttttatgggacggagggagtagccatttacaaccgttattcagaccctgtttagatgggactaaaacttttaagtccctatcacatcggatgtttggaaattaattataaatattaaacgtagactattaataaaacccatccataatcttggactaattcgcgagacgaatctattgagcctaattaatccatgattagcctgtgtgatgttacagtaaacattctctaattatggattaattaggcttaaaaaaattgtctcgcgaattaactttcatttatgtaattagttttgtaagtagttatatttaatactctaaattagtatctaaatacagggactaaagttaagtccctggatccaaacaccacgtgagtcgacagttgggtcgtatgtatagccatttcctctccttaatgggctgggcttcctgcttaatgggccggccttgttagtcgatgggtcttctccctcccccgtgactcgacgacggcgaagggaaacccaaccccatccatccctctccttgccgccgccgtcgacccgatctccatcgctggcgacggcgagcatcgcatcgcatcgcatcgcggcggtgcccaagcgaggcaatctccccgtccgtcttccctcccggcctcggatcccggaggaggtctctcctcctcgctaggagcggcggcgggtgccgtcgtcctgctgcttcccttccgcctccggtgagcgcgccctcgaactcgccttaaccttgtcttatcctccactcgatctggaatggaagctaggttcaatctggggagtataatatctgggggttggttcaattcaactgttaggtccacccctgcaggcggcgatggcgttcttccggggcctgaccgcggtttcgaggattcgatcccgcatggtgagtagtggtgatccatcatcgatcgtccatgtcaatttttttgtgcatttgtggtgtggcgctgaaattccgtttgctcgtgttgctgccaggcacaggaggccaccacgcttggtggtgtgagatggctgcaga

SEQ ID NO: 54816 - DNA, 435 bp, Oryza sativa
tggttactgtgagtgccgtttaatacgtagcaccttaagacttatatatatatatatatatatatatatatatatatatatatatatatatatataaaataatgatgatgaagacagtaggactacctttgtccaaaaataacgcaattttacaacgtttatgttcaacgtttgatcgtccgtcttatttgaaaattttgtatgattagtattttttattagatgataaaacatgaataatactttatgcataactaatttttttattttttttaaataagatgaactgtcaaatgttgaacacgaaaactcacaactgcacttaaattaggaggcatgtagtacatatatatgcatatataaatcagttcctacgtgcaacgggcgcaaaatatcccggggtcacagatccgtttccttgtttgtgtaacaagt

SEQ ID NO: 54817 - DNA, 363 bp, Oryza sativa
cccaaggaaacaaaaacatttcccctcaattaattccgaggagccattccgattcacttagttctttcctaaagaagctagcaatctataatcattgaacacctgtggtgttccaatagtaaatggctagtgtgtgaagagtcaacatcaaatcttcaggtggatgtggactccaggggtagcctaccattctccagcttggtagtgacacattttttttctttccctttttgaaaagcaaacttgacacagttttcgttcatggcatgaaaaatggtcctgaactaatctaaaatgtattgtattgtaagttactagcaagaacaatcaatgtttcagggatcttacttcttgccgagcagc

SEQ ID NO: 54818 - DNA, 577 bp, Oryza sativa
aatgattaaagatagttgtggtttgtagagtataaaggatttaaggtggggatttctaccagatcatttgaagtgtgcatctcgatttcctgagtttgttgcctggttaaaacaacaacaattaggcatgacattcatgacttgttccactttgtttattatatactttaagcccacctgtaagatctgcaacaaatgaaagcagtcactatacaacaataattaaattctgtagaacagagataacatatctcagaaaaatatagtattgtagtgccagctaattaagatgagttaattaggatgttgatggtactaataacaacgtacatggtgatgtctaagttgattctctaatgttttcatgaccaaaggctggcagtgttgtattggcaccgaaagttcttgctcttagttttgtaccattcttaggcattccaatatcttgccagttatttatctgcacaaaaggggaaagcatacaagaaaatgcagatagagaacatcaaaacgtgcacttatgctcaagaaaattatcacagaacctcatctactcacagaattagtttcacattta

SEQ ID NO: 54819 - DNA, 1501 bp, Oryza sativa
ttggcatctcatggatcatcaagggctaaaaaaacaatggtttagacaggtttgggatgatcggaagtgtaacacactacttctgtgttcttagctagatgatgatgatgatgatgtttacagagaatttcttgagggttatttgtgtctgctaggggatgagctcttgctctctaagttgcagcttgagttgaactaagtctaacccaattgaacattccccctttctcagtggtattggtcatctttttatatgtcatggggataccacagtgcccatacatgtgtgcacaagtgggacccaacccacaagtggtggtatgcttggccttgtcacatgatagttgggggccgggcactattggccctaaacttgcatttcagtcatgttggtggggcatagagcggcttctctccaccccattaggccagtcccaacccaatgactaggacggtgtccatagcataaataagctgtcatctaggatgtaagatgatgtggcaagtgattaaatgaggaaagagaagaaaaccaggtcttgcatgagacatggttctacacaacatccaagacatcatgtgagataagtagcattaaatttaagtatggaacattggtgtttgcattgaaagagtagtttcttgatgatgtgaaggtttatagaaaccatatctagtgtcttgggttgggactggtcttactccttccttcgacgcgtggcttagggtaggtgatgtggataccttggtggttgttgggtcagcgcaccagcctcgaaggctaggtggagccgtaccgtggtgtcctagggttggtgtatgtcacctcgcattgaatatgagacttgattgagtcaatgcattgcatctacctcgagcacatagggaaaggtggaagatgtccctaagcatagcccatggggggcaaagcttggggacggatgtgccccgagcacagcccactgggagccgcactcatgggcggacctgccttgagcacaacccacggggagctacacctggggacagatgtgccccgagcacagcccagggcccgggcctaggggcggatgtgcctcgagcacaacccacgaggtgtcgggcctagaggcggatgcgccctgagcacagtccacatggggctgcgcttggggaaaggcgacaaatgtgcctcaagcatagcccatggagggctacacctggtggcgaattttccccaagcacaggtcatgggaggtcgtgttagggagcagtggcaaatacgacccgagtagctggcgattgggaccttggtttctatttctccgacaaacagtaaaatgaattgttttcaattgttcaaggtgttaattgctccaataaaatagttcaagacttcacgggagtaaaatggacctttatcagtatacttgttttgttgatggaggattgccctacattccttcatttgtatctcaaatgtaagttgtttatatctttgtattctctagctctatgtagt

SEQ ID NO: 54820 - DNA, 331 bp, Oryza sativa
tcttaaagttctttaggtttgatcaaatttatagaaaaagttagcaacatctaccacacgaaattcccccaattagtttcacttaatttaaccttaaattttttttggttccaaatttggtttaaaaaatattactatatttttctataatttggcctgaagtttgacttataaaaaagtcaaacgtgataatatgaacagagggagtataactgttagggctaggcaagacctaatagtattttatcttaaagaaagataatttgactttccaacaaactttattccggctatttgcttggtaattaaagttgctactattgcatcgaaa

SEQ ID NO: 54821 - DNA, 681 bp, Oryza sativa
cttgaaagtaatatgcaccaactagttcatacaatatattacctctgttttatattataggtcgttttgattttttttactcaaatctcttcaagtatgatcaagtttatagaaaaatttaatatctataatacaaattgagttttattaaacgtaacattaaatatgttttaataatatgtgtcttatgttaaaaatattgctcaactcaaaaaaggttagttaagaaaaagtcaaaatgacttataatacgaaacatatgtagtatatatattttttgtacgcaatcatgcataagatatactccctccgtcccataatataaaggattttgagtttttggcttgcactgtttgaccactcgttttattcaaaaaaatttgtgcaaatataaaaaacgaaaagttgtgcttaaagtactttggataataaagtaagtcaaaaaaataaataataattccaatatttttaataagacgagtgatcaaacagtacaaacaaaaactcaaaatcccttatattatgggatggagggagtacaaatagtttacccatcgaaattggcaaagattataggaattgtttgtgctttcgttctcaaacacgatgacaattctacggtgtgcatcactgagatagtgaccggagtttaatttgtctcaacatttgcaatattaatta

SEQ ID NO: 54822 - DNA, 1501 bp, Oryza sativa
aaaatttgagttgaaggttttcaaatttgagattaaaagttgaaagttttcaaattttgacttcaaaaaatttaaattttgagttaaaagttttcaaatctgagctgagttggaagtcttaaactatatttgaacaaaatatggttgaacgcggcgaaaagaaaaaatcggtactaattactcccagagctaatcttgttttctaatatggcgtaattaaaaagcgaaagatcaaattaatcacatcgataatgacgttttctaatagggatatacgccataattaccagaagaaaaatcaaaactaatcatggtactagtcacgtttttttctcagactccggttttgaccactgcgctaacgacacgtgtaccaggtggacgtatgcgcgagttcgacatctggcgcgtatgcgctaattagttctttcctcaattattgaaaaccacatcttgttcacatgaaagagttgaaaattttgaaaagactggtagactcaggtcctcaatactgtctcactgtagtctactagtactccctctgtccaaaaaaaaaaacaaaccctggtttccgtgctcaacgtttgaccgtctgtcttatttgaaaaaaatattaaaaaaatttaaaaagacaagtcacgcataaaatattaatcatgttttatcatctaacaacaataaaaatatgaattataaaaaaatttcatataagacggacagtcaaaattggacacggaaactcaaggtttgcctttttttgggacggagggagtagtagtctactgcatgacttggattgtcaggtgagccaacccaaagatgagagttttaggaagctgggcaatttgaattgaggcttccccagacctccaaaaatcttatcctcagggctatgatttacgaagcagctagatatcatttatattactacctccgtcccaaaataagtgcagccgtaggaaccgtgtccgacgtttgaccgttcgtcttatttaaaaaatttatgaaatttttttaaaaaaatagtcacacataaagtactatttatgttttatcatctaataacaataaaaatataaatcataaaaaaattttaaataagacgaatggtcaaaagttgaacatgaacagtgcaaaactgtacttattttgagacggagggagtactatgaaagagagtagtggtgccaccacaacttttgcactattttttaaaaaaattagtccgtgataaaaaaaaatcgcagaacatatagctgctcaaatttccatgctgactggcatgatcaactttttttttggattgctattgtacgtaattccctcatcaatcaactaatactcattggtactataagggcgctggcaaggaggtacccctagcatttcctttcccttttcttttcaaagaggggtcagtactgtcgaagttattacaaaggtaacttatacgatgatatactttactgtttgcttgggccgaatttgggtcataaccaca

SEQ ID NO: 54823 - DNA, 211 bp, Oryza sativa
ttagactctgatcatacaagtagcatatatacattattagcatagttctctcttacaatgttcccttggcattaaataaatacgataccttggaatactcccaggtgaaatgctacaatggtatatccgtgcgcttgccgattccttctataaccatatatatactaggaccatttctggcgtcattgctgggaattcatatttctagtaa

SEQ ID NO: 54824 - DNA, 1501 bp, Oryza sativa
ggcccgggactaaagatccctatctttagtcccggttcaaatacccaggactaaagatcgatctttagtcccggtactaaagatgggagtgggcaatagtttttttttcatttacttactatttaatctctaatttattttctcccaaattaggtgggatgcgtaccatcccaaatacacaaatcaatcatatacactacagattatacatccgaaatcaaaccccaaatcaaagaaacatcccaaatatacaaatcatacacaaatcatgtacatctcagatccatacaatgagattccaaaaaaaaattatacatctcaatccatacaatgaaccacagattcttcatctcaatctacacatggatcacaaattctttgaaaaaaaaaagaaaaaaaaacgaagcaaagccgccggccggctgagccggccgccgcctcccctcctccccggctgccgccgccgccacgcggccctccgcgccggccgccgccgcgctgccctccgccggccgggccgcccaccccctcctgctgcgcacactggatcgagttgggaaggggagttgggaaggataagaagaaaaagagataaggaggaagggaagagataagattagagatggagggagagaggagtgggtgtggatgagaaaagagtggacgaaaaaagaggataagtaatagggattatatagtgtattttgatctttactcccggttcgtaactccaaccgcgactaaagatcctggaggggcctgacaacacctgacagcatgtgaaccgggactaaagatcatcggtaacaccaacctggactaaagatcacgtagtctcgttctacttataaaccgggactaaaaaccatctttagtcccggtttttactgcatccgagactattgtggtttttggtcgaccggacaatgatggtttctccactagtgaatgaagatgagcgaatgggtataagagactgggaaatttaactatttgccactattagatttggcaattatcaaaatgcccttcttatatttgtacatacttttttccctcttaagtggtggttccttaactattcgttacttttgcccacgtggcatgccaacatggcatataggtctaaacgggctccaactcgctccatgtgctgacatggcatgacacctaaaacaaattcggagacctaaatatgtattttgggagttcaagaacctggatgatacactcgcacaagtttaaagaataccgtgtacatcactcaaaatataaattgtcgtcctcctctcccaatcgtacttccccacacaaaaatcaaactgtttcaaaaccaacctaaactataaaaagaaccattattccgacgagaagatttgatagacaagtcgttcgtattgctctaaatcacattgccacgcatggacacgttggtactaaggataaagataagggaaaatgtacgaattacccccccaaccctccgaactatcacgttcga

SEQ ID NO: 54825 - DNA, 232 bp, Oryza sativa
ccacgtgggcgattcaatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtca

SEQ ID NO: 54826 - DNA, 1501 bp, Oryza sativa
cgagatgagccattagtgcatggttaattgagtattaactattttaaattgcaaaaatagattaatatgatttttaaagcaactttcctattaaaaagttttaaaaaacataccatttaatagttcaggaagtgtgcacgtgacaaacgagagagaaatcttctctttcacctgctgccgaacgcagttacaagaggtgcaatttcaactttggtgtgtttggataatgtgaaatgaggggtgggattgagattgggaaataaataaaatgttaggattaaatgggtgagagagaatgaatggttaggatttaagatgggtaggaaatcatttgccttagacatttgccaaacactgccttactggaataagaattttgaagtagaagctctctgtatcgaccgtcggccggccaggataagccatcctagctcaagctgtcaagtgattgggcgaggctagaaggcccagcaaccctgccagtcaactgggccgataaattctgcttagacataattgtgtatctgtgctcaaagtctaaaatagaaagtactcctataatgttttcaagggaagatgcatgcccaaatgaccaaaatgggctgatgaaattcaatgaactagcagtattttaaattcagttttcaagttgtggtgtggcacatccattttaaatcctttttttttacctacctcaccactcaacctttttgccctcaggcctgcaccaggtgtggctgctggcctgctaccccaaatcatgtcttcctttgcttccattgcaatgcaagtcacacacacacacacacacatggcacattgctcattgatcttagctatctccttagccatggcatcattgtatttgcagactcttgcagggtataaaaacccttgtttactctctgcgactgcaccatctccatgacagcttagttagtttctctggtttgctatatagatttagacacagatggcgtgcttatccttgctctccggcgttcatcccctaccactactcctgctcattactctcttaggtactccttcgttctagaataagtttacttttcaaccctccgatttatcataaataaatttatttttagtcattattatattggagtttgtaaaattaggagatggatacattaagagtagataaagcaaaaaataattgtatcaggatttgataaagtgaagatattttagtcttttaggttttaattgatatgtggagaataggaaaattgaacttattgtaaaacggaggaagtagatcacatccatggcttttgtatattaaattagttccattaaaatctacaataaaatatgtctgatttatttgaaactgaaattgctagctatttttataaactctgttaaagagagagaataaaacctacgttcttttaatatgaaatggataccgtaaatcacacccacctacgttctttttcttttggcaaaatttacttttcagcattggtaatttcca

SEQ ID NO: 54827 - DNA, 1501 bp, Oryza sativa
ggactgattggggtcagaaatcaacagtgatgttggtgatcacaactgtttaggccgagcatccgcgaggcgatcgaccgtacgggcaatcagccatgctgttgctggtggttgtcggaatcgctggggaatcgctggatgcggccacacaagcttagcctttgtcttccatccccacttctgcaccactccattcccttccattctgatcctcttattattcctctctctcctcttctattacgtctgtcccataataattgtatttcaaatcctaaaataattatcacaatagagtactaattgttccattaatcacttgtaattcaattttttttcccattttaccctcaaccacccttccactctcagctataagccatttaataagggacatcatagtatttcttcttaaaccttaatatattactaaacaacctagaattacaatttatataggacagaggtagtatctgatacttatggtatggatgtgtgtcaccaccggttagttgtggagccaaaaagatttttatgtccagataaatttcgatataactagtagtgctatttgctatagaaatttcaaaccatcaatttaatcattaacattaaaatttaacggagctttcgtcgatgagcccgagcggctgtccggactagccagacggtgactccgccactaccaccagccgatctgatcgatctgccattaatatttcttttggtacacctcaaaagagaataacaagtattcgttttcatttaaaaggaaaaaaacttggtacaatttttaagaaaaaatcggaaaaaaaatcttacgatcgcacgattaattataagaaacgggaaaagaaaacacgaggaagaaaaaagcactggtcgatctgccattaactcctggagcttttgggttgttggcggatgtggcttcatcttctgctgctgcttcttcttcttcttcagctgcgaagtgcagtggccccacatgcagtagaaggaggaacagtggtacagtactacagtgtagctgtgtagtggctgctgctagctaatctgaatgtcgaaagggaaaaaaaaaagggtcatggcagtagtccacccaacgctatggataggtagactgttgttgttaatggctacttcgaggaggaggaggaagaggacgacgacgatgatgacaactgccagcggctcatccaactagaactgaacgagaactgaactttttagaccggttcgagaacacaaaccagtcatcaattatggcaaaattgcatgaccattctaattatcatcttagttttgagatttcaccttataacctattttattgcaagaactcacccacccaacgttatccagtcgaaattgtttcctttgcgcatatgagaagttaatttgtcggcccactttaacgctcggtcgctccgccttcgggggcgacgcgggcagcgaaacaggccgcgccgctcccgaccccctcctcccctcccccacc

SEQ ID NO: 54828 - DNA, 905 bp, Oryza sativa
attaaggaatatgtgacccaatggataatacaaaactatccagctgctatgtaatttctttgctgagatgtttgaataattactatgcattcaagctaaatagtttaagaatgaaacatgcactttagatattatttaaataattgatatgctttggttcgaacttgtaataaagtagttcaaaaagatgtttgattgtttcaaggaattcttttagcatatagctttgccctttttactacttctatccgtattattcttgtggccaagttaactgtggaagaatctgtagtgttcttgtgacaaagccataagttaaaaaaatttgatctgtgtgcaatattatttttctcaatatgaaaagaagcggcacaaaatactctaaagagaaagatgattcgttgaagcaaccaaacggctagccactaattcttgccatagaaagcacaccaaccaaacaaagggtatatggcaagcctggcaagctggcaacgagttggcttgcccttacccagctaggctagctgggcaatggaaccaaacagaccccaagtattaccaggcatgtagcctagtggttgcagtgacctgagtaacaccctaaggtcctgagttcaaatcttcataggagcgaatttcagattgggttaattgagggctaagttcctaatttaaaaaaggctgcatatatccagttggatgcagaggccgggtaaaaaaatacccttctctttaaaaaaaagatttgaaagacaatttatataaacagggtattcttagcaatggaaaaatgatcgttgtgaagaagctcctcaagatacacattgaaagatgataaatttcagaaggaggttacattccttctctataaaaaaaagatttgaaagacaatttatataaacagg

SEQ ID NO: 54829 - DNA, 1501 bp, Oryza sativa
ttaacaggtacgtcacttaccactgaaaaaataattatccgtaaatacaaacatccacataagtctaggagtaagcagccaacacaaagtaccttaccagctacgctcagttcgcttattttagctacccttggtcctgcaggtctcaccgtctcagagctcttggctcggatgctgcatggagttagcttgacataaaaataggtggccatatatacatatactagatagattatgatgagcatgttttccaaagttttaaatggtttgatttttcagaagttctatatataagttacgtttcatagaatagtattttaattataacaacctttttaaacagcaatagttaatttattcgttttttcctctaaaatattaccacaaaatcagataaccataatccattcattcattaagataaaaatgaactggaacacatctcggtcatgactcatgatatgtgtcagttcgaccttcatagggatggactgaatccctgccctgaagaaaatgctgcctgcaagaagacaggtatttcacaggaacagtgataattctccaatatgtacaggccctaacaaaactcaggtgtcattaccatgttagattagaacttcagcttgggcgagctaacaaaagggccaagatgttaaccctttgatttgaagtgactaggttcagagtgcatgttagattactgttttttctgaaatgactagttcagattgcagtttgtggtttcagctttggtggattgattatttaggcttaactaaatgggaaaaaaaatccatgctgcataaatttgttcaactttgtttgtgccatccaaacaacacatctttttcagctatggttactgggctgacaatttcatctcttggctacatcaaattgtgtgaaattgagttgggcttggatctcacctcagcccattaaataagtttcaattttcaagtcttctcaggcaccccgcttgttacctgttgggccataatttgaggcctacacaaagatgacctcttaaaactttgtagctatttatttattttttcttgtctaatttgtagtacttgatcattgaacaagttatataaggaaataagtctcaaattcttttttgaaggaaatattccctagtgaaattgtctcaaactctttccaggtcagcatcccagcttccaattctgctgaagagtttatctattctttttcacaactaggacatttgttgattggactttttgcaagtaaagatatctccaaaatatgtagattttacatcctgcctgttctaaaaaggttgtttcagcaggtgaaaaatttctactttcctttgtcaaggaaaataaaatgtgacattgagtctgaaaacattagcttgcataattgcttagaagttaaacaaaatgagtggccatgatcagacaagcatggaagcagtaattctacagagttagtattgtccctttcctttgtcttttcagaagaagcagag

SEQ ID NO: 54830 - DNA, 1501 bp, Oryza sativa
tcacataacgtgcatgtcacgctacttggacttgtgtcgctgacgtggggatcctaggaaataagggtggtttcttggatttggtggagtcactttggccctcaagaaattggggtagacccctatttatcttttaggactgtaaaatagggctatttatggagattcttagagttgccaaatcacatatactctctctctctccatgatgtcaagaaactaataggaaataggtaaggggtccataatgattccataaagccacagggcaggcaccgaaatggggcttatattagcagggactaagaaataaacgttgtctactgaaattggatactgaaattggatgcctcttagaggtcttaggaaatagggacggccctcatttagtatttggggctacaaaatactagtgactattgctgaatatgctcatattattatatcgctctctcttttcaccatcatctcaagaaactagtaggagctagataacggatcataaatgatgaattcataaatccacaaaaggcaggcaccgaaatggagcctatatggctatatattactgcccatggctcaccatcacaatcaccagccagtcaggcacagtcatcagccgtgtagatgaaatggagagtatgcaaatcaccagtcgccctcatagatcacacccatgtctcatctcatcctcatcatcttgcagatgcaaatgtatctagcatcgatcctagctagctaattaacctaatcttcctccccaatgaacttgcacacactgcagtagcatcagtgatcagtgatcgatcagcttctgctgggcccctgcatatgtctgtctttgaggtagccaacgcggttacacttttactagcaccaacaacccaagaacgaactgcgaccggatgcttcgtttcagtgctagctattagcttcactcgatcgtcgtccagccagctgtggctagctcactctcacttgatcatcaggagtcaatattactcaaccttcagttcagcgtgtgcaggtaggtagggtcgatcagcctagctataacgatgtggcatgcattattaggcctcgtttagttcccaaaacaaacatttttcacccatcacatcgagtgtttggacatatacatgaaatattaaatgtggaaaaaaaataattacacagtttgcgtgtaaattgtaagtttgcgtgtaaattgtaagatgaatcttttaagcttaattgtgccatgatttgacaatatggtgctacagtaaatgtttgctaatgatagattaattaggcttaataaattttaattttataacggaatctgtaatttgttttgttattaaataatatattttatacttcaaattccgatgtgataccccaaaacaaaaacttttgggaactaaaccgggccttattcatcggtgatcgatgcaatgcaagatctctagcttgatcacccccactacccaactaataatgcatttcgatttgatgg

SEQ ID NO: 54831 - DNA, 1501 bp, Oryza sativa
ttgttcgatcggagcaagtgcaagcacaccatattgcggactctagcgacgactagcgtcactagcctctccgaggtgtgcatatgcaccatacgactgcctgggcaaagaagataagattgatatgatatacacgacataagaaataattaagtagtactaaccacatgcattgtcgctttcgaaaaggctttgcgggagatcgacgagtgattgatgccgcctgggttagttcaactattgctgcatcgcaccgtcgactagtcccgtcccgtcgcgccgttgccttggaggacgatgacctgcaattccgccgcacgatgttgccgatcggtcgacaccgccgccgcgccgcgcgtgcaggtcgccacgccgatggatcacgccgtcacctgcaacgcagccatggatcgacgatgaatctcgctgctgtcgcggaatcgacgatgaatcgccgccgccttctccgagttctggtatatcgcggtctctcccagtgacctgattttcgtatccgatgcactggtgggaccgaggaattatgcgagctcatgtcattccggtttctgtgattaaggggtacgtaattttttttctagttaaaaagttaaacgggtccgctcgttaatccgatatcaggatccatcgaagctaatcacagatcgacggtggataagagcaggtgtacatacttccaggtgtatacttccaggtgtatagaaccattttcatatatatatatatatatatatatatatatatatatatatatatatatatatatatatatatataaagtttggtaagatagatgaaataaccttgtccttgaagatatcccttcagtgctctcataatcaagtagtgtaatgtctttcacttagtttgccattgtactaattcataggatgcaacagcatggttggacgtgttcatctcttgattatgaatattttgtccatgtgctccaaagcgttaagcattggtacgaaatttttcgttgttttttttttcttgtgttggattgggtttgtgctacattgggttttgtgatctatgggcctgtacacatcagtttatggctttgtgctatcacaaatggttagatgggtttcagcttatccaatttcctggtaaaacagcttctactcttattggcaaatgttgctttaatatagtgtatgtatggtggcctctcacagtcacaacatagtacggctaccaaatatcaaatgagtgtggaattggggaaaagaagaaagagacaggtggtgcaatgactaaagcaagaagaaaattagacaaccaactgcattatcagacaatttttcttgctttgtggggtctaaaatagtactgaacgaacttgatttctttgagagagactgcagcattttgagtgcttttttatataattacaaatgcaaatatatatcacacacacaaacacacttgcctcctgtttattgcatccagaaatgaaagtaaaaaaaaatattag

SEQ ID NO: 54832 - DNA, 1501 bp, Oryza sativa
gttctaaagtcgtacgttcgtaacagagctaaacccgaggggagcatcattgaaggttacacgaccaaggaggctattgagttctgtgtcaattacatgttcgatgccgatcctatcggagttccagcgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatgattcaagaatcgtgtgacaatgtccacggatgtcccaaatgagatagtacagttgttggggatgggaccgtcttggaccatagacacatggcaaggatacgatataaatggatacacattttataccgtcaaacaagatgacaaaagcacagtgcaaaacagcggcgtccgtatagatgcattccaggatcaagttgggtcaaacacatactacggccgcattgaggagatctgggagctaaactacgtcaagttcacggttcctttgttccgctgccgttaggtgaatctacgcactggtgtcaaagccgacaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgccgtcgatgaagaagaatacaaccataatcttcatgtaagacctcacattgaccttgacgatgatccccaagagcctgtggcatatgctcgttcagatcataccgaaggcataaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttaaccatatttcaatttgaaatcatttagtatttacaaatgctattaattagatttgtcatattgtcgaaatcaatttcaagctgttgggaaaaaaattatatagaataatgaccaaaataaaattattagatcttgaaaggctctacaactttgttgttgaccatatttccatttgaaatcttttactatccgaaaatgtattatgactaataaaatgaattattacacagttgctatatattttacactcacaacaaatgaaagatggaaaatgagtcatcggtgacgggctccatactaaagcccgattgagatgactcatcactctaatataactagggtttctcagatcggatcgaaaatttttctaagtcccgctacagtttcccgcctccttaga

SEQ ID NO: 54833 - DNA, 1078 bp, Oryza sativa
tttttttcaaacttccaacttttccatcacatcaaacctttcctacacatataaacttcaaacttttccatcacatcgccaatttcaaccaaacttccaatttttgcgtgaactaaacacaccctaacctcaatagcatatgtatgcaacttttgtagtactaacaggcaagcaagatgccaaagcaaatggaccatcaccagcggatggaaaggcaagcatcagattggctaacaggcaaatggaccaccagtatttcccccaatacactgctagctagtactaccagcctaccactatcacaatcccagcaaagaaaaatggcagccgtttcactggaaatagctgttggcacatcagtgcctggccagccagcagcctgctctgccctgcctgcctctactcatgaatgatactagtagctcccccaattcatacgaacaaacaaacatccatccaaccaggcaaaagaagcagcagagaagcaaaccaataaagaaagaaacggcagctgggagggcattgaagagggcccctggcagcagttggggtagctttaagacccccccttttaacaaccttatttgagaagagaaaggcagctggtgatagctaagctactccttagatagaaaaagcagcagaggacatttcatatctcatctcacctattgccagtacatgcaccagtcccaaaacgacattgagccaaaagatggcacacagaaatcacccaaaggccaacccccatctccactctcgaagtggcagccatgcatggcaacagtgcagggcgccactctagtggccagaggcagcacaagtgagggaggaggtgaaagagacaaggcacaataggggtgatcagaaactatgacagagtacagtggaacagtgaccactgggaagctatctccactgtcagcaatggaggcaggcggaggaatagttgctggatagcaagaaaagggcaaagcttcgctccactagacactggtgcgagtgggccccagctttagtgcccactgttcaaattacaactctgtaaaaatacagtagggagggccaatcactttta

SEQ ID NO: 54834 - DNA, 1192 bp, Oryza sativa
tcctcttaagggtccgcacgcaaaaatgggaggatgataagaggaccgcacgcgaaaatcgattttcacgtgcggtcctcttaagggtccgcacgcaaaaatgggaggatgatttttccagacgcggtcatttatggaccgtctggaatctaacgaggggctcgtacaggaaattcgttttttagtagtgtttcttcaatccaggatggaaatttcgggatctatacatcatatttggaacaactctattactatagcactaaaagcatgaagattatgaacatggacattgtatagttctccatcccaatttataatgcaactaaaagcatgaagattctgaactggataattatgacatagttaaatttgaaaataatgcaacttaatacttgcatagtgtcagtagtgtctgcctaagaaatgtgtctcgtcataatatgaatacatgaaatatgtttacttcctcatttctctttatttgtaagataaaggactagatacatggaaagtaggatagcaaagagtatggccaaactctaatcattgctttattttttgggatggacccaaaatttgtttctcctttacttctttccctttatagcaatgttcgttacttccaattcttgttaacaaaactccaaatacatgccaaactgcatatgtatgtatgctattaaagtacatttacaaatatccaagtttaccttctcaatcattcacatatggcaatgactcatactcttaattgttatctgtgtaagttgtgacttgtgtaacacattctacaagtcccatacaaattcagttctaaaagattctttacctagctcataatttacaaaactgctaacttaactttgcaaaatgccaaagcaatctggcacagccttatcaacatattttctttccatgcaccaaagcattggcaaaactatctttgtttagatattccaaagtattggttggataaatgtccaaataattctcatgtttcatgatttctagcttatgtggcctccactaggtggttttgcaaaggccaatttttttccaagcttacacagctatagctactagcatgtataaataggcccctaggcaaaggcaaccatcattccatcaccctcaacaatattgtctacaccatctaggatcttgtttaacactagtactgtagaatcagcaa

SEQ ID NO: 54835 - DNA, 1213 bp, Oryza sativa
tacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggacccagggtcgggttgccagttcggtctgaatcatgtaggccttgggttaaggcaggttcatgcgggttcacgaccttgattaataatactgtgtagctctaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtagagtcttggcttacacccgagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacattcgcgcaggcaagtgacgtaattatatatatgattgttatatttgtaatgcaattaagactattagatttaataaacgacacttagacttagcatatatcactatttgagttttagtataagattattagatttgtaattagacttagcatataagattgtgtagggttctaatatacgacagttacacttagcatacatgactatttgagttttagtataagattatttgagttttaatataagattataatatttgtaattagacttagtatataattattgactagctagggtcctataatatacgtcacctagacttagcatttatcactatttgagttttagtataagattattagatttgtaattagacttactatataatttattgattagctagggtcctataatatacgtcacctagacttagcatatgattgttagcatataagattgttaaaacataaatgtctcatgacttagcagatgtttcctgtatgaacaga

SEQ ID NO: 54836 - DNA, 655 bp, Oryza sativa
gtagctcacgtgcctcggcgccgccgccgcgccgtcgccgccggcgacggcgaggtctgccagcggcacggacaccttgccgacgagcttgctcccgagcagcggcacctgcgccttcacctcgaactgcagcataccatccgcggcggcggggaggtcgaaggcgaagacggcggcgtcccagtccgggttctccccgccgtcggggtcgccgctcgtcttctcccggcggccggcgagcgacacggcggcgtagagcggcggcttctggaaggggacgaacgccttgacgcccctgcaggagatggacctgatggtgacccgccggccgccgccgccgccgccggcggtcgacatggcctccgagaaaaatctttcttggaaagaattgggattttgagcttggagatggatcgatttgtggctgatgggatcttggtggctaaagatttgaccttgtgctcttttgtttatttggatgatattggatctaggtgcaatcaatcaattggggagcagatagtatatgctgttactgtgttctttggctgcctgatttttaactgttcctaatatttttttttactttcatttctggatgcaataaacaggaggcaagtgtgtttgtgtgtgtgatatatatttgcatttgtaa

SEQ ID NO: 54837 - DNA, 1501 bp, Oryza sativa; identical to SEQ ID NO: 54831

SEQ ID NO: 54838 - DNA, 1190 bp, Oryza sativa
tatgatttttggcaatttaattagggccacatataccaaccaaaaaccatcgtaccaagagatctgataacaatgggacacaagaggtctatccaactgtggcatcaacaggccaacagccatgcttcccataagtgaaaaatgtatgacgagtcgtgttccttccctgaacgctttcacaacacatttgcagacagtagcaatataaagaagattcaattatatacaaagtacctaataattgattcaatctacctatttttcttctttgccgctagtcatatggaccatgtatagtgtgttccccacttgtttgagctttgtcttataagccgcggccactgttgaactttaaaattactagctgaatgactgtgcttaatttgcttccgatagaaaatatattatagtggtccaaaataaataaaaaatatttctatgaaatatattacccgtcctcatgttgccatagggaatattcacctcaatttaattttttgtgtggttattcgtttatggttgtgttttaatattaagaaattcaaggaataatttgtaaaatttactatggaagtagatgaatggcacattcactttcaccaccaatatcttattttaaagtactacagaaattggagggtttttttcctactcttaattctcaactttggcctgtagaccattaaaaataagaatatgaaagtcactatctccatcagtaaatataagtatttctgacgctgtaaatctaaacgagtgtttgtcttgcttcagaaccatacacccttatatatatattttgaacgactcgcgccaaacagtgcgaagttcataatgatagagtagaaaaaaattacaaaattataaccatgtaaggtcgtaaccaggaaaacgaagaaaaaaattgctaccacccacacaccgacagctctgacacatgaacccaggagaaggctaacaccagaccagccgccatttctccccctaggccctccgacatggtcattttgtataagctagggcgccaacacaagagaaccaagatctagagcgagcttgcaccagttgtttgggaggtttcggccaggggttgcctagacaacgtctccagggagaggagcgacagaaacaccgccgcggccgtccgtcatggagactgcgctttcacccgacaaactccttagaggcga

SEQ ID NO: 54839 - DNA, 1458 bp, Oryza sativa
aaccacaatttgttttagcacaaacaactagtgtgtcatgataaatgcatgatcttgtttatttgaaaaatgagatggccgattggccattaggtccaacaataagtctccattaatttgagaaataaaatgaggtaaaatcgtcatcacctcgaggtcatctatctcaatggtaaaaatgagaaactgaattatactataaaacatttcgtacaatagattacagactacacaaattcttttttccgtttcacttgttgtcagtgatcacctaatttttttcttacttgtcagtcacttaagcttgcacaaatatcactaacttgcataatttagaaaccttacaactttaagtttagaaaattgagggaattttacagcgctgtaaactcttcaaaaaatcacactgtaaaattcttaggcaatcagtgcaaatttaaaacttccaattcgagcatacgagggcattatgtatgaatataggtgctaatctattaccaaccagcatttaagaactcggcacattgcggtggcgacggcggcagcggcagtggcggcgacgacgctgggtggactggctccaaaggagatgacgttgagatgaggatcgacagtgatcgccgccggcgtctcaccttggctccagtttcttcctccgtggtacgtggctctcgttttgagtgtcttttgcaggaaaatcgggatggggacgacgacgatggtgttaatacctcgcatgagattgccgatgaggctgtcatcgaaactaggcagagtgggagagacaatggtggtcacaggcaagcaacaagtgatggtggaggccatggacgaccggctcgatctgatgaagcttcgctagtacaggagttctggagcgaggttggttttccgacgccggcgaaccgctggtgggaaaaacaacccgagcctccctctcgctttcgctctctttcaccgaagcttgctgagaaagacaacgctggcggatggaatttggtgtcttacagtcgatcaggaaaagaattcggtcctgctatacagcgtcgacgtggatggctgattcggccatggaaaggtcctcttccccgtccacgtccggcgacggtagtggtactgggggatttcctgccggcggcgacatcaaaccaagcgacaatggtttcctcagattgcgcattacaaggatcgtcctcagatcacgcgctttcactaggattgtttcaaaattcgaaacaatcttttgtgggccgtgtgatgggcccggtcggcatgcgtccttacggcagatcgagatatgacttgcttcgaccatcgttgacgcaatctgccatctctttcattccatcaacatagccatctcgccctagttacgctgcgatggcggcgactgaccctcctcgccacaaccagcagcggccgctagcaaatcatcctccccagcaacaaatcaataga

SEQ ID NO: 54840 - DNA, 1501 bp, Oryza sativa
ttcttttctctcttctctcttctcttttctctcttctctcttctcttcttcagtgagggaggccagcggccgacgggcggagcagtgatgggcgggcggcgggagagcgcggcggcgggcctgcgaggaagcggagcggcggcgggcaagcgcggtgggggagtggggagagacaaagcgagaccggaggagggagagagagagagaggaggccgactggcaccggcgttatcgcccggttgcgcgacgacgatcctggccaggtcgaggtgcgggtagcggtggagcacggcgcactgtgcacctcatgtcctccctgtcacgctcgtacgcatctcgcgccttctccgccagcgcgcccgccgccaccgccttcgtctcggcgagctcgagcttggccttcacgttccacagctcctctagcaacgcgtccgcctctgcgccggcgtcgcgctcccacgctctcatgtagtaggttgaggcgatgacgtcgcctgttttggcaatgacgagctcgctctcctgcgatggtgtcacgatgccctgcacagctgcgtcaccaccttccactcgccttccgccgtggcggcactatctggcagcaaaccaccagttcgccgcctgcggccgtgctcgccttttgccagccgccccgctatcgcgctcgcccgtcgctgctctgccgctgtcgcctacctgcttcgccttccgctcgcttccgacgaagggaagaagcacgacaaggacgggggttgctctgaccgccgcctcgtagtggtagacagtgtgggtggcggagacgcaggagccggcgggaggcacgacggcgaactcatccgccgcgctccgctcgccgcccgccgccgctccgctgccacacaggcccgccgccgtgctcgcccgccagccgtcggcctccctcgctgaagaagagaagagagaaaagagaagaggagaagaaaaaaaaattacagctgacatatgggtcccacgtacttttttaatttttttgttgattaggatgccacgtcagcgaaaccactcatatatattgccacatgaccttgagtgcacggtttgtataagtttaggggtatacatttctcgctatcaagttgagagtcctccgttgaacttattccaagatcatgtagtaagcaacacaactggttagggaataaacacacgtgaaaaaagagagagtagaagttaggtcatctaattgtcttaaacagtttagcaacgaggacgcacagtctagtagtttgaatagaaattaagactataaccttaaaaactagatttatttggcttttttacagaaaattttatataataatcttgtttttgaaaaaaaaaaatcatctacccatacacagcattacaataagcccatatgcagcagctccgtcgaaaggatgatgacttttcctttacacaagaagagatttttacagcttaacatggagaagaagaaaaaaatccagaaacaaactaaaca

SEQ ID NO: 54841 - DNA, 245 bp, Oryza sativa
ataccttttgtatacctcggactgacccatcatctcctctccaattcaattatctcctcttcttttttttaactaacataatataactattgttttatttataattaaataaataaatcaagataacattagctatatttactataaaaagttaaaatacatcatttgatggtagaccctatcatttgaatggcaactaaataacagccaataattaatcgaacatatgtattatgttatactaa

SEQ ID NO: 54842 - DNA, 1501 bp, Oryza sativa
gatcaattcattgttcccgtcctggcgattaaagcattcacagttaatttacagatcgaatccaactctttccttttcttttgatgaaaagcagaattcaattcaacttgtgaatttgtgatatacgcaaagctcaaatcaatttagcagaattcatcatctacaagtagcgagtcccgggttgggggtacaagctgtacggcgctcccgccgcttcttgatccggcaaccacgccgccggcggggggtagcacggcgcgccgggcggcggcggacgcggcgacatgtacgacggcagcgcacggtccaccgagcgatcgcagcatggcgccgatcttggcagtggtggtggatactgcgatgaggctgactccggcggcggcggtggcgggtaggtgctcgtcggagaggggaaactgggcgccgggtagcctgccggcggtggcgggtagaagttgctcggtggtggcggcgggtagccggcgatgtactgcgacggaggaggcggcggcgggtagctgctgtttggtgcgaagctttgcgtcacgtgaggcggcggcggcggcggcggtggaggaggagggtagctgctcggcggcggcggtgggtacagtgaagctgacggtgtcgcggacagcgatggcagcggcgggtagcttgccatcgccggaggcggatacggcgcacccgacgtcgtcgtcgtcgtcgacgtcggcggtggcgcgcagcaagaggaggagattggagttggatgatccacctgcggctgctggtacgcgccgccgccggtgacggcgaaggtgaagctgagcttgccgttcgccttgccgtcgggggcgcacacctggtagctcacgtgcctcggcgccgccgccgcgccgtcgccgcggcgacggcgaggtctgccagcggcacggacaccttgccgacgagcttgctcccgagcagcggcacctgcgccttcacctcgaactgcagcataccatccgcggcggcggggaggtcgaaggcgaagacggcggcgtcccagtccgggttctccccgccgtcggggtcgccgctcgtcttctcccggcggccggcgagcgacacggcggcgtagagcggcggcttctggaaggggacgaacgccttgacgcccctgcaggagatggacctgatggtgacccgccggccgccgccgccgccgccggcggtcgacatggcctccgagaaaaatctttcttggaaagaattgggattttgagcttggagatggatcgatttgtggctgatgggatcttggtggctaaagatttgaccttgtgctcttttgtttatttggatgatattggatctaggtgcaatcaatcaattggggagcagatagtatatgctgttactgtgttctttggctgcctgatttttaactgttcctaatatttttttttactttcatttctggatgcaataaacaggaggcaagtgtgtttgtgtgtgtgatatatatttgcatttgtaa

SEQ ID NO: 54843 - DNA, 1501 bp, Oryza sativa
caagtgtgaatttgtgctggacgtactatatatgcgccaatggattttcagtacaccctttggtcataatattataagtttaggacaatatttggtccattttttttaaaaaaaaattgataatcaacaataatttgctaattctcaataaaaaagtatgtgtagatttacgtttaaaagtattgtcaaacttattgtatttaaaaatgatggttaaattttcaaagtttaatcaaaccttattctaaataacaaatatttatagccggatggaatatttgggaggaaaagtatactgtggacactaaggctgtgttcttcccccattttcccaacccacctctctcgttttccgcgcgtacgtttttcaaactgctaaatgatgtgatttatgcaaaaactttctatatgaaagttgtaaaaaatcatattaatctatttttttaaaaaaatagttaatacttaattaatcatgcaataatacaagcttcgttttgcgtgccgggaaggaggggttcccaactctttctcccgaacacaccctaggatcctaaccaacaactaagaattattgtaactaaattttgaacatatgatttctgcacggattttatagaacttaatctatttttataaatactatataatattcctaaatagaatagtaaactaacgttatacaatagctataatttggtgggcgcaccactaacgtgtatatttagtgagtgacaagaataggggctaatgaatgggtgcgtcaacagacatatagattttcaatgttaattcgtaaaacataataacaatggctaggctaacttgtggttgacaatatttgataggttgtccaatggtatcgattattatgtatgattttttacattgcaaaaatcagataaaacacaagttgtaagtaacatttgaatattcataaaattttgttgaaaaaaaattaggatttcaaaattttacaatatataacggttttacaaattaggagagctttagataaattttacaatatataacggctttattgaatgcttattcattttttacatatgcctataccggttaactagccagcgccattttctacttcttattaaaacaaaaaatcgcggtgaaaacgatcctaaaaatgcaggtttacctgggagaaataggcaaaggcccagaaaattaaaccctgggccaatatgggccgtccagatcggatccaacggtagcgaagcccaccacaatatctactccccacttctccagcccctctcgctccgggagcaaacggcggcgacgcttcgcctccctctccggccgccgccgccgccgccgcagcccatggcgtcgctgctccgcctccaggccctcgccctgaacctaacggcaccccgccgcctccccttcctccctctccgcgtcacgactgcgacggctccgctcgccggccgcctctccaccgccgccgcctctggcagctcgccggagtcacctgcct

SEQ ID NO: 54844 - DNA, 1501 bp, Oryza sativa; identical to SEQ ID NO: 29024

SEQ ID NO: 54845 - DNA, 1501 bp, Oryza sativa; identical to SEQ ID NO: 54755

SEQ ID NO: 54846 - DNA, 1501 bp, Oryza sativa; identical to SEQ ID NO: 54756

SEQ ID NO: 54847 - DNA, 1501 bp, Oryza sativa
tgagcaggtgcagtgtggggatgcatgagttggtgcagtgtggggagagggggtcacacatccgatccagtaacctccctcttctcatttgcttgcttggtgcctcacgaatcgtcctcatctctactgttgttagccatcatccgtcgccatatgaccaccgtcatcgtcatcaccacccaccatgcaacgtcgatagttgctttcctatcccttctcctcactagcctccggcctctcctcgggacaaacgatagtgcttgagggatgccttggggatgatagatggcctccatcttcttcccgtcggtcgtcgcctccatcttccacgccggtcactaaaactcttcctcaccgatgaccaccgcatttcaagtctctgtcgcccctttttgaccccgcaaaacactggatctagctaatggccaggattggcgccgtcggatccggctcagaggacagtatataaatgttcttgacatgctattctgagttttttttcccaatcatgcaagacatacacatactacacgtctacaccacaagtatacacatgtgaatataccccgttaatacatgctaaaaggactatagatcctaaatctcactaaattattctatatgaatggtgtccaaaaatagcaagctagaggagtagatgacagcccaaggaggcaaagaaagataatcccaaatctcactaaattcttagataggtcattttttcctgaaagcattgaatcataggatcaggatcctatcggattcggattttacaaaagtgcatattttttataaaagatctgtaatacattgcaaaaattaaagcctataacattaatttgttaaatttaattgacctttttactattcacattattttcgatccactttttattaatatatagtacttacatatagaatcatatgattgggatcctaatgagatactacaaccatatgatcccacgagattggtagcatcagcatatgaatacaaatagaataacacgagattaattgtttcggcttgctagctaggatatcttacaatatacgatcggggatcctattaattaacaaccttgctactacttatcactcattttgcctagtagctttcaattgagacagaatcagaaatattcaaaatttcttctcagaagcttgttgttcgatctccaggttaattttcatgaacactatatatcacacagcagaaagtgcagtacggtgataattgatgaaatggtggctttgcgtcgtcgtcagtggtgccacctaactgcatgcgtgcatgtgtgtcggcggtaatcatctgcaggctgcaacaggggcagcaagcaaagctggattcttgggcttcacacgtgcgagcaggcgaagcaatcttggaagcgatctttccatgatagtaagagaaagatccgtggcgacgacgacaccacagctgatcatgcatgcagagccgcaagcatactacctgcagtagttaatgtcg

SEQ ID NO: 54848 - DNA, 1501 bp, Oryza sativa
cttgtactaatcttcaagttttcattgaccaggctggccccctgttgctgtaattctgtcactgcttcagtaaattactgaaacagacaaaggcatctcctctatatcgatgtgattgctgttaggagcaagtttgtaactgtagatgtaactgatgcttgcggttcttgcaaaagaggagtttaactagtagaatatatacagtgttcatatcaaattaatcaatgtctccttgcttcagaaatgcaaggttttctgcctcatccaattaattttctccatacgtttaaatttctttttccattcctgctgattgtgtgatgcctgatgagagaattgcaaatgggattttcttgtgctattttcccaggcatatatgagtggccggttatttccacaggaattcgtcatccgccactagcaaactactattttagattgaacctagtccacttgagcttttattcctttctgtattgttgcccaaaagtcaagatccaaatctgaatttcacggcttgaagtaattacgtccttatcttgcatattgttgcagaccatttagtctcaactcccgagcttttggactgcatatctcagaaatttcaacaattactccctccgttcctatttactactccctgacgccgttgacttttcgatcaacgtttgactgtttgttttattcaaaagttttatgtaaatatgaaaatatttatgtccagcttaaagaatatttgatgacgaatcaagtcacaacgaaataaatgatagttacataaattttttaaataagacgaatggtcaaacgttggataaaaagtcaacggcgtcatacattaaaatatggagatagtactagtcactgttgaccaatatcgttgcaactttgataattaacaagttttttttttgttgaacgaaaattgtggtatggtcatgtttagcatgcaacatgcttggataatatcttatgttttcatatatatacaaatgtgttgcaaaaataagaatggccaaagtttacatatgaccaatgttgatgataattatatgggcatggagagagtaggatactgtataaagtagtaggaaaaaaaacatctccaaatattttctttccagcactgtatccatcctccattttattatcttctcttatttcaacgctgtttccttctctttgtttttttttttttgcggggatgttatgtttatttaattgttccatagagttgactgaaattgcatttttgaagtacaatttgcatcacatctgattaagtgattatctgtcctcttcgtcatatataactctcttgacgaactgaatccaactaatttcacattaaaaattagtatccacttgccaatactgtatttccaggaaaaaaaacaaaagccaataattagaacattttttcaataataataagaaaactagtcaaattcgtactaaaacgtgaacaacctgtattcccgcacacgagctgactttgcat

SEQ ID NO: 54849 - DNA, 1501 bp, Oryza sativa
acttttccctgcgctggctgtggcaaggtccatgagttgagtgattagagctagtagaagccttcccggtaattaatgtatggaacattgtcctttggtttttgtgagtacatggctagaataaacacctgatgtctagctatagaatagatagattagtgtaaaaaatatactaatatattagtgaaaagactaatactctggctaacagcagctacatgcatgcatggaagcacctactagtacttgttggttctgtccctttagcatagtcacatcaactagctatcttctattagtagctgtcatgcatgaaaatttatatattgaggctgtgtttagttcgtgtgctaattttttttttaaatttacgaacacacatttgaagtattaaacatagactaataacaaaacaaattacagattccgcctgtaaactgcgagacgaatttattaagcctaattaatccatcattagcaaatgtttactgtagcatcacattgtcaaatcatggcgtaattaggctcaaaagatatcgcaatttacagtcggactgtgcaattgatttttttcgtccacatttgatgttccatacatgtgtccaaatatttgatgtgacagaaaagttagaagtttgaagaaaaaagttggaatctaaacacggcctaattaatatcaaagatttgcatatttggctaggcgaaacgcacgggtagaacgatagaaaactaggcaagactacgcccatcaactattttacttaatcatctctaactaaatttgcttaccattattacattgagatggtgatactaacaatctaacagtaaatattattaatacacgaataatggattgatgattttatcagtgagaataataacgtgatagtgatacttagcctgagacggccgatacctgaaacaacgatatcgagtcggctgatatcagtgtgagatgaggaatgcctcacacaactagggaattcagcggcgtgattctcagattagggtatcactaattgggggagaaaatggattgaaggaacgatattatgacgattattttaatacctctgcagtgtatttttaactcatttactatgttaaatgtcttctattatttatcggttgttaatatctaagggtagtagtattttctgtctttaaaaacatctatatagctatatgtactaatcttgctgagtatgtgtaatatactcatatatttactatttgatgtgcgcagaaactagtcaagacgagatgtccgagggaaatgatgacatgcaaacctaatggggagcgtggtctacttagtctttagaagcatacaagaggacataccatcatgctaggtatagggtatcgtcttggtaataataagttggtaagcgaatcaaccgatgtattatgcaatgtagctggtgaaaaataaatggaaccattgttgaaagtgtccaagctctagttgtgatagttagatattacatcttgcctt

SEQ ID NO: 54850 - DNA, 1501 bp, Oryza sativa
  unsure (1)..(1501): unsure at all n locations
gatcaattcattgttcccgtcctggcgattaaagcattcacagttaatttacagatcgaatccaactctttccttttcttttgatgaaaagcagaattcaattcaacttgtgaatttgtgatatacgcaaagctcaaatcaatttagcagaattcatcatctacaagtagcgagtcccgggttgggggtacaagctgtacggcgctcccgccgcttcttgatccggcaaccacgccgccggcggggggtagcacggcgcgccgggcggcggcggacgcggcgacatgtacgacggcagcgcacggtccaccgagcgatcgcagcatggcgccgatcttggcagtggtggtggatactgcgatgaggctgactccggcggcggcggtggcgggtaggtgctcgtcggagaggggaaactgggcgccgggtagcctgccggcggtggcgggtagaagttgctcggtggtggcggcgggtagccggcgatgtactgcgacggaggaggcggcggcgggtagctgctgtttggtgcgaagctttgcgtcacgtgaggcggcggcggcggcggcggtggaggaggagggtagctgctcggcggcggcggtgggtacagtgaagctgacggtgtcgcggacagcgatggcagcggcgggtagcttgccatcgccggaggcggatacggcgcacccgacgtcgtcgtcgtcgtcgacgtcggcggtggcgcgcagcaagaggaggagattggagttggatgatccacctgcggctgctggtacgcgccgccgccggtgacggcgaaggtgaagctgagcttgccgttcgccttgccgtcgggggcgcacacctggtagctcacgtgcctcggcgccgccgccgcgccgtcgccgccggcgacggcgaggtctgccagcggcancggacatccttgccgacgagcttgctcccgagcagcgccctgcgccttcacctcgaactgcagcataccatccgcggcggcggggaggtcgaaggcgaagacggcggcgtcccagtccgggttctccccgccgtcggggtcgccgctcgtcttccccggcggccggcgagcgacacggcggcgtagagcggcggcttctggaaggggacgaacgccttgacgcccctgcaggagatggacctgatggtgacccgccggccgccgccgccgccgccggcggtcgacatggcctccgagaaaaatctttcttggaaagaattgggattttgagcttggagatggatcgatttgtggctgatgggatcttggtggctaaagatttgaccttgtgctcttttgtttatttggatgatattggatctaggtgcaatcaatcaattggggagcagatagtatatgctgttactgtgttctttggctgcctgatttttaactgttcctaatatttttttttactttcatttctggatgcaataaacaggaggcaagtgtgtttgtgtgtgtgatatatatttgcatttgtaa

SEQ ID NO: 54851 - DNA, 1501 bp, Oryza sativa; identical to SEQ ID NO: 54840

SEQ ID NO: 54852 - DNA, 1224 bp, Oryza sativa
catttaacccaatcactgctcaacgctacaccacgttgagactggcccaaaccaccacctgaactaatcagttccattatgctaagctaggggtgagactaatcacagtgaatctggttgatcgcccataaccacgagcacggctattcgaatagttttactctgatcagaggtatacaactatacccacaagacacagccccacgacacattcccgtgagccgacatgccatcacgacataccaaaaagaggccgtgacaggacccttcgcataacccctctaaccaagcacaccacacctcaagtttcacccccactcctcaaaaggcaatgggcacctctcatgcctaggtgaatccagaagcgacaaaggccatcgcagggcctattccgctccatcacgcccacccttacctggatgtgtcggctagaggaaagctacactacaactccagccgttgcccaccctgcttgtggtaagtacgataagttcttccagggcatcctgcgaaccggtccttaatcgccatgggcacgaccagcaaaaccatgcacccacagcccaccatttagtgtattttaattaaccaacaccattgcggtggtactaaaccaaagtcatgctagattccaaagtctatgtatagtgtgtttccccctttgtgtactagttgaactaagcatagctatgcaattcctaatccaacatatagccatgttacaacctaagctagcaaaggaataagatgaacaaatagtatggctgataatagtaggtaaacatctcatctagtaacattataaaacaatgcataattttaaagaaaacatagagcatttgcaatataggatcaatatgttcaagtaacaagcatgacttgccttgctctgcggctagagggacctcggcgactatttcaaagtacaccgaagcgtcgggagagccagaatctacgcgacatacaaggcaaacaatgcaaacatgctataagactactaaaacagagaacaaaacattttttaatggattctttgcatttttcttgatttactgagacttgaatgggcttaaacggagcacagtggaccgagtccacgggactggggagaggagcaccatgtgacgctgacgtggcgccgaggtggcgcacacgctggcggccaagtgggcggaggcggctcgcagccggcgcgcacgggcggcttaagccggcccggcgcca

SEQ ID NO: 54853 - DNA, 1017 bp, Oryza sativa
cccagcagaaaacgcagggatagtggaagggaagaaaagcaaaaaaaaagagagaaaggaagaagaggttaaactagtgagggggaacacaaaaaaaaacctccatcaagtaaatttcccccaagttcttcccgttctttcctcaacacacgttgttcttcagaggaagggggtggtggaaagggaagaaaagaaaaaaaaatcaaaagatgggaggaagaggtgaaaaggagggaggtgggaacagagagcaaagagaaaaacctccattaagtaaaaatttttcgggttcttcctgtccccccagcacacgttctttctccttcttcgtgttctttctctcctttctcctttttgcttttccaatctgagttttgatctctcctctagtttttcttttggatctgagttttgatctgagtttctatcttggagcacaagacattttttaagggactcagggagtggaccatttttgtgacagaacccaattcggagctaaaaagcccaaaacgggtatcatgtgagagcccatttgttttgttgaaaaaagcccaaatcacagctaaaaaactgaaaatccagactcactgaactacagccaaaaaagactcgggcccacaccttcgctggcccataacttagcccaaaaaactggggcccaaacattgggcttttgttagttttttggacccaaaagtgtgttttaaccaactttgggctttgggctttttgttagtttttgggcccaaacatctgcaccaggttgtgattttttttgcacgtcacattttgattttttgagctttaccgttagatacatatctaatggtgcacaaagttgactgatcaaatgcaaaaattgcaatcgactgcagaataggcggtcccgattagcaaacacaaaggattaatgaacaactaggtcggcttgtgcggttgtgcccgagtgtggaatggcagacgctgcccaggaataacggagatgggatcgatggcccatatacaaaacaagga

SEQ ID NO: 54854 - DNA, 1501 bp, Oryza sativa
ttctaaagtcgtacgttcgtaacagagctaaacccgaggggagcatcattgaaggttacacgaccaaggaggctattgagttctgtgtcaattacatgttcgatgccgatcctatcggagttccagcgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatgattcaagaatcgtgtgacaatgtccacggatgtcccaaatgagatagtacagttgttggggatgggaccgtcttggaccatagacacatggcaaggatacgatataaatggatacacattttataccgtcaaacaagatgacaaaagcacagtgcaaaacagcggcgtccgtatagatgcattccaggatcaagttgggtcaaacacatactacggccgcattgaggagatctgggagctaaactacgtcaagttcacggttcctttgttccgctgccgttaggtgaatctacgcactggtgtcaaagccgacaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgccgtcgatgaagaagaatacaaccataatcttcatgtaagacctcacattgaccttgacgatgatccccaagagcctgtggcatatgctcgttcagatcataccgaaggcataaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttaaccatatttcaatttgaaatcatttagtatttacaaatgctattaattagatttgtcatattgtcgaaatcaatttcaagctgttgggaaaaaaattatatagaataatgaccaaaataaaattattagatcttgaaaggctctacaactttgttgttgaccatatttccatttgaaatcttttactatccgaaaatgtattatgactaataaaatgaattattacacagttgctatatattttacactcacaacaaatgaaagatggaaaatgagtcatcggtgacgggctctacggtaaagcccgattgagatgactcatcactctaatataactagggtttctcagatcggatcgaaaatttttctaagtcccgctacagtttcccgcctccttagaa

SEQ ID NO: 54855 - DNA, 1501 bp, Oryza sativa
gtcagtattatttctgcactgggtgcacatcaatgcaagagagatcgttatatgatttgtacctggaagacttcctgatctttggcacaggacaactggatgttttcttccttggagtagcctgctttggcagtttcttggttgcctctcggtctccaggctttctagcagtatcgctttcgtcgtcacttgacaccaacttccttttgcgtaaatctggctggattggaagtatttggccgggcttcagaacgggtcttgggacccccgctcccttgaccggtttggcggtggggtgatcggcattggacgactggggggtccgatttcatcaaagcaaattcctggtcgtaatatcattcattgttaattgattcaacaaaaagacaagactatattctgtgaaaagttgaaatgtttgattacatatcggtggaggaggattgaaagcattgaatggcatgactagcagcaagtgcgaatagctgacgacgatagcattcgagaagatcttgtacatcctttccttcataatcttaaagttaagagagtctggatcttcacgatttggatcatgtttgccgtcaaactcaaaagctgtgcgggacctctctttgattggagctaatcggctttttatgaagtgccaagtgatctgttctccctgcaaaccttgctctttcagctttatcatgcgctccattagttctacagcctgggctgcctcatctcctgtaggcaatgaattccatgtatcttggtagactggagggagacaagagtactcgggaagggctggtttaggattttgaacatagaaccagttggcgtgccagcctttgtttgaggtcttgaagggcatggagaaatatttttggcttagtgttcccctgagttggaaaccagcacccccaacaacgcacagtttgctcttgtttggctagggtttgaggaagaagatgcggcgaaacaaggcgaaatgaggcctaatgcccagaaaagcttcgcaagcatgaacaaaattggcgatatgcactatggagtttggattcagatgatgcaagctaattccatagaagttcagaattccccggaagaatcttgaggttggaagagaaaatccgccatagaagaagtgagagaataccacaatctcgtgtgtgtcgggggtcgggaatgctttgccgaacgctggtcgccacccgatgatttccttcgtcggaagaacgccgtgcaccaccatttctttcagattctcttccgttacatcggagggagcccactgactctcgaaactttctctctcctccgccatggatgcgagttgcatggttagatttggtccaagatatagctggaggggaatgaggaattggtgcggtggacacgcggagaagtttcgtgggattttttgagaatggattgggacggattgatgaaccctagtttcgacggtgcggtttgctactgtagcaaggagtggggaaatggcgagagtctc

SEQ ID NO: 54856 - DNA, 1501 bp, Oryza sativa
ttctgtaaaagtggtaccattatcgccagatttgaatcctagctatatacatagaatttatatcctctaatttttcatagaaacaatattgtttctggtcgtttataagcattttgatcccaattatagcacacacgcatgaaaatttagtaatatattctatccatccaaaagagttagatatattacttttatcaccatgaccaaaactacatgtaatgtaacaaagatcaaagaacactctcatcggttcaatgttgcagaggcagattttcagcaaaagtccatcggttagcttattgggctgattatgcatcagccattggtagtgggaccaatccttcccgacacctttctacggccacatcgctaggagaccaacctcgattccccactcccctctctcgaaccctacctctcaacgatcaccatgccacagaagatccactaatcagccattactctttataagccaaacgatggaaacgcttataccgataaacatcagtctgcttatgctgaaacgcaacaacataagccaaccgatgaaggtgtaagtgtatataatgcaatcgatgagtattgaatgtgtatttgggttccggtaaatcatttaaatttcagatatatacatgaaaactacaaggtatgacccatttactttgaaaaatcaaaatataaaataattctaagtcttatcggcttgtttggtaactcgagggaaggggattgagagtttacacaagggaatttatgatgagattaagatgggaatttgatttttaatcccagtatcttgtttggttggagtgatggaaactgatagggagtttagttggagattatgtcattaataaaaatggatagttgagatttgcatagacaaagtaaaggaggaattccctcccaatcacctgcccctacccaggtattgaaaaggagggagttccttcctcaattccacatccccatccccatcccaccaaaattctcatgtctcctaaataaacatgtggagattatggataccctatatctacatggcggtcatattctagctgggtacaggataccgaataaagacagaatatcttcatgaggactcgggttagattctaaacttgtatgtcaaggaaatacccgagatcctagtcggttacgattatattttatctgtaattccatgttcttttaggatatggactgtattttgtaaagcggaccccttcccctatataaggaggggtccggatgcttatcggggcacggttttttgacctagattatacaatcaataatacactcggcggaatcatccccggacaggagtagggtattacttcttgaataagaaggcctgaacctgtataaaattcttcgtctccaaacccatccactttcctagcttgatagccacccccttttagtattgccgaaatcttgtttcgacagttggcgcgccaggtaggggtagcgtcaagtttttaccggctaagtgcga

SEQ ID NO: 54857 - DNA, 199 bp, Oryza sativa
tttttctcgacagttcaaacttcactgagaaatgttaattgatcacactaatttctttttcttttctcttatcagttacactgtaaactaataaattatgtatactgaactaagtatgagcatcttgtatgacctgaagtcaatatccgtgggtttatttttcgaatgcgtgaagcggcagcaattttcatcgccccca

SEQ ID NO: 54858 - DNA, 1501 bp, Oryza sativa; identical to SEQ ID NO: 54768

SEQ ID NO: 54859 - DNA, 1501 bp, Oryza sativa; identical to SEQ ID NO: 54855

SEQ ID NO: 54860 - DNA, 1501 bp, Oryza sativa
gtaacagttttttactataccggaaaattcctggaaaggcgatccattcttgtgatgaataaaactaagtttatgatgattattcaacaacataaatgaatgaaggaaatataagaaaattataagctcgtttaaaaatttgtactataagatacactggtgaaggaagtagtaggaggctaggacaaagtatgatcgtcataatccataaactgaaaagtttacgcatacagtggatttgtcatcactattcatgtgaaggatggatattttttctccattttttggaagaaagagggatggggatttcatagtactatgatgttgagcggcgagctaaaagcaggattaaccggtggatttatactgtaccagtgagacaccttttaaaacacttcctgtagcgatacttttttgcctggtaagattacacaaggaacagacaaatgctagtacaagatgcattgatccctaataaaaacaccggattaatttgtgtttccggggacgctctgcaaatgggcacagtgaagatgggtcctactacgtaccaattgctgctaaaggattgcgcgtacttctactgttctgctttcaggttggcagttggcttgatagcgagcaaaccaaaccaaaatcatggccataaatctctctccatgtccatctataaaagagaaagtgatactactatactacacagggtacagacgaagctaggccgctagagatgatgcacaagctgcaaccacacactgattttcagtcgtccaaacggaccatcctattgccaacatgtttctcttgttttggagggtccaaaggtatgcatctagtaacatgtaaggtgttcaatgattcaacgaatatatggacgatgaaatatccaaaccagctgtgcaaactagcgaatgtgatatatggatgcatgctgtctgcaccattagtagtgatatatctttttgggattgcgacaaattaagaaaggaaaacaaaagagctctagatgaatcttgcatatctttgcaagagatatagatgctgccatctaattagaagtaagattgaattaattagttcgcttctagtttgtggcaaaccatgattacgaggctatacgagctagtaattggctattgcctacaaatagacaggattaacttgtaacaaaaggtggtagtacacatcaacttattgatgatgcatacgaatataacatagatatatgttagtagtactaaaaggagcatcatgaatcaaatcaaatagtgctattttgcttcatggaaattcctcttttatacgtgatccaaccttcatcaagcgaaaggtttaattttctctacaccaatcttagcatgtgtttggtttcggaactagatgggatgggatgaaaccatccctgattttggggttgggatgattacactcacatgtttggtttgtaggatgggacaatcctaattttttgtttggttgaagggatgagggagaaatggga

SEQ ID NO: 54861 - DNA, 1501 bp, Oryza sativa
taattaggccggtattgtttacaattaattaaaaaattcgttgcagtttcatttgatgttctgtaggttaggttagttgaccggaccccactcaatttgggctctttgctggctggcattcagaatttcatatgacaagttgcactaaatacagaattgccgttctgattaaattaagaggatctttgcaagaaagttctagaatcaattgatttcttttctcgacagttcaaacttcactgagaaatgttaattgatcacactaatttctttttcttttctcttatcagttacactgtaaactaataaattatgtatactgaactaagtatgagcatcttgtatgacctgaagtcaatatccgtgggtttatttttcgaatgcgtgaagcggcagcaattttcatcgcccccatggcttctgtctgttcttcaatgcttgccatgcaattggagtatactgattacatctacatcgacaagtggttcgtccacatgctggagggctctgaattcctagccatggacgcccgcttgctgcataggaaggttgggatccatatgcttgtccagcctgcaggcaagatgcagtcgcaggtggccacatgaatgacatgtcagttcagaacgttcagatccaaggctttaggtcaggcaggcagaactgctgaattttattatggcacatgatgaattgctgcgtattgccttgctaatgcctggttcaaattgaaatcggtatcaccttatgaaatttactccaagtcaccaagtgtagccccacaaatctactagaactcgttcaaacttcaaactgggttaaattaccatcaaatattctgagcttgttatacaagagagcatctcggtttggctaggtttgccccactggattgaggattgcttgaattgaccatcagatttgtcgatgtttttgtcatctcgaattgcaacagagttataggtgcggaatcctgttgctactacagtttgattagtgccaaggatcaaacattttcctactggccaaaattcgataatttttacggtgcagttgatataacttcttgccaatgccaacttcacatgatttcgctcactagtagtttgtaagtgaattgaagatcacaacgatttacggttaattattatttcagtggtagacgacgtatctatcgatggcgagacgctcgtgatgacttcgtcgatttcaagatataccggttcagtctttaggagatgctcatagaggtaggttgtgcgcgtgttcataagggtgagcgtacgcacgttctatgatctgcgtttgtactgtttgttaaaagacgatttaatccaagatgtggtgctaccaaaaaactcccaaagtaatttctgaaggttaacttgagcctccctgcaaaaaaaagaaagagagaaagctaacttgggctcaaagtatttctaccattagctgggctagttgactggccgggccctctagcccagcaaaatatttcatg

SEQ ID NO: 54862 - DNA, 1501 bp, Oryza sativa
tgtttaatgcaggcttcaaagaaaggctgttgtttttgcaattgattttatttgaactcttttctgaaacaactaagtgagtgcttctcaaacgacacggatgagatagtgcgtctcgtccggtcggagtatgtgcaatgtatcagtcttttgaattgatcaagattggcacccggccaacagctttcaaacggccacccgggcctggctgatcccattagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggggtacactttacccacacgacattactaacccggatcatccagcccgtgcagaacggccacgactagagaccttaaggctttcatgacaaggcatttcgaaagccgacacaggttcaccatatgccaacgagagggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcatgtgttcggatgaaattccaaggaaacggtccttaagtgcaagagcgggaaaccgtacacccgatacgttccccggtccgcgattttggaaattcatttagttcgcaagcaccgactcaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccaccaatctgccttgcagacaggacaagcagattaagtgcgatcctatcaatgcataatatttttcaagcaacataattaagttcaaatataggctcaagatgttcaaaggtggcttgcctcgctcgagatcttgagtttgatcctcgaaatcctcgcactgcgggtcttcgagctccgaaactacacgcgaaacgggacaactcagcaaacggcgaaaataaagccctattattgacctctaagcgtgccattagatagatctcgagatttgagaaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcacggcccgagagaaaggggcggctcggctgagcttaatgggccggccggcccaagaaggcggcccaaggcg

SEQ ID NO: 54863 - DNA, 1501 bp, Oryza sativa
ttccctcaattcatatatcaacctcgccctattccggagttcaagctggtaatcattaattttttcttcgaaaaacctaagtttttctgcataagtgaaaaatcacatttagaacagcagattttaatgaaaaatcacatttagaacagcagattttaatgaaaaatcacatttagaacagcagatcttaaaaaggatatcaacttatatatggtcatcattatcaacatatggaaattgcaatctgactacaagaagcaacataccaacaaaatctttctcaagcacagaaatcttctctactttacccttcaagtcagaaactgaaattgcaacataacacagataagtatctaaagaatgcacattagtgcaataaaaaataaaaagacaatcatttggtaaaacaatagtagaataagatgtttcagccatttgcatacctacattttccttgtcgccaactagacatttcacattaccgagtacttgtttcaccgcagcgacttcctttcctactgaactaaataaagccagatgagcattcagcttttctgaaatcacagcaatctgtttatccttcatctggatagtccattgcagagaacaagcagagtcctgcctatcaaacatggtatcatgagccgataatcagtttgattccacatacaggtaattcataattaatgcaaatgtcagaagcaagaacagggcagaattatatgacagattagacaatgtacaataaagcagactccagatacactctagtcttacaaatgcatagcaattgttaaggaaaaactatgatattaatggcaagtagcctcacataaatatgcaattattacaaagaccaaaagtttagcatggagagaaaacataaaaaatgagttcagctccatataaactactacagaaggaagggggaaaataaaggtaaacacctgcctcgtaatgttttatgaaagcctcctttgattgaagcagtccctccatgttatcttttaactccttttcgtttttctccagctgctcattttcattttcaaggcattttatctgtaaaaaaaggtattgcaatgaacctctgttgaataggtacaaaccaagcactaggggaagaatgaagcatccacggtgtgatgtgacataacatgcatatcaaaaatcaagtgctgcttctacctaatcaaccaagcaccaggactagtcattgttacgattcggtagtaaaagtacaaatctacactatgatagacaactggcccaaacagccccaaatgttggtataatcgccacgaaacacaacatggcaaacaccagcatgatcacaatgtgtttaagttagggactgtaatttagttaggcattaaactgtaacataatccaacacatgagctctacccaaatccatgagacgagaacacaagctacttggcgaaattgagagttgtgaaggggctaagcagaacgaaccctggactcgagccgacggagc

SEQ ID NO: 54864 - DNA, 1501 bp, Oryza sativa
tatgttacaattaatttgtagctaatgtgattttttatttgatataacaaagtttaaataatggaagttctatttgtagtacatatacagaaggtttctcatatatatttactaatgagccttaaaaactaatgctattatcacatgttgttaattcatgcaaatatacaagtaattaacttaataatcagtacattactgtttccgtctggctaatttggaaagcaaagcgcggtctcgcaaatcagacaagcgacagcgctgtcacatcgctcgtgttcggcgcagtggcgagcctgtgctgtgcactatcgcattcccactccgcgagaccgccgtgtggcgctatcgcattcccaccgcgcgagaccgcccggcgctctcgcattaccttcgtgcaagactgcgcgtcccgtcgctgctttcctagacccgcggcacccgctcgctctcgcacttcccaggcgcgagaccgccgccgctctcacgtttcggcgccaggaaactggtagcaacgctgggccccatcgcactcgctaacgcatactgcgagagtgctgacgctctcgttactccaagccgcgagacggccggcacttcgtcctcgcttatctaaacagcgataccgctctcgttctcacgcatcccgcgtgcgacgccgcgctctcgctaaaccaaaccgcgacggtggtatattttcacaaatcttctcatgttcagtactttcttacaaattccacggaaaaaatgtatatttctaaatttttttcagcagacagaagccgctgtcatgcccgtgataaattcatcctgaaataaaaatcattctctaaaagaaataatagaattaattaaaattcgaaaagaaattggcaaacactaaaatacgtacaagaaaaattcgaatgttgtccggagattttttgttaaattcccgtggtctaaaaagagccctcaaattttacttgaattttcagagcaccgaaaatattattaagcaacaaaaacaattatcagagtttactaaaaagaaaacataaaaataaatcctccttcctcctttgggccgagtccgaagtcctcccactctctccgggccgcggccaaaagtcctccctttttccctctctttctctccctctctttctctccctccttctcttgggcttacccttcccctcccggcccattccttcctctcctcctctttgtgggttgcccctcccctccctccttccctctcggcccagccgcccggcccaaaccaggccgagccgagccagccgtgcgcacgcgcgtcgcacgcgcgctgacggcgcgcctgcgtgggccccaccacccgggtcgtcgtcctcctcccgcacagctcctctctctctcccgtgaaccctagtttcttctccctcaaatccgctcgattcaaatgactaattccaaaattgattagggggaattaatcccctttccctcccctctctttcccccttaattacctcttgat

SEQ ID NO: 54865 - DNA, 1501 bp, Oryza sativa; identical to SEQ ID NO: 54856

SEQ ID NO: 54866 - DNA, 1501 bp, Oryza sativa
atacctcatctcaataatcttttgtttggctctccaggcctttgcatagcttatggtgtacttgaatttgttctcgatgtgcctaatagttgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcatcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggcttta

SEQ ID NO: 54867 - DNA, 1501 bp, Oryza sativa
cgaatctgagttgaatgtttttaaatctgagttgaatgttttcaaatctgagttgaatgtcttcaaaatttaactttaaaatttaaatcttaaatcgaaagtttctaacttgaaaaattttcaatctgttagtaaaaatatctccaaaaaaatctttaaaatctttcctaattattgttattagtgttaagtaatgttaactaatactagtataggtggttagatggggaaggtgcgcgctagcggcgcatacgcgccagctaggcgccccccaatgttacggtatgttttcccttttctttgaataagttcactttaggttccttatcttaaagtcgagtttaaaccgcaataccatatatataacgcatcctttcatcttttaaaaccgatacaaatatagtcccaaagcaccagaggaaaaaataaaaacataaagtaaaaaggtatgtagatcccacatatcagtgaaacaagtcttcttccctctctccccctatctcctcccatctctgtccaaacctccaagccacgcgactgatgaggagaagggaggcgaccaacgaagaggagttgggtggcggtggcggctacaccatcgagcctgaccggtggtggagatgtggaagctcaggtcggtcgctgctagtccaatcctcataggttgtcatcacaccatcgtgagtgcctcaggcctcaacaccaagaagataggagagaacagagagggaaagatagggggagaaaggagagagatggaagctaggagtcattgtcgtcagcaatgcgatgaggggaagcgcgggctcgatgaaagcagggaggtctagggagcatggcattgccttggtaccgcgggcctcctccgctcctgccatactccacctagcctccaaatctatgcgccgcttcgcaaccggcacaaccactacttctgccagtctacaccgctccccgtggtgtcttctactgcttgctggtgcaagaagcggcactatgagcaagccctcacgatggtgggaagagcgggtgacatcgactcctggattgtaggcgcgtctccgccgactactgggcctcctctgccgccagccgggcacatcgcacactagttagtgtctcctcacctcctaactacccgcgcacctccaccacaaccaccgctaccaagaccaaatgatgggagagatagataaacaaggtggaatatattgtttcagtgtcatgtggattccatgtgggttttaatttttttattttgcttctattgtgggttttaaaaatttttagtttgcttctatttttagaaaaaaagggcattttacaaatttgccattggtttttttaattttgtaagaatgccacttgagtatcagttctggtgatatttttgcaattttctagcggcagtattgtaataacgattcaaaccattggcaaatttgtgattgcctcttagaacaaaggatattaaaaatgtgcaagccaagtacatatttat

SEQ ID NO: 54868 - DNA, 1501 bp, Oryza sativa
ttaaattgactataagtaatttggagctactagttgggtatactattaatcttgctctaatacgctgtaactatactttgctatttgcatttatttaaataaagaaaacattattaatgttacacaattatattaaaacaacacaattattctaatatcattttcgacgtctacataactaaggaaaagaaaattgtgtaaaagaaacagacgcatgcctaaaacatgaagaatcaggcatgagtccgtacaactatagggtgatactaattgctttcgtatgtgtaggatttctttgagctactgacacgtgggatatactagattaattccttctctctctcgtttactgtcagccaaacgaacacataacataatcacaaagtacggcaatgtaatgatccccacctgtgtttcaagctcacctgtttttagctgtttactgccgtgtccgcgtccaccccatatttcctgacgcctctccatcaccatgtcctctcctcccacctctgcccgcagccgcagacgcagagctgtctgctctgcaccaccactgtgcgcgtctcccgcctcttgcgctctctttttcacctttcccccatttctttattcccccacgccctcatatcccctttttttacttccccgtgacaccaccagtagagtaaaaaaaatacaggtatagtagcaagtactccttgtacggttgtactacgagtagaagtagaagtattgatttcaactggcacggccagtagcagttatactgggttcacaattccagtgaaatccgatttgaatttcgcgaaatccagttttcttgaaccgggttgaaaaccagatcattccgtttttcgatcaagttaaactttggctgtgtttagtttctgaaattgggaagaaatttaagaaaaattgatagtttgaaaaaaaagttgaaaatttatgtgagtaggaaaatttttggatgtgatgtgatgtaatggaaagttaaaagtttggaggaagtttttgattggatttcacaaaattcgatgatatcggtcgtaagcggatttcgatccggtatacctagaataagcgaaacgacatatttataaatgaaaagtaatttataaataaaatttctatatacgtgttcttataaaatctaaaagtacataatgaaaaatagactttaataaaaaaattttaaaaccagctataaatttaaggttaaaaatttaaattttggctaatatatgtgggcataagcaaaaaagacgaggccccgggctcctctgcttcttttgggcaatagcttcgcgtagcttagctcggcttccccctcattcatggccattaccacgatgtgtcaccccaccccaccaccgcccgctgctccacttctcctcctcctcctcctcctctcctagtagtagcaacctacggacaccacccccacccgcttcatttatcacttgtctccccctctccctcgcctgctccgctgctcttgtgc

SEQ ID NO: 54869 - DNA, 1501 bp, Oryza sativa
tctacatgcaaaaaatgtctctatgtctacagtttttgaacggaacgacttctgaaatttcagagttaccagcgcgtccttgtacgttcaatgtggctctagaagaagaaaacatggttcctttactttgaaaatttattgggattataattttatttccaaaatgtcataattatgattcttaggtggtactcccagctccttctcaaattgataatcatataatagaattcaaaatttcttaaattgatcatcatatacatacattgtaagagaatgttatgtatggtgttttgattgatgtaatttaaattatccttcgtcgatttgggaataagtgagtatttgagatagaaattaagatgaatatgaagacaaggcacgcaaaacaaaaaaaatcattagcgcgtaattaattgagttttaattattacaaattgaagaaataaatttatttgatattttaaagaaacttttatatataagaaagtttttaccagagatacatttgtacagtagtttaagaaaatagtgacggaaatcaaaataaaatctacatcataattggaacaaaatttgaaaaataagatttcaagggagtattgtttcttaaatagtttttaagaagaaactgcgagcggggaatgaagacaggatatcaggttgaaaccacacttgcactttctaaacggcacaaaatggagcctcccttttctatgccgaaacgtaaaagtcctgaatgctactgcacaggagcacgcgccgccaaacgctcgacaacaaaaaaaaaacgcatcctccaaaaaaaacaataaaaacgtatatacggaaagcgtatatacgtacgtacaccagagataccaccactgtactgtacaacgacgctgcaaaatacaaaaacctgagctacccgtactcttctgtggtccgaaacagagcagtccagaaaaaacgaaagcgaagggaaaaaatggcaagtaaatagataaaacaaaacacgagcccaaattcagcccaagaaatatattaatttaacgtcgttcgtttccgcgtcagccgccgcttgaccgcagaattttattcccacccaaaaaaaaaaagaaaaaaaacgaaacgcagcgcagcagctactcccttcctaccctaatatggattttaatatttgcttgtactatttaatcatttattttattaaatttagaattattatttattttttacttattttattattatctaaagtgatttaagcataattttttttaatatttatataaattttttaataaaacgagtggccaaacattagtccagagcgtcaaagagggagcgagtagtgcagagtgtaacgcagcagcagagcagtagacgcgcacacacgcgacgcacctaccccacgagccgacgagcggcctgagccgacgaccatggcgaccatggcgactggtaaacgccacacacccctcctcacccacctcacctccggtatatatacccgcca

SEQ ID NO: 54870 - DNA, 1501 bp, Oryza sativa
gagcattttgagtgaatcgaatacctggatccaatcaccagtattgttaggtagaaaacaaagtaaatctttcgaacaatttaatgcatcgatcgatctgcagttctacatcggaaaaaaaaaagagatcgacgcctcctttcttcgaccctttggcttagttcttgttctagggtttgaattggtccactagaagaggacaaagggagaaatatcagcatagttgagggttcaagatggaccaattgacggctaggcgcaatcgcatcagataagatctactctgctcctatactatttacacaattgattcgttatttacatagttaataaattccttcgtataaggaactaaaatgagatctcctatgtttttcttctagggtttgaataggcgaacatgtaaggagacatggttgagagagagaagctctaatatcttgttggttaatctgacatagcatgttcagatggatgcaatcattaggtatattttctctacagtttatgttttccatgaatgtaaaacttaaatcggcgtaacccttgagttatattttaatgttcttgggaacaaaatataaatctcaaaataactatgcaaataatgtaatggagaattaatgggaagagttctaccatgttcttgggatcaaaatgtaaatctatagaaaaccacgtaaatgagaactttaatactagtaccacacaaacaacttaactggtaccgacacggtaccgatctgaatttgcggacaactctttcctttcctctctactagcaaatttatctttttacttggtacctgagtgcctatgccaatactcaaataccatagtacattttattatggagtgttggatctttactctttttgaatgcaaacaccataaaaggttagtatctcttaaatactataaaatttctttttgttttttgtttttttggaaaatagaatttgccatgcgacaaactttaacatagttttgcatcttgcgcgttacacatcggaaatactagcatggcactaagtacagaggccggagatgtattactcatttttccatcatcttagtgcatttcattttaagaaaagctgtgtgctgctgtgaactagaaagctgaagaaccattatcgaaaaaagaaagctgaagaacacccctagcacctggctttattctgaagtgcgcatgggctcaatagcacacactcatatgatcatatcgtccaaatttcaattcgctggagagattctctccgtcgcaaatgggcaatataataaaaatcacaagaattattcccgtagctggaacggttggctcaaacgaactcctgtctttctcttcagtgtccagctctccatgatgatgagcgagtacatatacatacagttgtatgctgttcctgaaaattacctgctcaatcaatcatggcgcatcatctcgtcgtcgtgctcgctgcgaagcgtacgaacggatgctgacaaggaccaaccatta

SEQ ID NO: 54871 - DNA, 1501 bp, Oryza sativa; identical to SEQ ID NO: 54768

SEQ ID NO: 54872 - DNA, 1501 bp, Oryza sativa
gtagaactacaactatactgtcggtggcaaacttcttccagttttgtatatatgacactgcatgattagcatacatataaaattctagtgatagattctttgctctctgatgttgaaaattgcagtgataatgtatataatcatggggccaacatgtacatatatgaactgaatgaatgcatgcatgcatgcatggtttgtggcccaacctaactggaatgcacatttcctgaatatacaagatgaacagacgacaaaatgttgagactgatcatatcattcatttgtatgtagtacaggtcacacctaataataatatcaaattgtaggcatcttgggtactttgatacagttggttttgtacatcaaagaagatattcgatcaagtttctggcagttaaaacatcgccctcgagaggtgcctccccggccgagactacttaccacggccgccaaatgcatacacactgcaaaaaaaaaaaaaaaatctcgtagtgcaggggaatgcaaactggtgtgcaatcatccagtgaaatttttgttctggtcgtgtgtgaaatttagatcgaaaggaatcaaagagtttttagcacaaagagacatccgctacgagcctatatattcgcaaaattaaggaggcaaccacatggatgttggcatggaaaaaatggcctactttatggacgtatttttttattttgtcctgtatataactgtattcaataaaatataacaagtcatgtgtgaaatttagaatgcaaggaatcaaagagtttttagcacaaagagacatccactacgagcttatatattcgcaaatttacgaggaggcaaccacatggatgttggcatgaacaaaaatggctttactttgtcctgtatttcactgtattcaatgaaatagaagaatctccaatctctgtcgtattgatttttttaagagaaaagggtatttttttacctggcctttttaaattaagaacttagcttttaaataatccaatctaaaattcgcttctataaagatttgaattcaagatcttggagtgctactcagggtactgtaaccactatgctacatgccatgtaaccactatgctacatgccatagtattgatatctagtgaagaatgtgaaataaacctgcaaatgtgcaatggaatgaaaatgttgtagcatttgctggcttcacttgggttcaggtagctcgcaaatcacatctaagctcacgcaataaactaaaaaaagaaaaagagaagagaagaaaagaaaagttggctatgattatgaaatgagcctcgctgcctttgctgttccaggcccacgtccagctcaccacctcaccttgatcgctcactcacactcgctcacacacacactctccctcgccaccaaccacactataagtctattaaacacgcactgctcccagctctcagatcgccgcctccaccaccgttcgtccgattcctcgccaccacacccacccacccaccaatgg

SEQ ID NO: 54873 - DNA, 1501 bp, Oryza sativa
tatatagaaatatcaagaaatatatgattttattgaagtacttttcaagactaatctacacatatggttttcatatttttaagataaatattttagaaattatttatagtcaaagattttaaagtttgactttacccttgtttaaaacaactaatattatcatcccgaagggagtagaatattaatatgcgttagtattatgcatcatgcccatgtttaaggaggtaaaaggaatgaaagacactagcatttcatttgaagagaaccttttgtttttttcctcttcaaatacagctccattattaactattcagcttatcaaattgcaaccaaaatttaaattctaaatgttaattttagagttgattgtcatatactttttttgttgcattttattttttacgtcgataagaatatattggggatgttctgagatgttggatgcaacagtggtaatgcgtaatgcgtaaaacttagctatgcaatagaagtaacgatctatagtaattacattatgattgagttgaaataagaaactatagagagtaaattcacgagcaaaatgtagagaagatttttaagtaaatacatttatgaaagtaaattcaataaagtctaaaagtaatttacatcaatcataaaactaacttagcacaaaataaaagtaaattgttacaatattagaagtaaactcattgtagggagaaaaatatggtctatctaaaaattaaattgaaagcccacaaattatagaattgatgactaaaaacaataaatattttatataataatttaatcaaatctaagagtaatttatatatatataacaaaagtaacttacatatataataaaagtaatttacaaacataaatattttttcatcgtaatataatcatgtaagatcttgttgtaaagattttaattgcaacgaacacaatggtgtaatcagattgtagatcggataagtaatttgagagaaaattttataagaaggaaaaaaatacatgcatgtctatatagatgtgtagtatttctctgatgtatgtggtgtctcccgttaagactaaatagataggcctctcagtttagattttacgtttcttttttgttcacaaaaagaatagagctttatttctttttttagaccatggcttggagatgtgtcctgccaagcaccgtaaaatcggcacaaagaattcctagtatagtactactaccaactaccctctccattctataaaaaataaatctaatacatgatatgaatcttattattacgaatctggacagcgactatccaaatatatatgtatctgatcaattattcatatgctaaaagatatttgagatgttctacgagagatgaattgaggagacatgagagacaatttgcttcgtacagttgtccaaagataaaaacaatattaagacgatacgtacgataacgtagcttcatgagataaaagagaactaattaatcatattaactatatttaacaa

SEQ ID NO: 54874 - DNA, 1501 bp, Oryza sativa
atcacaaaaggttttgtatcaatatttatgccgtatttttccccctagtttttaaatattacaccttaaatccatactaccaccgttttttatatataacgccattgattttttacatcatgtctgaccattcgtcttattagaaaaattaagtaaatatattttcttttgtcgtcacttgatttatcactaaagaaactttaaacactacttataatttttaagatttgtataaaatttttaaacatgacgaatagttataaattgttgcaaaagtcaacgttgtcatataagtattaaaaaaatgaagggagtagtatatttctgtctctagatcaatcctaaacataatggtcaataaaaatgctcacttacggagcaaaagcaacgatattgtatccaatcaattgttttataaacccaaacaacgtctcgactatataaaaaagtcagtagggcagttatataaagcctcactgtttgacacgttttaagatgcattgtaccaactcctaaaatactgatattcttagagtgacattccttattaatttttgcatgccacaaaatgcaaagttgtaggcacaaaagcagtagcaaacagcctctgtggtcagacaatgtggcccatttgggctttggcctaccactacaaggccagagtttttggctggaccagccaacaacaatttgggcttttttggcccattctagcagggctatccagcgaattttttttatttttaatttttttttttaaaagttttacaaaaataattttccattttaaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccatccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 54875 - DNA, 1501 bp, Oryza sativa
catattgaatattgatacagttaaaagtggccatgcagtcagcatcttcaattatactgatgctctttcaggcacaataacatcattacgtcaacccgtctagtgtataacgctgtaatgggatttggatgtacatcctattatttgtcctggatcacaatttttttacctagataaagaaagtaatttccccatctttgtgtggttaggtaaattgttttataggtcagttcatttctcagttgtccatcatcttctatatggctgtacccatgggtttgtgctgttatcattcatgcatcatatattttcccttgcaatattgtttttaaaatacttactatttcttggttagtacctttagtcttggctctctttgctaatgtatcttcttaaaattttcagggcaattttcagactctttacttcagcaatggattggctaaagagtaacaagtacttccatattgtggttaaaggggttgaacgtgatggctggaaatttgtgctacttgctagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttccagtacttggtatcatgtctagcattctcatttcgtggaggattaagcaatattcttctgcccttgttattcctgaagagcttaaaaattcatctactaatggaaaggctaatgtggatgacaaggcagtgtctgaaaataccaactctggggaaactaggaaaaggaggtgaccatcacaatttcttgcatattactgtgaggagctactacgaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgaca

SEQ ID NO: 54876 - DNA, 508 bp, Oryza sativa
cgacccagtcacgatactatgatgttttaactgaagcttcggattcaaggatgtcgacaggatcacgattcctccatggtgttgaaaaggcacctggctatacattccatggacaaatttctggttctagccatttatctctacatggcaggccaccagttttttcatcgggatcaacagattatgagatggatccatctaatatcaattctagttctgttccaaatgaaagccagtatggaattcctcaggttgctggatttgaaaactccgttgcaccctcagacagaatggtttatcatgatgacgatgcttttcgaatggaaagaaagcgcaaagtactgagagatcccctcataatttccccaaaacgtaaccatgtgtgaataaattttgagctagtagggttgcagccacgagtgagtcttcccttgttattgggtaaccagaatgccgcaaaacttccatgcctaagcgaactgttgagagtacgtttcgatttctgact

SEQ ID NO: 54877 - DNA, 1501 bp, Oryza sativa
attgctgatttgctgccacacatgaatgtgtggataacttgttaggtgatcaattgtcttgggagatagaagataacatcaattttgagtccctcatgttcttgtcaagcgatttatttttaatttctgtttgatcagttacagtaaaagtgggtcttgtgtggaaggtggtcacctggagaaacttgtggacttcatgtctctgcttttcattttagtagatgacttggttcctccatctttttcagggatgaattcttcatcattgacatcttggggtgcaaattttggaggattttgaaacgtcggttttgcttccaggacatatttcctcgctgatagtgattttccatgattaatggcttttcttgttttcacaagcaaaaaattgaggaagattgaaatgaagaccgtagtattaaataatatatattgatcaagaattaaacaacagaagaccagattattgaagagcttactaattaaatgatggatgagaaacatttctaggcttgaccaactctccaaagatcaaccaaaggtgtgcaattttttttctcttaagtagtaagaatggaaagcacattaaaacataaaatattgaacctaagtgttatttttaataaaaatattttaaataaaaaaatatgattgatgttcaggaactagcagtctccaagttgatcctgcaaacaggaatttgtcagtttatatgtggttctgtcgtaattgctatagaatcatcaacatcgttattaatgtaaatacagtcagagtacgctacttcgcattgcaataatttatttattaaaaatacgcaagatttggattagtcaagtacttggttttcccacaaagtcaagctgaaacttctttatcatgagatttagatggcaaaaggagtatgatactacataatcttgaccaagataactgtatatgaaaaatatgtttcattatctgatctcggtaataaacaactaaaaaattgacatcaagtttggattatccggcacacttggcagaatttgagacaattttttcttgggagaatttgagacaagttcataaccggatcaggatcagatagaatagttgttgaaatagttaaatggaactaaagttaaaaaaaaaagctcagatttttattgttcaacagtgcatttacagccatgaattgcaaaaagtattattttgcgtaatcccctctttatcatgcacttcacagaatacaatggaataaaattgaaggaacagaaagaacagatattccaaaaagtaaaaaccaaagacaactactctagttgctatgtgggccaggagggtaccatcatgctcatcatcttctagaaccctaatatgttggcagtgctcattggttgtggacataggacatgaggttgttcttgtttgttggtcaccaccatgtgcagtgctccaatatcaggtgtgttcttcaggtccgcaattcagtaccagccacaaaaagtgcaatttcttt

SEQ ID NO: 54878 - DNA, 1501 bp, Oryza sativa
gaatatatctcctggccaaagcaaccaaccaggccctagtataagatatttcaatcaacattgtgcacctgcacgtacggcctctccaacaacgtacagatcgagagagaataatgttggtcgtgcatatatgcagcatgcaacttagatcgatatcgatctcatgcatccacacagagcacctgcatatgcttctctccttggcaatattatgctttaatttcagctagcttagctgcagggtgtactgctagctccttgctaacttctgttgaaaaatggaacaggatatgccgggcgttgttggtcgatcggatcgtggacagttaccatgtcgcactatgcatgcacctagctgttcgatcgatcaatctccggcgtttcctttctcacgtattctaaggttaaaatctcaattagttctctcgtacaattttatgagtaaagattctacgactacatatgagtaaaatctacaatttaacaatttttatatgtacgattctacgatcacaacaatcctaagcatgcttggcacaattttagctctagcttcacctctcctgaagttgaagctcagctaaacaatttcagctctacttaaaatggaagcggggctgggtgtagcgttttcacaaaatgaactagagaagtggaattgagtttaggcagctctacaactctactccagactcaactcctgaagttaaatttagaagttgaaactctaccaaacatacccttagaactttcgattttgattcacgatcaagattttaacaaaccttgaacgtattgggcacagatcggtttttgcatgcctatacgtgagagcgaagcaacgtactacatgccattgccatctcaactacgtattagttagccgcctactactacttgctaggaatattgcgtacatgtttgtatatatacatatgcgcacacacacacttggacataattaaagaaaagaaaaggagaaaaaggtgtatatgtaatggatctcttattggggaatgaaccacacggggaaaaggttgaattgtgcacagtattgcattcctcctgctcattggtaccagatgaggatagagaaatcagagagagggatagtacgggtgtgtgtgattacaagtagcttttaacagggacaagctagctgttgcctgcaagctttccttcttcttttttccccctctcgacgatctctctctcatcaggaccccggccttaagttgtttcttccctatcagctcaggtctctctcgatctctcctagctagatagatagcttaattagcagctagagatgtgtctctagctaagctaactagctagtaggcttcttcttttaatccggcattgttcttggctgctggtcttagtttttggctgtcatgtatggagttagtggtaaaatactaggttaattaataatataaggcgtgtgtatatattggtgtggaggaggaggagaaagggggttggccggagagatcga

SEQ ID NO: 54879 - DNA, 1501 bp, Oryza sativa
agtcagattcgctggctttgaaagaagagatcagatcactgactgttagcttggagtcttttagaactgaagctcagtcacgtgagaaggaagtgaagatcttggaacaagaaaaaaaccatcttcaggagaagtatctaacagagtgcaagaggtttgatgaggcagacagccggtgcaaggaagctgaaagggaggctaaacgagcaacggaattggctgacgtagctcgtgcagaagctgttgcttcccagaaggataagggtgaagcgcagaggctagcaatggagagacttgcgttaatagaaagaatggagagacaggttgaaggtctggagagagagaagaataagatgctggaagaaattgagcgagttggtcagtctgagaaggatgctgtatgtaaggtttcatcgcttgaacaaagggttgacgagcgggaaaaggaaattgatgagatgatgcaacggagcaaccagcaaaggtccagtacagttcaagttcttgagagtctactggagacagaacgagaagcctgcgctgaggccaataggagagctgaggctctgtcactgcagttgcaggcaactcaaagcaagttagatatgctccaacaagagctgacatctgttcggttcaatgaaaccgcactggacagcaagcttaaggcctcacatgcaaggcgcctgaggggtgaagctactgagtctgtccatgatatggatatcgacgatgacaacactggcaggcgaaggaaacgatcaaaaagcacgacgagcccgtttaagagcaatcacaccgaggacggtggctctgtatttgtaggagaagacactaacaacgggagccagcaagcgcaggagacggagactgaagactacaccaagttcactgtgctgaagctgaagcaggagctcactaagcatgggtttggtgctcaactcctgcaactgaagaatcccaacaagaaggacatcgtcgccttatatgagaagcacgtagttggcaagtagcggttttctatttatgcgtgctagattttccctgttgcgatgaacgttgttgtcacggttgaggtgagagcgcgaaataactaatgtaacttagcctgaaactccagtttgtgttattgttaacttggtgcagtttattttgcatgcatcattggcaagtgtttgtagtacctgtgtggctgtgtttagttattactcactctgtctcaaaataaactcagcgtgtagttcaacttattttgggtcggagggcgtagaaatttggtttgcaaacccttcattatatctggcttccgtgtttgtactaacgaaataatcctatatgttggggactacgaaacagagatcaaggttaatttctctagctataatgttagaaccatccatccgagacatctaaagatatatatgaagtgatgcatcatcaggacctcttccgtgtgcatgtatacatgtacaaactgatacattaattgacattttcgagt

SEQ ID NO: 54880 - DNA, 1501 bp, Oryza sativa
tatcctatctagatgtaaatatcaaatcattaggtactcatatgccactacagagaagtacatatcaggaagaatgaacaggttctctttttccaattaatgtcttcatgtattagcttgttgtcgttcttgaagaacgaactaaaacaaataaaacaaaatctgcatcaaatgatatacatagagggatcacaatagttttccattgatatatcagacatcgattgtagatctaatggccgaattaatttaaggtgatgtggcacgttgtgaaaggagaaaattaaagtttgtggggataaattgtataagtatataggataagtacattgtatgatctgtgggtcataattaatttacacgtactgcttaggatactttgatgcagctgcatgaaggtagggcaatactaggctaaagcttacagacatccgaatcgagcatgttaatgattgatggccgaaaaaggataatcacatgattaaagccttgtgctgtcttatagctttgcaatgtttgttctccaagacctcaggtggagcatgcattctacactgttacaacatgcaatgtgtaggaatctgttttgccagaaagaaaggccatggagtactggcagaggttaaaggagcatgcatgtatttggaccactgcatcaggaggtttttgtcttggcacccaaaagcttattcttatcttgcccaagctatcctgttcatgttatgctacttttgattgcattgcgtctgtgtctctgtgatagctaggctggtatagctgcttcagaatgacggcgaacatatcagagcctgactcatgtaagtttgcattgggcatctgggcctttcttgtatcagcttgggattagattgggctacctgtaattttgcaggctactggacctgtccatctctatgggcttttttcataggctaaatccccagcctccaaccgaacatctctagcagccagcacaagcaacaggcagcctatcagcctatcagctcaagcaacggcaacacaacaattcgtgatcacttatcagccatcaccaaaaagaaaagaacacaaaagattttaaaaataccagcaagatatctacgatgatttcatgaatctcaacaaatgacagcacaatcttttcgaatatgcttatagaggtaaagcggtgtatttgtagaatgagtatgcacgtgttatgatcgcatacgtttatctttaaaaaaacacacacacaaaagcgagataccacacttgcccaataatgcttagtcgactacatgacacgtactttagccatctccacaaggcaaatccactaccggcccaagccacagtagaggtatcaccaacaaactcacctaatccgctccgtgccaaagctgcctttttagttttgatccatcaatccttgcaccaaaaacgctcacgaccaaaaaaaacgtagctggacgaaggccggcactgcaaatttgcaatgccattccgttactcaaccgtg

SEQ ID NO: 54881 - DNA, 1501 bp, Oryza sativa
aaagtatatttaaaaaaaatctgaaaataggagggtataatcatacaaggaagtgatgacatgaagcggtaaaattataatttacgcaactattagaaacaaaaaaaatttccctcatcttttgttttactaatatggtcgtcgtcggactgtgctatacattcaaaggaaatatattactccctctgtttcatgttacaagacgttttatctttggttaaagtcaaactgtttcaaatttgactatgtttatagattataaatataataatatttataatactaaattactttcatcaaattaataattgaatatattttcataataattttgcattgggttgaaaatattattacttttttctacaaacttattcaaacttaaaacagtttgacattgacgaaaatcagaatatcttaacctgagacagagggagtaaaagtttaattgaaacgcggcggccgttgaaggactgcgttggcagggacgtgtgcacgacaatggtggggacaagcagatgctacaaacatgtaaattaatgataaaaatgcggcacgtaaaatataaggaaaatactatttcccccttttaaattggtgagtaggatcatttcttggtagtagaatgcacttctagaaaacacattttcgatgtcgtaggggttccattttcacaggcgggtatggtcttcggagccaaaaccccaccggcgaagacgatacccggggtggagggggtggtccgcctatgaagatcgatctttgcaggcgatcttcgcaggcgtcgcttatatggcccgtctgcaaagatgcccctatgtagtcttattccttcctgagccccgttcattctcccagaagtttctctctcctaaagtgtcttaaatataggggggaggttttctacggtgcttagatctactcatttccaccctaggtatacattttttaagcttttagacctcaatttgtgatgtatttatgcatgcaaaattgtgaaggaaaagctccatgttttttaatttactttcttttgatatgttgatgctagatgtatgtgtaatatttgatgactcttgttgtagtgatttagtgtggtaacataaattctcaattttttttattttgctatcatattcacctcctagttctagatctagatctagatcttgtcatacatatagagagagaataaaatttttaatgtctatttatttggtgcaatcaaaaaataattatattagtttgtaatatgccgatgatatgattttgttagattttcctaatatattaatttggcatgtctgtgtaaaaaaattaaaataaactttgctttaatggcgatatgttttttttcaataaaccctacaattttagtattaatagtgcaaatattttatgttcattttttttagagatatggaaagtcgggaatggatgtatcattggccgaggtttttgtctccatgtagaaatgaagtgtctaaatttattggtattg

SEQ ID NO: 54882 - DNA, 1501 bp, Oryza sativa
taggaaaagaaggtgtcgggagttttggtctaacttggagataaactattcgttgcaagagagtgtatgttagtgctgccagagacacggatgcagcagaggggcagagagggctcggccaccctctatagctccttggttgatcatgggaacttggggctcttctgcagccctgcaacaaagttgtacgcatgcagtcatccagaagtggcccgaggcaagcaaaactgcagaagcaggcacccggccggctgcactcttagaaataatcttgtcattaatactatgcatatatattttgttcatttgcacgtagaaagtggttgtataggtcttagcactgtagcagtgtgtggcttcagaagaagtacccggcaatacgtgtgatacgtacaaatacataggcttgaccgaaatagaaaggagctcctctaactttaagttagagggacatgggtctcagatgtgccccatacccatcagcccatatgtcagcgaagcctcatccgccggaatgcagccgggtcgtgcgaagcggctggagagtggcgccaatatcagccacgtgcaaaaaggaagcattttcatgggaccaagctagtgattagtggctgcatgtgcacgcaagcacgtttagagtttgttagcttgcatgcaagttagttcccccctccatttcagcttataaattgttttgactttagtcaaagccaaatagcttcaagtttgactaaatttatagaaaaaagtagtaacattttcaactcaagacaaatatattatgaaaatatattcaattattgatttaataaagctaatttggtattgtaaatattactatatttatttataaacttagtcaaacttaaagtagtttgaatttgatcaaaatcaaaatgacttataatatgaaacaggggagtagcattttacatggtcagctctactagcttgtataggatcctgtgcatgcatgagcttagtggagcaagttatccggtattcatgtgagtgcgttgtcgttgtataaatatgcacttgcatgcttggcttaagttaataagaggagaagaaaaatgtcgtgagctgtgatagctgcatcgccaaaatcttcctatgctcttgctcattgtgtttgtgcgagtccacccggaaaaaatcttgaatattagtgataacactgctacaggattgattacgctggacgccacccccgttttgtttccatgtgggtccgtaagtcagaccgcatggaaaaatggtgggagcgtcgcccgcacacgaaaatcaatttttgtgtgcgggtgacttaacaggcccgcacgcgaaaataaccctattttcatgtgcgggcctcctaatccacccgcaccgaaaaatagccgtccctcccatcctattcaaaatttccgtctctctccccgtggccccttctctcctctctctctcccttatcttctcaccttccttctcctccactcattttcctctctctttctct

SEQ ID NO: 54883 - DNA, 1501 bp, Oryza sativa
tcggagtttccttaggtagccaccgacctacagttctccttaaacttctatgcttggtggaaaagtacaccagccaaagaggatttcgcagcattgcaagcaccttcgttttacatgaaccacatcgttgtgtgttccaacaaggatgaggtaattacttttcatatgaagccttgaaactgcatgatacctctattaattgctcatgtaccgttcacctacaatattaattgttacaagccattgcatacttgatagaataatagtcactatctttgcttccttgctatagagttggatagctaaacagtcttgttaaaattcactagcactcatcaagtacagtgtgatccacagcagcatgcgagagattgagtactgctatacatccgaccacatcgtctgacccctatccggtccggcctcatgtctgccaatcaattctctccatacgagcagcatctctacatgtgggccaggacaagaaacaactaagtactagttggtcacaagtcgtacatgccagttgtatgtgtagcaatttctcgagagattgttcgttcagtaatatggtgatgttcaataggatccaataggaaagggagacaccgagaatgcacgtctaagttccatggtgtctgttgggggtatacaaacggtttgtgcgtctttgtattagaattctggccttctctaggtcacttgtgttcatgtttgtttgtgtgtctttgtattagaattcagctggtcaccgtcgggctggccggtttgaccgctcgcataacgccggtctgatcagtcgggctggccggtttgaccgctcgcataacgccggtctgatcagtccagtcctgcttgtctgaccatgaccgtcagagcaactcaatctttttcatcatctgaaaatcacacatctccaaaaccatatcaccaataatttgcaaatatcaaaaccaataatatcatatatatgccaattgttcattataaaataatcaaatacattttcattttacatatattacatgaaaaaagattagtaatcagttatatatatattagtcgtttcagatatttgatccactaggaaatggaggcctcaggaattcatgttcaagttgctatatcatttacaacaagacgacaagctgcgtaaggagcaaaaaagcaagtgcaacttattccagtagagcagtaccgttttgctgtatttgacgatctatgatagcgttcgaggagagactatggtcgttgaagtatagccgatacaatacaatgggaggttgatatagttgcaaacctacttgcgaagcctgcatcagattggaattggatcctgcaccttgatcaataaccattagctaattataaattcagtgtattcgaacaggtacatactagattaattgcagttaccacaagaaacatccactgagagctagcaactgtttgtcaattaccaaattaataatgtgtgaatagctactatatatttatgaac

SEQ ID NO: 54884 - DNA, 1501 bp, Oryza sativa
aaaatcccatgcttctccctccaccaagctctcatgagccaagaatcaaattttctttcatattctttgcccttgtggtgaatatacatataagcttgggaagcattgggagattgatacctgctaacctcttcggtatgacaggctcagcacgcttagctgctggaacagaggaggttcatgctatgtgctgtcccgacatttacctagtaaaacacattctcctcgctagcttgcaagctggtgaagccagcgacggtggatacgcgggagaacaaggcgtggtgtcagcggcgctgaggtacacggcatatcgagactgtgtgccaggtgcagagacatcaaccattgctgcggatgccattcgcagtgcaggatcgatctaggatgcggcggaccgagctccggcggcaggatctggcggcgtcggggagagctccggtgacctggaccgacctcctacaactggattttttacaatttgatcattttataaaatttagactactgaaaaaacttatcccagaaatgatttttttttggcgccagagccgctggcgtcgtcgtcaatgactgaactcatagccgcaccactcacgtgttcatccttttttgatttatcctgactgaactcctgcttggtctatgtagaaccgcacttctcttagttttatatttttacagtagattcaggttaatcttggtacaaaacaaataacaaattacagcgcattatgaacttctctgattttatttacttctctgccttttcttgccaatgtttctgccttttctgtgagtaaatccagtaaaaacaagtaacgttttgttgttcttctctgccaccgttgctcaactaaggtggtgtttaggaaggagtccctctcataaaaattttagttcctccataggaactaaaatttgtgagagggactaaagtccctccttcccaaacacaacctaaagaatcaagtaaccctcctcgtatctaagcgagtaagttttttttccttcttttaggaaatctgaggggttgttcactttgctaccattttcaaccttaccaagttctgtcattactaaattttagtaaggttactaaaattttggtaaggttgccaaattttagcaagatttcatatgtacttcctctgttttataatgtaaatctttttaccattgcctatattcatatagatgttaatgaatatagacatatatgtgtgtctgaatccattaacatctatatgaataggcaaaatttgcgctaaaggacaccaaaagattgcggcatttgctgtgagacacccgaagatcgtgtatttgctcatgaacactcaaaaaatatggtaattagctggcggacagcggctgtattattttattatttccgatggaaacggagagagaaactttagttaaagacaagtttacccatgggctcacttgtcaatctctttttatctgttcttcttctttctctcatgtcatggtgcccgcc

SEQ ID NO: 54885 - DNA, 1501 bp, Oryza sativa
tggtaggtcctgccgagatttagtcaactactattaggtatgtggtatccataaccctgacaacaagtacatcggggagcttcttcctcttgttcttgggctaggggaaatcttatcttctccccactgattccacgttgtaacagtgatgtggcacgcgcaaggctgaaaaagggcacaagagcaagacaaattctctctagtggcatttaaaaataggatgtcataaagtttcaaaaagaacccaaaatccatcaactcctcaaccaaattctaatttgaatgcatatctaaaggagagacgcgagggttattttgagaaagcacacgaagacgcccatcatcaatttggcgaagcccgccgaaacagatgtcaaaaagctttaaaaaaaaaaaaaactccaccgcatccacatccaaacgaaataggggcgggagacggcgcgcctccattcatcgctcgccagagttgcccaccccctctcgtctgctccttgcccttgccattcgagggcgatcggtgctccctccgcctccggaccgccgccgccgccgccggagccctctccggggcgtccctgaggtcagattccaccctgtttcggttcaatttggtgggtgcgcgggctcgatcgaggcttttttttctccggtatgtgagtagggtttggttcgaattttcccccattatgtttgggttcggattggcgggtgggcgggcagcacgcggtgaggatagatagcttcagatttgtggatggctcatccgctcatggctagctggcgacgccgcgtcggtggggacgccaccggccaggggccaggggatcaggggatggtggcgcaagcacggccatgagattcatgaactgcgcgaggaccctcccctctggattttttttttgccaaccctgatgacattggtgctttgatccttcacatctcgtacaaacattttcagatgtttattagttgttcatagttcctcccatttagttggcagccaattgccgaactgactgcataatacaactcttatgtactcttggtcgatgttactacagtttgtactatcaacaataatgttaaacacaccagggaacatgttctagaaggatccaccagagtatgcctgcatgatatctctaggtccactttgttttattggaaagaaattagtgtcaagattgcacaatttactaactgcaatgggttcataggctgcacaccatgaatatatacgtcatccctgtttttccgtgcaccaagcaagttaataaaatgtgttgagctagctctgatgtattgtattgtgtctaattagttatgtagtaactagttgctggtccatatctatttgtttttttcccattgcttactagccccaacatttggtgcttgatggacattcaagatagctcttgaattaggattcctggctccttggtttatatttttctccaaatcctctgaataatgtgctgaaatctatcacttgatc

SEQ ID NO: 54886 - DNA, 1501 bp, Oryza sativa
attttaaaaatgattcataatcaaagattctaaagtttgacttcagccttgtccaaaacgacatgtattatcagcccggagggagtagctataaattatagttaccctgttaaaaaaaatatatgaactaaaatgatataccttaaagggttagttagatcatatcattataaatttgacagttttaaagaatactaccattattcgtataactgaaatggtaccactacaataatatgaaaattggattcataccatactgtacactaatttaaataggtaaatagtaatgatatattttcaagtaaatttcagaaaactacaaccaaattatcgtaaaacttcatatttataatcttgtattacaaaactacaaatttagcatggaaattttcatagaactagagatttaaaatataatatcccaaaaataaagattgattagcaaatttaataactacaagttttgcatcaatttaagtacaaaactacaacgcctaatagttccaacataataataaggggcaattacatatctgaccctcttttgaaagctaactaccaatttaaccatcttatatcaagtttgctcatttgacccttcatttcaaaactgaagatacggtaggaccctattctatcaaaggcatgtaacggtcttaaaaggagcataaaatttctcttctgcccttgctcttttgaccctattttaccaaagcatttagttagtttagcatagttttgtatggtggcaataatgagaatgatttgtgcacttagtgtaagtttcaccgatttgtgacaagtttgactcagactttggtcaaatttgacctatatttgttatattaaatttttcaaatttgacttcagtttgacaaaatggacttcaatttgatagatgtttgacaaatttaacatagatttgataaaaatatgaataaacttcaataaaattttagactccatcatcctcgccacgtcatgcatcgtcgcagaccgctgatttccgccaatgttgtgccaccatcactgacccgccacccgtacacctcagcaccgccggatttgcagcccgcatgcccagtcacctctacatccactgccaacgcaactctgctgccctggccctgccgccgccaacccgccgctaccagatccaccgcctatacacctcggcgccgccggcgcaaaattacagcctgagctgctaccgccgtgccactgtcgttgtcccgttgccaccggatccgcaaccggcacaccttgacaatgtcggatccgtagcccagatgcctaagcactgccggatccaccaccgtagccagagcttcgctgcctgggcctcgccaccactgctcgtccttgtcatcgtcgggcctctgccgcccctcctcgtctgattcgcccgcctgttaacaaccaaatttggtaatccaagtatcggagatgaagatagaatcgaagcggaattcaagatggagatcgttacggaaacata

SEQ ID NO: 54887 - DNA, 695 bp, Oryza sativa
gggaggaaggggaaggggagagccaggaggacggggaggaggcggaggagagggtggcggaggcggcggaggtgggaggaggaaggggagaggtgggtggtggcggcgaggaggaggtgggagagggaggcggcgaggagggcgagggagaggaggaggtggcaggcgaggaggaggagggagtccgccattggtgacctcaccgcgagtgggagctcggtttccggggtggtcgtcgtcgtctattcttcttggatagcgacggtggtcggtggcgacgaacgcggcggtggtggagggggaggaggctttctcaggtgtggacacgtgggcggtgaagattggagcggttgctcttttctcatttttattatttttcaagggaaggtgttactgactttttgctgtagttctacggtggtgtggtgtttggatcaggatttaactttagtcatgtatttaaacactaatttagagtattaaatataaattacttataaaactaattacataaataaaagctaattcgtgagacaaattttttaagcctaattaatccataattagataatgtttactatagcatcacataagctaatcatggattaattaggcttaatagattcgtctcgtgaattagtccaagattatggatgtgttttattaatagtctacgtttaatatttattattagt

SEQ ID NO: 54888 - DNA, 1501 bp, Oryza sativa
acaacccaacctacggttcaaaccccaaggataatgagatactctctccgtttttaaatattcgacaccgttgactttttagcatatgttcgaccatttgtcttatttaaaattttttgtgaaatatataaaactatatgtatatatataagtatatttaacaatgaatcaaatgatagaaaaaaattaataattacttaaatgttttgaatgatggatggtcaaacatatttaaaaaagtcaacggcgttaaatatttaaaaacaaagaaaatatgtacgagtgaaaatgctatcttcaatcatatccagtgtcgaacgtgctgctaatttattggttgtcaaggtaccgtttaatttgaattattggatcatatcgtaacctccgtgcctacatccataatcctgaacatgcttattcgtccagagaaaaaagatcctgaatatgcttatttgttgcaatgtagcactattcttcagttagcctctaccatgtgcgagtagagtttcttctacgctggtttgcatggttacgagttgaaatttattttaaaaatacttttgagaatttgttgtggccatgtaatattattggattaattagctgtagtgtttcttttaggcgtagtagctagccacctcaagtaaattcggataaagcagaccttacttaggtccgtcatagggtagggttcacgtttttttctttttgacgaaaatcgactgaagaaccgtgaaatttcgaggtttcgatgtgggaagaaagtatatcccgagtgaaagtttgaatgggttttgagaattcaaatttcataatccaccaatccctatgcatcatctggcaagtgataggttttgaaatctcctgtgatataccaagcgaacttgcgggtggcgcagctgagtccccgtctcggacgctgcgagttcgcatatttcctttccatatggcgacagtcagtggggcaatgactgtctagttaaaaataaaaaaaaattacaatgagaccgcacaccagcgcagttggcacgacaacggtgaagccagtgacggccccacgatgtcttgcgaatgaccagcggccaccaagaggatggtcgaggatgtacagcaacctctatgatggcgccctcgccgatgcgtgtccccttcttttgccccttgccggtggatgacggtggccgggccgctttggttgttttctgccatggactccccgatttcctccttcgacatggcccctgacgcgtcctatataaaatacgcttccttggtttcctccttcgacatgatcggagcgttccccttttccattccagtcaacacagcacccaccatgttcttgatcactgatggcagcgccgccttcgttttgacgatgactggctcgatcacgaattctctcagcggaggagatgggcatattggggaggagacatgagttccaccgtatttttttatttttaaccggacagtcactgtctcattcatatgtgggttc

SEQ ID NO: 54889 - DNA, 1501 bp, Oryza sativa
aaatggccgcactttgggctgggttgtcgggcctcgggccttatggccatgtatagttgtgcagcacatgtgtcgtcattcgaggttcatttcgttcatgactttatttaatccgatctgtgaaaattgtacaaagaataatcaaccaaagataaatagcagaggcgctcccttctgtaatggtttgaagaccactgctggatatggtagaggaatattgtggatcatagttttacatcctagttggaaatggaggcaccgagaagttagtttcaatcagcaagcattttcaatgatctgcccacccatactttgtctgtgcaagatcacgaaactgtgatgctcgatgctcatagttggagatcagagaaaagccattgcctgtgggagagagttgctctactgtggtggcagaatgtatagtgttaatgaggatatcccactgtgcaattatgatgaactagcctagaagaaatctcaagcagcgcaaggaactgaaaacatccatctcctgatggtgattaaggagaaatgcaggacaaggctgtgagtcatcagagcttgttttggctgccactcagttggtctatcacaatcataatcttgggagtttataattttccattacttttgatctgtcgattctagtaaaaataaacatgactatatcacagtaaccttcttggatataatggactaaataggtctattacagatcgatgaaatctcagagagcttgttgtaaattggtgagagtatctaggatccattcataataaaagcaaaattgaactaaaatcccagtcaattgaaaccaagctgaagagcttatgtaagtgtttttcatttgccaataaagaagtcccagtgagtatgttggtttttggacatccattactcgtcgaaagcaagttgtaacgcagcaaaatcttgacacggtttggtcctcaaattccgtcaaaagtgagcacggacggtgggcgttgcctcaaatttcgtttcaaaaaaagaaaaaactcgtttgctaatattgaattaatcagtgtgtaagtgataaggtccgtgactgtgagcaatgcctagtcgatcaagcaaacagattggaggtctatgcttatcatgacatcattggcgtttgtgataccggttttaacaaattcaaattgatgcaataaattaactaatacgacgattggaatatcaggctgtacatttgggactgggagagctatgaaaatgatctttaatattgaaaccattcaaactccattggctgtatattgcattgtttgatgtcgtaaaaccaaacaggataaaatgatcctgcttactactgagtcctactttatactaatacacagtagtttacggagatgtacatgctcacctctatatgaggttaattctgagtccatgaagctagctcgcacttgagacatggcttttttttttttgcaagatcacctaaaaaaatgtttaagtaaatacatccatgtatata

SEQ ID NO: 54890 - DNA, 161 bp, Oryza sativa
caaaaccaccgcggattgggtcaaggggtataatttgtccggtttgcttagttgggggtgaagaatacccggttttatggttcgggggggtggtaatttggacagccgcgatagttccaggggggattcgtactttttcctttgcgaatttgcgatgatta

SEQ ID NO: 54891 - DNA, 1501 bp, Oryza sativa
ttgtttaggatagattaaggtttaatacaaaagtctataataccccttgttaaataatgtatgagaagtgaaatggttattgagggtaaaataagaaaatttttgagtagaaaatgattgatgggacaagtagtacgacaaaatttaaatcctaaagagacaagtattctagaacaaaggtactagtagtatgtaagaagaagcactacgaaaatggaattaatgtgaggtactacctccgtcctagaatacttgtcgctttgagtttttgcttgtaacttgtgatctttcgtcttattcaaaaaattatggaattattattttttgatttgctttattgtcaaaaatacttaaatataacttctctgtttttatatttacactaaactttcaaataagatgaatggtcaaacgttaccagaaaaaagtcaaagcgactactaatttgggacagaagtgactactaatttgggacagaggtagtagttataggtacattttggtactgggctttgaggagagctttgtggatttttcatgaaaatgatttgtaacgaaaccgttcaagatctgttagcacacataagttcagtactgggttggtctgcctcatgcaaatgcattacaatagtagaaaaaatttgcagtcattctcagtccatttacttagacactccactcttggttgactagaaatttgacctctgaaaagcatgtactatcatcatggagtagttatgtctgaatttgagagccgtgataaataccagaggcatccgatatctcgcacgatatagagcatcctaagccagtcacgctatacactatgaggaaatactatttatcttttgaacaagaaattaaaagtgacgttttctagagtatttcaataggaaatggaggcactagggattcacataaaaataaggatattcaagcttgagaatttgtgttcagttagcccatggttattcttattagaaacctattctggttatgaaaaggacacagcacgtgcatatgtgaaacatgcaaaaaatttcaccctaacaatggaggaaaaaaaaagcgcaacaactgacttccaagacctgaccacaagtaagtggtacataatttggctgtgtatattcattactatggagatttgaactcaagtcccgtgcttgtttttagtgaaggctaatttaggaccgatgccttttatttatttatttttttagagaagaatattttttagccggtctccgtatccaaccggataaatgcaactactatacagatttgaactcatgaccgatgcctctttttttattatttttagagaaagccattttgccttttttttattatttttagagaagggtattttttacctggtctctacatcgaaccgaatatatgcagccatttaaactcaggaccgatgcctttttttaatttttagagggttttttacctttttatttttattttttttagagaatatatgcctacacgg

SEQ ID NO: 54892 - DNA, 1501 bp, Oryza sativa
cgtagctaattggggttttttaaggagattaataagattttaatgaactactggttggtaccgacttttaagaatttaaaaaagctgtattttcagcttctaatttctctttcattttctaaattctacaactagattgaacttgaagaagctgcaactgatagaagctcctccaaacaaaccttaagaattagcccaaacttgatcgccgttgagccaacacgtcttcagtcttacctgctatggatgcatgagacgccttcactctcgatgctggtgccacgatgtactgtttgctttgtttcgtgcctttgcttctgttgtcttggtcatcctgggagcttcctcagagcctcagagtagggggaacctgccggctccagtagatagggcagccacaatatgtgttgctggtttcatcttccattctacgggcttgggggttcgtactcgacttaccagaaaatacagcacttaccactctcctgatgcttcccaatcttgcattcaacttaagagaaaaaaatgttggtttcacatcaagggcaagtagaatgagcgctgattgggaagcatcaggagagtaaaaaatgtatagtcccaatgcatttatggtctctgtgacaaaacgatccagttctttttttctgaaaaataataagtctagcaagtgtgaaaaaggtggtaaataaattgagtgatttaaatcacatctagcttgcgtattagagcatgaaaaggaaaaaaatgtggtaaatagattaagtgacttaaatcacgtgtaaaatctattggattgttgaactaatagctagtgctggttccacaactggcactaaacttcgtacactaggagtgggggttatcattattagtgctggtttcaagtcgaatacttcctccgtcccaaaataagtgcaatcatggttttctgcgtctaactttgactgttcgtcttatttgaattttttttaaaaaaaatcaaaaacataagtcacgagtaaagtactattcatgttttatcatctcataaaaataaaaatgctaattataaaaaaatttgaaataagacggacgatcaaagttaggtgcgaaaactcatggctgtacttattttaggacggaggtagtacatataacttgttatggccaaggattcaaactggagacctctccttagctagcatcaccttaaactagctcacctacaaatcagtttactataaaaaaacgattttcctgtacagggacccatttatattgcagatgaaccatgactagtcgcgtttgggaaaataagcttattttcgcgtgcggtccatttaagaggaccgcacggaaactgagcctattttcacgggcggacctattaaaagtgccgcacgcaaaaataccgactccctctttccctcttacccactttaaattttcccctctttctctcctttcctcgctatgtctttttcttctctcctctcctctttcctcttcccagtcatca

SEQ ID NO: 54893 - DNA, 1501 bp, Oryza sativa
ctccagcggatgatagacgatcattagcccatgggagccactgctcctcaacatgctgcttcaaagcagccaggtcagctcggagattgatgagttcaccatgaattctctccctcccagcaatggcagggacaagaagaggtgattcaaagtccttgggaagctccataccttcaggaagcttcaataccctggccaaagctgctttgaagtccccagataacaacggtacatcatcagtgaccgctcctcccaataaaagatcatctccaatatctgatgcaagtgtagtgagcttatcgcgagctcctaccaactcgtccctagcttcagccagctctgcaagccccgcaagctgtgtgtcatcaactatccagccctcttgattcacgtactcctccaggtactgataaagttcccgcgcatcattcagtggttcacaccctgacactgtgacaacaacaggaggcggtaaaggcaagctgcctggtggcatcagaagttcagcatgaatacgacctgcacctggaccatctggggccactgtcgttgagttgagatcaaaaggcagcaccccatcctggggaagatgaaacgcactagccactgccgatactacccgtgagtcgatgggtggccgcacccaatcatccacttcgacgagaacagttgaacccgcaggtagatctgggactcgttgagcaatgacaaacaaaactggggagcatcagcacttgtaaggtttccctgggcgatagctcgaagtcggggaatgtcctctgccttaatcaagtcgtgagcaccgtgatccagacgatcctcaacaaattccagtagcctgtgaatattggctgactgctcacaaggtactctaataatcatggtaggaagtgtaggtgacatttccgcaactgcacgaacgtcagcaaggccattaatgtggtgaggcgccattggcgcacacaatctgcagatcaaattaaattcagttagctctcataatctaggagaattaaacacactgttactacagaatggcattgtatgcaatcaatgaacatgtaatgcatgtaaactgagcagagtgccacagagttatgccagggctacaatgtcacaatgataaatgattcgttcaaggcactatctaagtagttaaaggcagcaaatcaatagtactcttcaagtaggaatccaaggatggtgagaagtatcaagtacctagcaggccactttctgggaggatcaagtgatagatttcagcacattattcagaggatttggagaaaaatataaaccaaggagccaggaatcctaattcaagagctatcttgaatgtccatcaagcaccaaatgttggggctagtaagcaatgggaaaaaaacaaatagatatggaccagcaactagttactacataactaattagacacaatacaatacatcagagctagctcaacacattttattaacttgcttggtgcacggaaaaacagggatga

SEQ ID NO: 54894 - DNA, 1501 bp, Oryza sativa
actaagtatgaaaagaagcataatatctagacaatcaagccgttgattgagttttcagggtggtagatgtctaagctaatctaatctagcaacgcgatttagccgataccggcagaaaccctaaaacaagaagcagccgatagagctaaattgatatgctaagactagattaacatagacatatgataaataggtaggcaaatatatcatctaaaccagagcaatccaagaggtcgaatgtactgatgcagccttgaacgacgccgacataaacgatacaattgcctgggctgacagaacattggacttaccccttagccggagatcgaacaccgatgcagccccacgtcaggtgccaagtcctgccggacgataaaataaagtagaaaaggtaaaaggtggcgatgcgccgaattgtattgatcgtgaagatagtttacaatgatcccgggtgtacatatttatacccatggtagatactagtccttgtaggataagaaagaaactttcctaaagataaaaggaaaacataaagtctttataggacactgaacacacttttctaaaaataaaaaggaaactaacaaactattcataattaatagatacaactgccttcttcggacttgatccgtacatggcaatcatcatgaagcacgtcaactcaatcagacaatgattccaatatcaccttgccggaatcggctacatcggcttaccttgttcgattcggtaactgccgatgcacactatagccgatgcggttctgaagccgattcatactctgtttctgttatcgatttcctcccaaatccgcttcagctttaactccaaatccaatgcaaatttaccaaatttggtcgttaacagtactgtgatgtgaaaaaatattaaagatcgtagaaaaattaatccctccgagttaataatacttgtcgttttggacaagggcacggtcttcaaaatgtaactttgacaactattttttattacaaaatatatataaatttcaacaaatatatgattttattgaagtactttttaagactaatctacacatgtggttttcatatttttaagataaatattttagaaattatttgtagtcaaagattttaaagtttgactttatccttatccaaaacgactaatattatcagcccggggggactaatacactttatagttatattttctatgaagataatatgttttcttacacacagggttattttcctattgataaaaattgaatagccagctctttatatttaaaaacatagcattttattctttcttttatattattttaaaatttgtatttattattgaatatatagtcatatccccgtatgcatgcatgtttctgaaaatacaacgtatcgtgtatccgtgtaaaatatcagctgcgacatttcgaatatttaatcgcatatatagacgttgaatgcaacatggcatatacagcaaatttctcattgataggaatttgtcgaataca

SEQ ID NO: 54895 - DNA, 1501 bp, Oryza sativa
aaaattcaaaagaaaaggaaggaaataatgggttgtaggcccaaaaaaggaataattttcatttactttttcaattataatgaatagcgatcctaatgtttcttcattgctagcggttgtactactcaaaaaacgtttttgccccgatgcaatgcacgagtatttttttctagtatatctatatatctatatatctgtatacctatatgcctaataaaaaaatacgcaaggtttccggttttttttccgtctcttttttcgccttttttttatgtcccattagttcttttccatgtgaaacagtttttttcaggctcactttttttatccggcttttttcatcgtcatttttttctgctctcaatccgatcctatcgtcttttcttattgctctttagtccgatccgcacatgggcaaagcccctccagccgccgccacgatgttcattcatccgtacgtttcctcattcaatttactgcgaaaatcgattttctaaccttgttatattcctctttccatttggttttaattcgttggatttaatcccgaccgattgattttgaaaaaaaccttgttatattcctcatgatttcctctttccatttggttttaattcattggatttaataccgaccggttgattttgaaaaaaacagaaaaaggagatcgagtagatcaaaagccctcaaccaatttcggggagatcgagaaagattcagctggatttgctcctcggcgtcatgcgtggcatcttctagaggttgaagatgcagtcggttatgcaagctagatttgtttatgggccggaccaaggagagacaaaccgagcgaagggatgtatcgaactgggatagggctgaaaaataaggaagtttttctcaggcttccttttttttatccggttttcttcattgccgttttttctgctctcaatccgatccgatcgccttttcttattgctctcagtccgatccgctccacacgggcaaagcctctccagccgccgccacgatgttgattcgtctgtacgtttcctctttcaattgattgcgaaaatctattttctaaccttgttatattcctcatgatttcctctttccattcatttttaattcgttgtattcaatcccgaccggttgattttgaaaaaaatagaaaaaggagatcgaatagatcaaaagccctcaaccaattttaggagatcgagaaagattcagctggatttgatgccgaggatcggctccggcatcattgtaggatcgaggattcagctggatttgatgccgaggatcggctccagcatcattgtaggatcaaggaggccgactagaggggggtgaataggcggttttaaaacttaatggcacttcaacaaaactaacctaagttgctaggcaaggtgaggtacaaggttaactaagcaactaagttaagttttgcaaacctaagtgatatgggctcaaatatgtctctatgaatgtaaatttgctcaaatgtaaa

SEQ ID NO: 54896 - DNA, 1501 bp, Oryza sativa
gaaagattgagaaattaacccaatcctaccctattgtactattgtactgcttccttgccagcttgaactgaatcgaaactataattccacgagcgtaatttctactccctccgtcccaaaaagactcaattcctaagtttccgtatccaacgtttaattatccgttttatatgaaatttttttataattagtatttttatcgttgttaaatgataaaacatgaataatactttatacgtgatttatctttttaattttttttataatttttttaaataagatgaacggttaaaggtcgtaactatcgatctgagacacgtccccatgatcgtccatccgtgcgctcgtgcgtacgagattggaagtgcttttgtttttttattatctataccttttttttataagaattacacagtacaacgcagacattgacaacatacgtgcactcacccctataaatgcacgcacgcaaaccgtacccctagcatcttcgaagactgggccggcaagtccttgagagacaacgcacgcacactcacccctatgaacgcacgcacgcaaacactacccctagcatcttcgaaaagactgggccggcaaatccttgagagtttgacgaagtcatcataggcacctcgctatcgaggggtacgtcgcccaccactgaaagcacaacgccgttaaatcctggaaaattcgctcccattgggagtcgaacccaggacctcaagtgctaataaggctcttgtaaccactaggctacatgccatttcgcttttattatctatatctaataaaaaatacctaagactttcggtttaatttcggtaaatctgtttttttttgttttttttccgattagtttttctcttacgtggaagttttttttttgggctttcggtttttttttctgactgaaaaaatacccgtgcgttgcaacgggtaaaaatatttttggatcgttatatattttactctttggttttggaccaaaagctcatttcattccttgtcaagtggagttgtatgtcctgctcgcatagctgactgtcctcttcaatcttcaaagacaatgttgtgtccgtacatgccaaaaccgatacccgtcaaatccggtccaatcttttacgatctttcaaaattggttgagggtttttgatacacttttttttataacaggcattcataatacccggcttttaaacaaagccaaagataacagaggtcttacacaacagaacgagaaaaaaaatccgacttaaaagaacaagttaacactggagcataggatcactgcagaggcccatcaatcagataaaaaacacacccacgaaacaccctaaaacaagacacctaacatgctaaaccaaaacccaaccccttagccaagatccagatcatccggcaacctccctagcgggcgtagttgtttttgatacacttgatctcctctatccgtttttattaaaatcgaagtgataaaactcgggataaaaacggt

SEQ ID NO: 54897 - DNA, 1501 bp, Oryza sativa
acgcatgcatgtcttttcacttatagcatgtctttgctcaccctcatctaattagcattaattgatatgtactacattgttcatatctatacttgatatatgacatgagtgttttattgaatatatgtatagattattatccaactagtagacatataccatgcctttgttaattgttgagttcgtttggaagacacagccaggaaataaaatgactattgttcattgacatttttaatatgcaaaacaacattttttaaaacttgaaaggatatatcagcagattattatctaacttaaagttaattatataacttgttttgctaacttgtttagtttgttttgcagatttgactgagaaaaaatgattattgttctagtgtatgttgatgggagaatacaatatggagctaagggtgcagaatataatattcctccaaaaataacttttccggcagtggaggctacaacctttgaggaagtcaaaaaagaaatttttcaggcccttggatacactgaggatcattgtgcaatgaatatccaagctcggtttgatatcggaaatcctggaccacaatattttcaattgattcctatttatgaagacaggggatggaggatgatatttgagaagacatgtgggtaggttgttgagctttatgttgaatgcgcctatacggaagcaagattaagtcaggttaatagtacaaccttggttgcatcaactaggcattcggaaagggatggctcaggtgttttgttggagccaggtacagttcattcacaagcaaaggttgtacccactttagtagatggtctgcattcaacaacagttcagttgtcttcacctatcaaccaggataacctatcaaccaggataatgtggtttccaaaacacaaccaactatagatgatgacaatactgcagaagacacatatgttggtgaggatagatttggactggacgatgacaacgagcaggattgtgatggtgcccttgataatagtttagatgatgagccaccagaaccacgagttgttcattctgtcaatgcatttccttttatgcgtgcatctggacaaaatcctataaaagcatttagtgatatatctatattgagggagacaacagcagacgagagtttctttggacgtaagaatcaattttctaacccactagcagaaggaaagtcttttgattcaaaaaagcacctacaaattgctataggtgagtttcatatatgtaaaaattcagaaatcaagtacaacacaagtagtcaatctaaacttgtagctgaatgcacggataatagctgcatgtggaggctctatgcaactcccacaaagataggttcaggttggatgataaggaaatgtccatatgctcacacctgttgagcaccggctgatagatttgatcatgctcagttatcatcttctatgattgctaatgtgatacgtgatgcattaagggatgatctggaattgagtataaaaaatg

SEQ ID NO: 54898 - DNA, 212 bp, Oryza sativa
gcacgcaaaaataagcttatttttacaggcagacctctcaagagaccgcatgcaaaaatagattttcgcatgcaggcatcttaagagcaccgcacgcaaaaataccctcccccctcaggcatttttccctctcaaccacttcaaaaatttctatcttatcctctccaactactcatccttatcctcatttcttctatctctctcatctctca

SEQ ID NO: 54899 - DNA, 1501 bp, Oryza sativa
tgaagttttctttcgctctcatgaagttactctactaatgagatgtatatggttgacaacttggcatgcattttccagtttcacaacaatatgttcattatttaaggtccgcttgcaaccttataagggctctcgtatagaaaaaaagtcatttttatagtagtgtcataaccggggagaaatatatactactaacactataccaaaatataacaacttttagccgtgaatctatagataagtatttgtacggatttgtagctaagacttatttaattttagaatggagaaagtacctctgtatttaaatatacaatgtcctaggtattatttgtctttggcatacaattttaaccactacatgtattattagaacatggcgataatatccaacaaaactatatattatagaagtatttataaaaaaaattgaccaaaaatgacttatatgtttgcaagctaaagattttgagagctattgaaggtaaaaattgtaaaattttgaccaaataaagttaatagtgttatattttaaatatggaggggtactttcttttatatcgttaatttttcacaacgatgatcatgaactcttctattttgatctttggaccataaggaataattactccttccaatttggagatatttaaccatttgccatatttagatgtgacaattaactttttgccattggacccacatgtcatagacacatgtggatccacatgtcattgagataggggtggcaaatagttatttgctaaatctaaaagtggcaaatagttaaaagcccctctaatttgtcctctccagggattatatcagatcatgagagcctcttaacgtctgtttttttccctcaaacacacagtaaagttaagcttcatttcgttaagaaaataagagaaagtaaagaggaaaggtcaaactcaaagaaacctctaaaaaaacaaccataacacttctacaaacacgccagaccagtagaactagaccactatgatcagcacattaccaactagattaagcatctagggcgagcgactgaagaaagagctcatgcagtacatcatgtacagaagctccagcccaataccataagctacactcataagagctcctccactgcaatgataacacaatcacacccatcaacaatttcttaaaaggtaaggcacacacataagaaaaagcatgaactagaacatgaaattaccttccagactaagggaggaagagaaaaccaacctaggatacaatgttaatgtggcacctctgcatttcttgatgtgtcccagtcctagtcctgtatgtctatcagttctctttctcattgcaagttaatccaatttttaggtatcacaaaaaataagcttggaaggtgcacactagctattaagccaacatatatatgcacaaaatttccatctcttccttccctcaagtaagctgatttcttttttttttctgaaatcctaagcaagcatctcctttcttc

SEQ ID NO: 54900 - DNA, 1501 bp, Oryza sativa
gcgagggacagaggatggcgacaaggaaggggactgtgcagcaagggaatgatagaagttcaggtaaccattatatatgggtctcatcgtgtgaaggaagatgaatattgggtcatcaggtaggcggccatgggactctcaagtcatggctcgagagtagaagagaatgaggaagggaaaaaggacaaaccgtgtgtgatcacgcgtttcacgcagcggcgcatgaattaaaatcccctggctcatgttgacatagtaactactactaactcaggaccaattttttaattaataataaataatattatttaaattaaattattagtaattagaggataacatttaccaaaataagatggacactaatagaaacagcgtccagatgtggacgctattaccattaacgtacagatgtggacgccaattggatcgacgtccaggttggtgcggtcataacctggcgctaatcatcgcgattagaaaaaagaaaaaagaaaaatcccccaacgctagggcagggtgcctctgccgccgtccaaatcgacgccgggagtctgccgccgccgccggcgtccgcctcaacctctggagtctgttcctccttctaactgagcgtagggactacccacgaggcaaatggcgcggcagcgctaaggcagggggctgccgccgccgccgccgccgtcgtccacctcgatgccgggagtccgccgtcgccgtccaccaccaccggaagaccacgccaccgcctgaatcgacttttgaagttctgagaggtggctgccgtcagccgcttccatccgtagcttgctgtcttccctggaggctgcagctgttgtctgcctcgactcctgccaagtgctgtcatctgttctcatcttggaagcttgcagccaccattgacgtccaagcccagaactcctacagtcaaggtgattcaactaacttattttgttgtagcctatttaataaacattttgggacacaatttatggatggtaattacaggagatggagaatcaagaaccggcttcacaacttctaaaaaaaaaagaaccggcttcaaaaatataacataggttcatcctgataagtctaatgtataatagagatctttataaaatatatgtcaactgcatcagagttgtcattggagttccaacttcggaactggaattacatttattcacacagtagaattgaaatactaatttagcttattgattgttaacattttgtgcagctaaaaaatggctgatagtgatcggttcagtgatttactatggatgcctcatgggcagcacaaagtatctaaaatttcagaaaatgtgagttgtctacttagtttggtttcttgtcgatttgtaaatatattcatctaggttcccatgagtaattgtttttatctttgatgtagcctagtagttcaatgaatatacggcaccatcgcgttggaatcccttaccacccattgtgccgatcggctcaacaaaatattagt

SEQ ID NO: 54901 - DNA, 1501 bp, Oryza sativa
tctgagaaaatggattatatttgttgcttttttttcttttgtttcatgattttgaatgaaattttggtccaattcaaaatttagtttgaaaccctttgacaaatttctccaagatttcactatctcggacctggacgttttgtttttagaacaatagtgttatctagggttaaaaattccaaaatttcggttctatcagaccacccccccgtatggtattattgcagccggttttctttttttacgaatttggcaatatttttgttcaaatttaaccaaattttgttcaaaattcaaataatttcggtatatcggcgccaccaatacaaatgccgaaaaaaaaatattgaacccggtgttatccacggtgaacagaatgatctttttaatttcagcaaataaccagcttgtgcaaccgcaattctctcttgggcagccgtcgtgggatcagacctcacacagtcacattgtcgcacacatggaacgacacctcttctgctcaaattggtgcttgggacatcccgaaacacatgaaaactctgatgcagtgtctcgtttttcgcctctcactgtcactgggttggccagcagcctgcgcgctgctacgggtcatggaaatctgatggctccgacaggtaagattggtgccatccctcgacagattcgtgagctcatcttgggcatggcactcgagaccccgccttgagtccccactctgaccaaattctgttgacaaatgggaagggagagcacatagcaatctcccaatgcttcccatgcttacattcagcacgaccaaaagagaagaaaaaaaaggaatacttggtttatgagaattgtgagatgtgaataaagtattgtaatctagaacgaatggcaggaatggtgagatgcctataggtatcatattcgcatacatatgtgtatatataactcaatgtgtttatgatatctaacccaaaatattcggtccagtaaatgaccaccttgaaagctgcaaatattcaaccacttgtactttctgcactttataactatattttgtgtattggagtgtggaaaagaaaaggcataagagacatgggcccattaactgagacactcaaactaagcgtttgtgtaagtcacaaaagagcatagggtactactctgtttacatggagaatgaattactgaagattttgtcaaacagttatgcatatcaaattgattgacaacaacagaaccaaacacatcctgagaacaaatatttccagttccatctaatccagatcttggcttcttgttgtgtcttatttcgtggaggaagggaaagaccccaaatccaagtgctgagacctctcatgtactgctatcatgtagggagtagcatacaatttacagatactgttgtgttccaagaaggaaaaatttattgtaccttcctcttcctgtcatactatatactgtactgtagttaccactaattaatcctaatatgtttagtcaatgttactctctc

SEQ ID NO: 54902 - DNA, 1501 bp, Oryza sativa
cctgttagcacatgaaaccttgactctcgctcagagttctcggtgcctcccttttctagctactgtgtgacttcgcgcgcgtgtactgtctacctacattagatgcatgatggtattaggtgtcctcatcttcacattctttgctgatttttcatgcaccttctactggagagatagagaaacttgttattccgaagccttagctagatgagaggaatgtggtggtttattgatcgcgcgaggaataatgagtacatctatggcatgtgctatatcgatatgaccttccgcatgtatatacatttggctcgtagtttggtcgttgtgctaatgttaaaatcagaactagaccagctgggcggtgaggtacaaattaaaacgttatattgatactgttttgatgacggcacatggcgattgatagcaacgggatgcccgatattccgttaggtaaagataactctcgatttggtggaaacttgaaacatatgatctgaaccctacaatcgtagaatcacgtttcctctggttattaactatgccgaaacttgattgacctcgccgagaaggctaatccctacgtgcgaatcgaaaaacacaagaaaaacaagatggattgcaactcaatttgcagataaatgattgagttatcaaagatagggttccacataccgaacttgtggccaaactgcaatgatagaaataagggataagtccattttgcaccctccaactcttcgcttagtctaaaatacaccctcaaacttcaaaaccaggtatttagcatccttgaactttttttttcttgacttaaggcatacctgaactttcaacacccattcattttaccccctcgagtggttttcagctggtattcacctgtgtggcgctgatgtggtggtctaatcagcaaataaaaacaaaaataagggatagacatctcttcttcttcctccatcttccatcccctttctctccttcctctttctctctctatccttcttcctcctacgctagaagagcagcagtggtggcgtccctgttaacatccctgagctcgacgaggagagcagtggcggtggaccaaggggttcattgcgaaggtgggaggtttttccttgtacgccattaagaaaaatggtgtctgcctctgtgccactaaaaaattcgagcccccctctataccatcgtcaaactttatcgtctcctccacaccattccgtcgctattctgtttcggtttaaccatttggcagctctgacatgtgggcctgggaaggaaaaatatcaatcttgccctttcactctctcttctccctcgattccctttttctccctcaggccgccaccacgcagggcctaccggcggccggccaccgcccagccctcggtctggtcgtcgtcgtcgtcgtgatcctcgtcgtcggtgcgctgttccccatcctcggcccgaccggctcctccagcttcgccatgccgcggatccggtggagttcaacgaa

SEQ ID NO: 54903 - DNA, 1501 bp, Oryza sativa
ctccaccgcgccattgttgccaccccgccctgcagtcgccctcgctgtccgtcgccgaagcaccagggagaccggtgcgtgcgtggatgcgtgacgcgggactccgggcaccctctccttccccttccccggcccgaggccagagagctcgccccgcaccgccgccgcccatcactacgcccggctcggtagtacctccctccgttctccttcctcgttctccctcgccctctctagcttgcatgatagctcggttagcccctcgaacgcgcgtagacgccgccccgagctctgccgccgctcggcatggccttgccaccgtcagcgcctgctcccggaggccgcctctcgtcgccggacctccacggcgcctccccaccctatccgattacaggaacgaaacccttgagccccggagatgctcccgccgcctttaattgagtccttgtcgcccctcggtgatttcccctttctctcgccgccggccgccgctgtcgaattccaccgccgttgaacaccctccggcgaatccgagccgttggctcgctccttctcgacgccctcgtcactccggtgtgctcctcgaagaccaaacccgtcgcgcttgctccggtgaacacggccgccgtccgccgtccatctcggcctccccttcttcctccacccgccggcctgcgtggctgccacgtaggcgccacgtcggcgccacctcggcattgaccgagccgagccggtcagctgcctcctccctcccccccctcgcgcgcgcggcccacggtgcgccaaccggctgcgcgtgggcccgccgcatccctggtccatccggtgcacgcgcgtgaaccgcgctcacccgaaaccctagcgccaccctcatgcgccgctcccacggtgagccgcgccaccgacaagcgggccccactcgggaccccgcaaggtggactcggcccgccggccctctctctccctcactctccccgcgcccccttgggccgcctctccgggccggccggcccattagttcggccgagccatgcctctcctcttgggccgcacccaagccgcccgaggaagtctaaatcatatccctctttcaatttctttccaaaaagggtttaataaattattaaatcctttttcctttagacagaaattccttaatccttagaaaatccatatcttctcaaccgctcatccgattgactccgttcaacttccaataattccgtaaaattgagatctatctaatggtactattatgtagtctaaataggatctttattttgggtcttgtgtaggtttttaattgtttgcgtatagttgcagttaccggattttcgtcgatcgcgggttttctcgaagattcgtgaagcttcgtgaagaccttgagcaaggcaagcaccctttgaccaattgctcctataattggaaaatcattattaatttgtttgcaactcgcattattagcaacacacatttatagcatgcttggtttcggtttgcg

SEQ ID NO: 54904 - DNA, 1501 bp, Oryza sativa
cagagtccagctgcccagcagcaaagcaatccgcttccactcgggaagcctagtctatgatgcccacagacatcccgaatcacacagattcgtttctgaccactcaggtcatccatctgccacttaggctgattctggttacgattcccaatccacaacaactgttcacaaagcacaggcaaacaaatctacgcaacgggaaccacctcacatccgcccatgaccgtgggcacggctgtttgaacagttagttaacctctgcagaggggtgcactttacccacaagacacgaacttactccagacactggccggtgtcagaggtttgcgacaaagcctttccaaagctaaatttgggtcacctcatgccacatagagggtctccctgaccaacatcgggccaactccggctttccttttaggactcccggatgccttcctctgtttcggactcccaggatgcctctacccccacatcccggctttccgcctctattgacatacaagattttccaaaagcagctaattacttagccagggtgtcccataccaccatgtggttgcacttgttatgcttgatgaatttcccaaaggaatcggtccttatatgcgaatacgggacagtgccaccaaggcacagcacccgcatcgcgagctttcacaattcattttattttcaaacacgccgacaccacatgtcgggttttaaaggcttctcaaacccatttcccagattatcgacaaacaacggtgtatgtggaatagttggtatacgcgctcagagagcacggataccgaagtaccacaaaggtggagcgacaaggaatcagggtagtacagcctacaggaattagtgcgactactaggtaggtccgtcggtttggcacgcaaaccgaaaccaagcatgctataaatgtgtgttgctaataatgcgagttgcaaacaaattaataatgattttccaattataggagcaattggtcaaagggtgcttgccttgctcaaggtcttcacgaagcttcacgaatcttcgagaaaacccgcgatcgacgaaaatccggtaactgcaactatacgcaaacaattaaaaacctacacaagacccaaaataaagatcctatttagactacataatagtaccattagatagatctcaattttacggaattattggaagttgaacggagtcaatcggatgagcggttgagaagatatggattttctaaggattaaggaatttctgtctaaaggaaaaaggatttaataatttattaaaccctttttggaaagaaattgaaagagggatatgatttagacttcctcgggcggcttgggtgcggcccaagaggagaggcatggctcggccgaactaatgggccggccggcccggagaggcggcccaagggggcgcggggagagtgagggagagagagggccggcgggccgagtccaccttgcggggtcccgagtggggcccgcttgtcggtggcgcggctcaccgt

SEQ ID NO: 54905 - DNA, 1501 bp, Oryza sativa
ccaagggcctgaaaaatttcttttttgacttcctcaaaggttgtagcctccactgccggaaaagttatttttggaggaatattatattctgcacccttagctccatattgtattctcccatcaacatacactagaacaataatcattttttctcagtcaaatctgcaaaacaaactaaacaagttagcaaaacaagttatataattaactttaagttagataataatctgctgatatatcctttcaagttttaaaaaatgttgttttgcatattaaaaatgtcaatgaacaatagtcattttatttcctggctgtgtcttccaaacgaactcaacaattaacaaaggcatggtatatgtctactagttggataataatctatacatatattcaataaaacactcatgtcatatatcaagtatagatatgaacaatgtagtacatatcaattaatgctaattagatgagggtgagcaaagacatgctataagtgaaaagacatgcatgcgtgatataaattgcagggcaaacctgttgctcacgacgagagagctgccaatgcacacggcgccgtggctggattgcaggattggtggcgccgtaaaacacggacaaatcgaaggccccggcgtcgacgacgagagtggcttggacgacaaagcggatggatcaaagtcgtagagagggtgaactcgtatatgagttacgacgatgtgtggccggctgccggcatgcgcgatcgagcgctcatcgctagagttagggttttcttttgattgtcaaggttttcttttgattgttctcactctattcgtggcttggctgcaccagggaggtggacgttggttccaacagcgtccaagtatggacgttgtttacaacggcgtccaattctggatgctttctgtattagcgtccatcctactcctgtaaatccccccaacgatttactaattatttaatttaagggtaattgtttattataaataaaaaattcggaactcaggatggtggtgatcatgcgggtaagcattcgcaatctaagaagcaagcaagagaagttaggagcttatggttcttccacacttagaattgaactatcatcattactttcacccttattttgttgggattctcctgatctatttttagatgttctcattgccgcctcctttgtttgcacacaccccaacaacaaccacaacgcgctatggcgcctcctatggatagcgcaatgtctctcacgagctcccccattgccgcccctttctcttcctccttccttccacctcaccccaaccccaaccccaaccctggccccgtcccgcgcgtacggaggaggggcccatgcatgcatgcgggtgaggtgacaaggacgcggccacggggatcaccggcgcaccgaccgggatgttgaaggtgaggtggttgccgttcaagaagacccatctcgcccgcagcaacgcctccgacgcgtcctcccccacctccgccgccgccg

SEQ ID NO: 54906 - DNA, 187 bp, Oryza sativa
tgtgtgtgtgtgtgtgtgagtgtgtgtgtgagtgtgtgtcctctatcctacctgtaggcagattcaatttcagctcagctataggagtatgatactccaattactcatacactgtttgcaagcaagtagatcaagttgcattgatgatcatatatcagtctaacttaaatttgtcatgattttcagg

SEQ ID NO: 54907 - DNA, 1501 bp, Oryza sativa
tttataggtgtaaatcaccgtgacagctaatacacgcgcctttttctctctttttttcacaagctaccgcgcgccgtttctttacgtccgcattttttccatttctttttttttcacaagctaccgcgcgccgtttctttacgtacgcattttttccatttctttttgccatatttttcgcgtttttttatttgagaagttgaatctttcatcttcaattttatttgaaagttttgaatttgagttgaaatttttaagatttgagttgaattgttgaattttgagatgaaagttttcaaatttgagttaaatgttttaaattttcagatgaaagtttttaaatctaagttgaaagttttcaaatatctggttaaaagtttttaaatccgagttgaatattttcaaatctcgagttgaaaattttcaaatttgagtaaaaagttttcaaacctgggttgaaagtttttaaatctggagtgaaagattttaaatctgggttgaaagtttcaaatctgaattgaaagtttttcaaatctgagttaaaaattctatttatgtattatttttctaaaaactaatactaaccattatcattaacgctaatgaatgtcatcaacgctaattagcgttattagcggagaggccgagagagggcgcgtgcgcagctgcgccagttagcctgatagcgcgcgcacccattaggaatccatgtaaatcacatcatacgttatgcccaaagtagggccatgtttggatcctaggcatttgaattgttggagttaggccctgtttagttcccaaacaaaaactttttaccttgtcacatcgaatgtttggccacatgtatgtagtattaaatatagacaaaaaaaaaaactaacaaaaactttttaccttgtcacatcgaatgtttggccacatgtatgcagtattaaatatagacaaaaaaaaaactaactacacagatagcgtgtaaaattgtgagacaaatcttttaagcctaattgcaccataatttgataatatggtgctacagtaaatatttgctaattatggattaattaggcttaataaattcgtctcacagtttacaggtgtaatttttgttattagactacgtttaatacttcaaatatgtgtccgtatatccgatgtgacacgtaaaaacttttcacccctgaattaaaccaggctttaatcgcataattttattcaagtccaatgttttcgttcgggacagaaattaatctagaatttgattcaagggtgtgtctgcctgtctgggtcaatgccatagtctcaaccatgccccccaaaaataatactccctccgtcccaaaataagtgcagttttgcactgttcatgttcaacgtttgaccgttcgtcttatttaaaattttttttatgattagtatttttattgctattagatgataaaacatgaataatattttgtgtgactaaatatttttaaattttttataaatttttcaaataaga

SEQ ID NO: 54908 - DNA, 1501 bp, Oryza sativa
atgacaggtaattacaagttactactccctccatttcatattataaatcgtttgtttttttcttggtcaaaattcttttgatttgagtaagtttatagtaaaattagtaacatttacaacaccaaattaattttattaaatttaatattgaatatattttgataatttgtttgttttatactggaaatgttagtatatttttttctacatattaacttagttaaatttaaacaagtttgattaagaaaaaaatcatacgacttgtaatatattacaaacggaataagtagttgctaaataatgtctgagcagcagttgaattatttgtggggtttggcttttaaggttagcttcagagagaagcccaaaattacagtgataatattctcattattttatgaacctgcaggcatctcatgtaatgctaggtactgagagttgagagagttagctgatccatctttctcattcactggagaattgtgtctcccctgttatcaacatcaatattacagtgttcaccgcagtcctaatttttttagagcgatagatatatcactgtagtgtgtattgtcaattcttttcaaaaattttcataaccatatttccgatgcatttgagagaaaattgtataagggaaagcagcatcctctcgggcgatataatccatcttgttttgagggctatattttactctgctttcttggtagccctgttacctaccaaaccttctccaattatgtattcgaattgtcccatacaagttaaagctacacacacttttttctgtaaattggcaagttgtaactttgccccctccctaatacaaggatatgcaagacttatgcgtattctcgaaaataatagtgtaagttaatttcgaattttatgtgttttcacaagaagttccattcggattcagtgtaccacatcttcgctccaaatttatttgggctgtacaaattccacctgaatttggcgttccctacaaaatatatttcatgttccgagtttttctaaagtagcttcaatttcatctttttataaatccatatgcagtacagtacgttcggttatggttaattttacaaccccaaaataaagaccatcaccaatccaccatgatcaatctagatcgtgtagagcccttcttttttatatatatattagacactaatattagttgcaaaaatataaaccaatattaaattacattactctgctttatactctatcctttttcaatgtatgatattgttgactttttaaaatacgtttaaccattcaacattaaaacattttatataattattatttattttattgtaacttgatttatcattgaatgttcttttagcatgatttaaatattttatatttgttcaaaaattttaaataagacaaatggtcaaacgttgtttaaaaaattaacggcatcaaattttttctacaatttcaaatattttcaataactctgcttcattttcttaaatcaggggaa

SEQ ID NO: 54909 - DNA, 1501 bp, Oryza sativa
tgacatgtatgggaggctcaatgtcatcgtggatgatctcaaggggcttggggcaacctacaccgatggagatggaggaagcctcaccatccaagaaggagatggaggaagcctcaccatccaagaagtgcattgctctccaagccgaagttgaagacaagggcaagagcaaggtgaatgaagtcaatgatgacttggaggaagagattgcccttcttgctagaaggttcaataatctcttaggaagaagaaaggagagaggaaggggctccaactccaataagagaagaaataaaagacccaacaagactctctctaacttgaggtgctttgagtgtggtgagaagggatactttgcttccaagtgcccttccaaggataatgatggagacaagtcatccaaaaagaagagtggaggttacaagctcatgaagaagctcaagaaggaagggaagaagattgaggccttcatcggggaatggaactcaaatgaggagagctccgcctcatccgggtccgaagaagaaggtggtgatgatgcaagctccaagaagaagaagatggccgttgtagccatcaaggaggctccatcactcttcgctccactttgtctcatggctaagggctcttctaaggtagcatctcttagtgatagtgagagtgacgatgattgtgatgatgtttcctatgatgagcttgtgagtatgtttgagaagctccatgcgtatagtgaaaaggagattgtcaagtttaaggccctagagaaggatcatgcttctttggaggtcttgtatgaggagctaaagacttctcatgagagactcaccatttcttatgagaagattaaggaagctcatgataacctcctttccactactcaacatggagctcacattgatgttggcatatcttgtgacttgcttgatgatagtgcttctagtcatattcctcatgttgcatcatctagcatttctacctcttgtgatgatcttatggatatgcctagctctagctatagctcttgtgtttctatttgtgatgcctcacttgttgttgagaacaatgagcttaaggagcaagtggccaagctcaacaagagtttggagaggtgcttcaagggtaagaacactcttgacaagattttcagtgagcaacggtgcatccttaacaataagggacttggatacattccaaagaagggtaagaaaccttctcaccgtgtcactcgttttgtcaagagcaacggtaagtattgctccaagtgtcatgaggttgggcatttggtgaatgattgccccggtagtaagccttccaagacatgcatgtttgattctcattatatgcttaagaaggctcatgatggtagtattgttgctagatatgtgggttcccctatacttggtggtaaaaagaatgccatttgggtgcccaaagctttggtctctaacctccaaggacccaaacaagtttgggtacctaaaagagcttgattttctcttgt

SEQ ID NO: 54910 - DNA, 1501 bp, Oryza sativa
agggctcatttgcaaaagcagcatttagcaaacaatttgagaattctaaaacgatagagtaattaatcatcaatattaatcaatcatttaaaagcacactcatgctgcacaggcccaaccatcctgaacaaccgtacccggctgcacagatctatctccaaaccaggaatgtaccattccaaaccaggagctaaattaattaccatcaattaccacattattattaatgagtagtgtgggactaatcacgaaagacattgttcgacccgcccataaccgcgggcacggctattcgaatagttttactctggccagaggtgtaccactgtacccacaagacacaacccaccgtcatgtcaccatgtccgtgcagacacgtcaccatggcgagtgattgtgacaagacccctcgcataactcaactcaaagcagtgcaccgttcctggatcataatcacccccttataaaacaaggcatggattccccagcgatcaccgtgggcttatttccgccacttctcagtctggtgctccgcaatgagccttgttatacaaagtgtccagccgttgtccattctggcttgtggttggcatggttaatgtttcacaaccgaaactcgtgaaccggtccttaattgtcatgagcacgaccatcaaaaccatgtgctcacaacccacctttatcaagttttagttggcaaattaattaattaaccaatcacgattagccatcgtgagctatcattaaatatccatcattaagtaatagtaaaacattagttatcctaattgtgtgctaatgtttctaagcatggctaagcaattatatctaatatatctagttgaaccaatatataaatccaactagtcaaattataataacccaaggtatcaaggaatagagtaatcaatgcaaattggccatactaaggaataattcacaccacccggtgacattcgaaaataaatgcacagttgaaataaatagagaatttaaatataggatcaacatgctcaaaggaattgtgtttgggatctgtgtgacttgccttgcaatattcggtcttcaattaatcttcttgaacacttccggcgcactcgcgaaccttcgaaacgacggaaacgacaagctaacacgcaaaatgaggaaaaagactaaaataaaccagataaacaatacatataaagtaaacaaacatgcagatcataattttagatgaattatgagacttgaacggcctcattctgacttcatatgaattaattatgaatttttaaagattaaaccggattaaagcatttatatggattttaattgaattatgacgcaataaggaattatttttgaaaaggaaaagagatttattgcgtcatcaaagacgatccacggtaaaccgggttcacagagacggtctacgaaaccaacggccgagatctaatctaagccaaacggacagccgagatcgatccggtccaccacgggtctacggctgacgaagcgc

SEQ ID NO: 54911 - DNA, 1501 bp, Oryza sativa
taatgcacattctgcttggaattctattcgggaatttctgggcgtgaaacctcctcggcttcgtcgtcggccttcccctcgatatcatcgtcgcctacctcgtctacctccgcttcttcgcccctcaccgtcgtctccagatcagtccatcgatcgcctcctttattctcgatccttcccgtgatgtacttaatcctaaccaactaatcaagtcctccatttttttaacgaatcaatgaggcccccaatttcattggatagaggagacgaaaactgtaagaaaggataatgtacgaaaaaaaaacaaaaaccaattataggtagttacgttgtcaactaagtggtgagattttctgtgcccaccaaccccatgtttttgcttcctcctttatcttggctagcagagttggcgccggcaactctttatgctggaaagtcctccagttcctttcgttccatatctcccaattaacaagcaaggttaacgtgcgtagtgccttcttaggtgtttcccgtatgcttacggtggcctcccaccactcatgtaccgtcaaagatatttgccagctagaaggtcttagatggtcattgcctgtccattgcacgatttcattctggattcttcttgtgtatctacattccgctagcaggtggagagctgtctcttgagtctggcgacataaaaggcatgtggatccgttgggccagcctctggttgctagtctgtctaatgtccacactatgttttggagtttcagccaggcaaaggtcttgcacttgcgcggtgcccaaggcctccatatcaatgtgtcaaaattcgacgatgttgttgtacctaggagctgcgccttataggctgaggtggccgtgtattcgccatggttgttgagcttccaggtgatctggtcttcatgttccatgaagtgtacattccgaacggcactccaaacggtgatgagctggtcaatcagatccattgtccatccttcgtttgttggtagagcaaggtcgtgcagccattgatctgctaaagcggcatgtttgagggtcctgctctttttcctagaggtcgcgtggactagtggtgcgacatccttcaatcttctcccttgaagccaagccaactcctagaacttcactttcgctccatctccaatttgtattgttgttgccactgcaaacagtagcttgtcagtttcattacaaggtgtttctgaccccaccaaagccttttccggcgacttctattcgtgcaagagccatcgcaatcaaatagcccttgcgaacttttcaagattcaggataccaagacctcccgaggcagtagggaggcaagtccgaaatggtgatttgtgtgcagccgtgcgcggtctctttgtgctctacgacagcgcccacatcaccgtctcgctccgccgccacagcgtcgacgtcggcaagcaagcaccacgccgtgcgctcgatctgcccgtaatcatcacagacacctcataaagaatat

SEQ ID NO: 54912 - DNA, 1181 bp, Oryza sativa
cccattaatctatatataaaagaaacacttccctaaattttaccatagaacattgtgctttgcatgaaaaccaaatataaacaaacattaaaaccattagatttaggtatatagatggtttaaaccggtgaacctatcaaatctatatataagaaaaacgctttcctaactttgaatatatactatttttctttgcaatgcaaccaaataaaaacaaaatattaaaaatggaaatatatattatggagtaaatttcacaaacccacgtagatatatctatctattatataaaagtccattaaacatcctaaaaagctcctaaactgccacgtgagattccaagaaacagtgcaaagatgacacctaacactctaattaattcctagaaaatctatggaaaaaggagaacatctaaccattggttttatttaatctgatggacctaatattttttttaccatcagataccattagatttatctttagtaaaaaacttaagatcaatctggcggtacgagtccgcccaacacatatacatgcttccatccatacgcatgataagagtctgtgtgattttttccttgctcgcctcccttttttcgatggtaattaagttaaggcttaagggtatataatatcttctatattagtaagttaattttatcatactttcaaagattgcatacacttgcaaatataggtatagataatatatctcatacatattgatcttggtatgttttataaataaataaagaatcttcaatagctgtaaatcttaaattatatattcaatttatgatctgtttgaaccattgtgtttttttaattaaatcaatagtttaatatctataccaaccatatttaattccattgtgtttttttaattaaatcaatagtttaatatctataccaaccatatttaattgctaataaaattattatattttggacccacatccatacgcaaaaaatcctaaaagttctcattacaaatcaaaatatccaacttagttttttaataaaatcaaaataacttataaaccgctaaccttaaccttaattatagcatcaatggacctattgactcacaaccaacttaattatatctctcgacatatatgtggatgctatttacttaattccaatgccctgataaaatatatgatcttcttttaagg

SEQ ID NO: 54913 - DNA, 1501 bp, Oryza sativa
acttttatgtttgatgatgatggaaagagcgaatggtttgaaaataaatgcaaagagttaatcgagtgccaaaaggcttcaccccaacttttgttgacagcaaaagtgacacaagacggatcgtaagttagacatcctgtcctttttgatgctgccttcgcattatggaagaaatacttcggaacttgctactgtttagattctagatgaggctgttcttgtgcaaccagctgcttgttttccttcttgaggaattacagagtgttgtacctcttgtccttgccatgtccacctttctgttatggaagcatagcttttgaactttgatctgttacattctagatgtggctgttgtacatacagctgctacttttccttctgttggcagaatgcatagaatttcactgtatcagtggacggttttttgagttgaacactataatttggtgacaggctgacactgatttagcattttggtatttttgaatgacaggctgatttagcatgatgaaagagagctgtgaatatgccttgctagaaatgtttgcgtctctttttttccttgatcttcaaatgctgtcaatgtatcctagagttttgaaggatgttgcaattaatactgggtactagcaggagcacttttcacgtttgacgatttggttcaaaatatatactcgctccgtttctaaatatttgacaccgttgactttttagcacgtttgatattttcatcttattcaaaaacttttgtaaaatatgtaaaactatatgtatacatataagtatatttaacaatgaatcaaatgataggaaaaaaaattaataattacttaaattttttttgcataagacgaacggtcaaacatatttaaaaaaatcaacggcatcaaatatttagaaacggaacgagtataaaacagcatttgaagtgacataactgaatgttgtcgacaatcagggttcaaaattttctgaggtttttctgaaaatcgtgttgcaacagatgccagggtgctattttagatcagcttacggggcacctcaaggttcagattcttatgtatgaatcaaaaggcttcgttcaaatgatttgtgcacggttggcaccaatgtatatttgatcggagactgtattagcatttgaagtggtaaggggtgtgttattttaagcccgaggacccgtcttcaatccccaacgcgatatcattttttttaaatatattgtctctctctccaaatcttcttttttttaagctcaagctgaatcatgttttttttgggtggttgggcagcgtggcctaaactaatcatgtgcggggtataaactgatttagtaatttagtgttataagtgtcgttatatgtttatgtaaacttgatcaaattttcaacaattttgacttaagaaaagacaaaatgacttgtaatattaagggaagggagtaaattggcatttcgtcacccatgaagggatcttttggaatatagagattctacgtgat

SEQ ID NO: 54914 - DNA, 1501 bp, Oryza sativa
tacgatttcaataaagttgatttcaggtaaagaatatcgtcaaagtgttccttcccaacgatcccttaccactacgacacctagagttgaaatctatcctcatgtccctttacgccgtcctggcaaggcctctgaggaacctaagggaacttcggctggggacgcccagagcggataaggccttgtcagattatgcagagacaaatcaccacgtaagatctggtcatgtaagagttctcaccgtgcgtattaactaagccgtgtaatcggaaattgagttttctaacttcacggctaggggctaggctctgcactttttcaaccaaggcaggtcaagggtccaagagtcttatcccccgagaacaattctccgacgacaaggctgggggctagggagagtgtatggctcaagtgactgatcgaagtcgtagaatgagaaaacactcatacacaatataccaaaagtaagaaaacttagttagatagatttcatttttattttacaaggatttcttacaagtcatgaatacttcaaagtatattacatgctcccttgagatgtttttctacaggatacaaaagctaccaggacggccaacgccaatccatggagcagaaaaccttctcggcaagcaacgccatcgactgcgcaagaccgtcgatctccgcggatgtcctccgagaacaagagaacccttcgcgaaggaactcgaggtgcagaggcgggcggtgatctcggatgcaagccagcacatgtcccccggcgtagcggctcgctcgacgacactcctgcttcagggcctcgtcgatgcgcttgccaatcccttcgagctgtgcgcaggcccccttcatccacgagatataaccagcagcggactcctcgggatctccgcggggaactcggagctccctgcaaacttctaccatggccgtgcaacaactcttaaggtacgagttaaaccacacctcgcgacctcggagagtttccacggcctggtccttcgcccccacgatggtcctttcgagttcggccacctcgagttttgtcttccaatactggattcaacgatctcagttagccaacgcgttcttgaaatctgcccaacacggaaaggactaagtcaagctactcttctctttcgagaacacggctaattaagtcaatccaaacacgaggagcgaagaaaatcaagacacaaacctaaggacgtcatcgccatatttgtctccgtggatgggctttgaccgatttccacctccggcacatgcggctcaagcgtgagcgccggaacgactaccggcgtatcgggctgcccgcgctgctggacatcctcgacatcaacatatctacaatgacaaaggtactcgggatcacatgctaaggaaacaagggaaacgactcgttaaataaaagcagttcggacctacagaaagttttacagcatgttgattaaggagtatagaggaaaatgaaaatcctactctattccttgataccttg

SEQ ID NO: 54915 - DNA, 364 bp, Oryza sativa
attggctgagcttcttgataagatctctcgtgctatcatatatgggccggcttcttattattaggagtatttaaggttgctttcttcactacactttcctagctaacttctactctttcgtttttcacgcgcacgaatttcaaattgctaaacagtgtgctttacaaaaatttataaaaaagttgctttaaaaattatataatctaattttcaagttttttttaatctatacttaattaatttttaatcatatactaacatgttgttacgtaccgaatggttactataacccaaaccaacacggcctaaaaaattttgttagtggattataacagtacatatgggagaaaaaaaaattaaaaca

SEQ ID NO: 54916 - DNA, 443 bp, Oryza sativa
ctctctctcaagaaaaagttaatcgccggctaaatttattaagatttgcaaggccgtgtggagcaaggcacaaggccgtcactcttcacatgctttcatcaaaacaccaagattacatcacctgcttcatggcgtcgcctgccgtttacggtgtgcacccttgtcatcggtttccatgatcatctcatatattctctcatctactggctgcttgatttcgattatattgagttgcttcctcttgtttgatttttgcattgatcgatcggtggtccctgcagtgattgccacgatcatcttcgttgtggcgttcgcggcgttgctggtcaaggtgtaccggggcgccgagagctgcggcgccgcggtggccgccgagatgaaggcgacggcgcactacgccgtggtgcccgacgccgcgatgcggagcgcgacggtggagaggt

SEQ ID NO: 54917 - DNA, 380 bp, Oryza sativa
accctgactcccctagggcgactgggctgtttttttctcgttgggccgtccgtcgccgggatgggccaaattcttgggtgttcccagacaacccattggaacggaaaaagtacaccgaaggtccctcaccttgtcgtcgggattaaaaaacatcctcgaacctcaaaaccagatatgtggggtctcttaactatacaaaaccggtcacccgagatccttcggtggttttgaccccggttttggtctacgtggcgctgagtcagcgtgggacccacgtggaccccacatgccaggtgtccacgtcaccctctctttcccctcttctctcccttcctcatctctctctcactctctctctctctctctcacttctctgcagc

SEQ ID NO: 54918 - DNA, 1501 bp, Oryza sativa
gcaaacagcctatcggataatctgatagaaatgtcggataatccgtattcgctggattttagagataccatatcctcatccgtatccgcattgtactatccgcatccgcatccatatccgccatatttctaaagcacataccatatcctcatttcggacggattcggagcggaacgaatcgatccgttttcacccctagttccactagtcgaataaaaatgtttcacctattagatcgaaaatgtttcaatcccttaaaatgttgaaacacatttgaaataagactgaatcattttggtgcaacatatgaaacatcgaatatccccctactgaaacaccaacaaataaatatcaaccaaggacaaagatatgaaacaccatcaaaatcccatcgcaacatttcaatccaatacaaaagaacatcaaattacaatatataaacaacagtttcaaatatattgaaacatgaaacacatctgagtatatcaaaaaaataatgaaacaccatcgaaaaacccattgcatcatttcaatctggctaatgaaacataatggtgcatgggctgaaacatcaaaaaattcaagagaaaaacctagatctatctcttcctccgctctagtggttagctaccacatgaactgggatgctgtcacgcccagaaatttagctcaaatttccagactattttatgtattaaatccctgtccaggatcaggcagggtacataaaacgacaagtaatatacagttccaaatgcaaataaaagcgtaaatacttacagaagagacacttaatcctcacaccgaaacgaaagcaacagcagcggaaaaaggcgatcctagcggggcttcagctccactccataggcaaaactcaattggggtctgagccttggtcttctaacttcgtcttcagctcagaagcactacacttctgaaaagggggaataatagcaaggctgagtacaaccaccgtactcagcaagccacaccaacgatgcagacgtgcaagaggaacacaaggacggtttgtggctattgcataaaggcggttgtaaaacattttattgagcaaaacagtaaaattgttgagtaattaaagtaacattaaatctcaactgatcaacgctacaccacgttgaacaggcccaatgtggacccccgtttttataacaggaatcaatcgtgtaacagtaccatttccctggatcaagtagtctggtacatacgagttcatagctgaaataccaaatacacatacacgagagtctagtgcgaattattacatcataagcccgcaggcatagtcttagatcatcggactgagcggtccggaatacattccaaaagcagaagtagataaggcagcggagttaaggcagcggcacgccattgccacaggcaacgaccgtaactaagacctactgagcgccatcgtcttcatcaccctcctggtaatagtcatagggatcctccgaagcttcatctccggcctctgatt

SEQ ID NO: 54919 - DNA, 1501 bp, Oryza sativa
  unsure (1)..(1501): unsure at all n locations
ggagggcggccaggcgcagatcgggcgcggcaggggcgaggacggcgaggccttgttgaggaggagattctcacgtatgctgcggacgagggccaaatcctcgtcctcctcctcgtcgtcgtcatcagacaagccattcacctccgctcccgccgccgccgccggcggggcggcgaggcaggcggagacctgcgcgaccgccgcgtcggggtcgttcccggagaggatgcaggattggcgcagcgcgtccaggtccctctgcaggtcctcgtcgatgtccgggtcggagtcgtcggagtagaaatccatggctacggcggccgccgccgtggaggtggcggctagggtttaggggtttgcggcgcgggtggggaggcggcggggaattcggggtttccagttggcgaaggcgttggagaagtggaggagggatttgaaatcttccgcgaggaagaggaggaggaagcctcngcttcccccatcgaaacggcgcaagatttcgggggcgtgtcggttacgaggaggaggagagggattcttttccaattttcctcgtcttgatgatctcgttgacgggaacatggaatacgccttcctgtgtcgttgacgtacaagctaccgaggtgctttttctagatgatgaactgaagtactccctccatcccctaatataagagattatgagttttcgtttgcaatgtttgaccacttgtcttattcaaaaaattttgaaattattatttattttatttgtgacttactttattatatataatactttaagcacaactttttgttttttatatttaaaaaaaagtaaataagacgagtggtcaaacgttacaagcaaaaactcaaaatcccttatattgtgggacggagggagtagtgaactggtgatctgtgcgtgcaaaatctgaggcagcgctgtaatcaattaaactaattacaccagtgtataaaatctgtgttcatttgataagctggcgaatccacgctgcaacaagtaattcgaaatattaatgtccactccagatttcaggaggttcagggaatttgttttgagtgagtgagaatttgtgaataatatccacttgcttgcagatttcaatatactgcaaacaggtaacatcatatacagtggacagagcactagaaatgcaatagaacaaccagcagaatgccaaaatcgagattactcccactgcgagcgctgcctgaaacagaatgccaattcacaaccgcaatctacaagccatctgaggctgtgtttagttcaaaagtttgaagttgtgtttagttcaaaagtttaaagtttacgtgtgtagaaaagtgtaaagctgcaaactatctagagactgaataccgattcgcaaccgcaaagacaagctatctgaatgcatttttcgcaatctctgaatggtatccgaaactgaataccaattcaaaatgacaaaaacaagctatcttagagactccgacagaatgcaaaataatcaag

SEQ ID NO: 54920 - DNA, 1501 bp, Oryza sativa
ggtggagatgctcacctggaacggcaccgtactctgaactggcgccagcccatacccctcagcttcatgccccctgagcaccacatcgacgtcgctcttctcgccgccgtcaccaagatggtacacatgcacctcatccacacaggtcttggtagccaccgtgtacggcctctgcggcatgcagcgggcgtggttgacctcgccattgtgcggcaccgagcgggagatggacacaagcggggtcgggacggcgccgctcgccgccgaggctgccgccgccaggcagggtggaagcgggagggtggcgtcggcgagcaggaggtggttggcacgtctcgtcggaggtgtgggttccgaggatgaggcggtaggagagggtggagtccggtgaccgggagtgggaggggagccactggacggtgagcgatggccactcgagcggctgggagatgacgaggtcatagagcaccagcgcgttcttcttccagttttggtgctcctccatctcctccgcggacgacctcgtcgccgggggtggcggtgacgttgaggaggttgaagatagagacggcggaggcgtagagcggtggggaggagcggaacacgaggtaggcatcgcagggccccgcagtggcggcagaggtgacttcgtactcctgctgcgcccaaggcagctgctgatggccctcgcccgcgccacgccgcgatggcaaggaggacgaggaggaggtgacctcgtactcctgctgcacctgcgctgcgatggtgaggaggacgaggaggagcatggcgccgccatctcggattcgccgtagtgtctccgccatcggcgaggtcagcggccgccgccaccacttagcctcgccgccagctgcctccccgctggccgctgtctagccactgacatcgtttttgccgcgccgccatcgacaagatttaacgcgagagcttcgcatgacgcctgccgtttcggcccatttgagccaatgctatttcgggcgggcggcggtgccgccggccgccggacctcctctccccttcccccggtggcctccttcccacagcgctgcctgttgccggcctgagaaaagtgaaagagagagaaatggagaagagggggaaataagagaggggttatgaagtggcatcctgacatgtggggctcaggtgggtcccacgctgactcagctgtcacatagaccaaaaccagggtcaaaaccgccgaaggacctcgggtgaccggttatgtatagttaagggaccccgtatatctggttttgcggttcgaggacgattttgtatcccaatgacaagttgagggaccttcggtgtactttttccttcctgcaaacaacgcagcctcaatcgacttcggctacaaatattgggatcacgcgggaaggcccattatactcttcccagcccatgagcttttatcgggcccaacaccgcatcctacctagggttatcagaagggcgccgcatataagaccgaggtccc

SEQ ID NO: 54921 - DNA, 1501 bp, Oryza sativa
gaaatcaatcgtttctaactgatccactggatgagaaattcctcctactcattctgaatgctaaaattttctttcataattccgtgatttgtgtccagttttgcggtcattttgattaagcacgccttgccttatgtgagatgctgcgaaaaaaaaactgtctctgttatgccctgatggcctgatctaagatatgagcagccagagttttctgtgtaccgactgcattttgggggatttcgtgtttccttgcaagtttttgcttctgtttagctaaaattctttgctctggtacgcagtggaagaagaagaggatgaggcggctcaagaggaagcgccgaaagatgaggcagagatccaagtaatcccataggcgatcgactgatggaggaggagaaagcgtctttggctctcactgctgtcatctcatctatttaagttgtttagtttcctttagtaagagagaaaaaaaactaatcaatgtacttctcttgatctttgtcatgggagtaattgattgtactggacagcaatgtttccataattctattacctggagttatctgtcagcaattctcattgtgtctcttctctgtaagagaagctgttcatctgcgattgtgattgtggagatctgaatttttttgcttctttccagtaatccagtgacagtttgcgtcttgattattttgcattctgtcggagtctctaagatagcttgtttttgtcattttgaattggtattcagtttcggataccattcagagattgcgaaaaatgcattcagatagcttgtctttgcggttgcgaatcggtattcagtctctagatagtttgcagctttacacttttctacacacgtaaactttaaacttttgaactaaacacaacttcaaacttttgaactaaacacagcctcagatggcttgtagattgcggttgtgaattggcattctgtttcaggcagcgctcgcagtgggagtaatctcgattttggcattctgctggttgttctattgcatttctagtgctctgtccactgtatatgatgttacctgtttgcagtatattgaaatctgcaagcaagtggatattattcacaaattctcactcactcaaaacaaattccctgaacctcctgaaatctggagtggacattaatatttcgaattacttgttgcagcgtggattcgccagcttatcaaatgaacacagattttatacactggtgtaattagtttaattgattacagcgctgcctcagattttgcacgcacagatcaccagttcactactccctccgtcccacaatataagggattttgagtttttgcttgtaacgtttgaccactcgtcttatttacttttttttaaatataaaaaacaaaaagttgtgcttaaagtattatatataataaagtaagtcacaaataaaataaataataatttcaaaattttttgaataagacaagtggtcaaacattgcaaacgaaaactcata

SEQ ID NO: 54922 - DNA, 1501 bp, Oryza sativa
cgcggtcgccaccgacagtacctcctcctcctccgccgccgccgccaaccccttcgccgcgcgcgccgtgaggctgtacctgcgcgacgtccgcgacgcgcaggccatggcgcgcggcatctcctatcacaagaagaagaagcgcaggggcggcaacatgaacggcgcccgcggcggcgccggcggcggcgcgcgcgcgggcgtgaacgacggcgatgcgacggcgccgccggtggcggtgaccccggggctacctctgccgccgctgccaccgtgcctcaacggtgtgccgttcgagtactgcgacttcgggagcgtcctcgggggagcacatggcgcccatggcggccatggcggcggcggcggcggcttctacggcgccggcgtctacttgccatttctgtacaacaccttcagttagttagctagctagctagttcgtcgtgtatttgtctgtgcttctcactgtggttgcttcagtgtactagctagctacatgtgtgatgtgtctgcatcttgtgatcatcttgatctgtgctttgatgctgatcgatccagcatatccgtacgtgttcgttccgttgcttcggatcttaattaactaatttaattgtgctaattaattttgttagttttggtgatggatgtcgattgcgttatgttcgtgcatgatctgattaataacatgcatgtgttacggtatttaaaccaggctgaaatcgctaaatgagggtgaacctcccaagaactaaggaatatgttgagaaatataaggtctataagcctcggacacaaatagaagatccacggttttgatttatttcacaaaatatcatattgtccaattcttcatcttattctgggtgtccggagagaagcaatatatttcccaactttttttaaaaaaacttttttctttgcactcttgcgaaaaaaaacttactacaaatgaatgaacatttaggtttcttactatacaaaattactgtgtaatggcaaagatggcatgaatctccttaattaaggcttttcccgctgtcccgctcccgtaggccgcaacaactctccggaagcgattttttagtttttttttctgaactttttaaatttttaattttaaaaataaacccttttaaaacttatttccactatctgaacaatttggctaaaacaatactagcattattttgtcacaccggtttgattggcgtgataacgttatttagtcacaccaccatagctgcatggctggattaaacatccacacccgctatttgtaacgcgtcagtattgttttgctacatggcaaaaaaaatttagattctgaaaataaactagttttgtaagggtctattattaaaattaaaaaatttaaaagttaaaaaaaatcgtcagaagcttccggcaaaaagaaccttctccttcgttttcgcaagtaaaatgggcctgtttctccatttacgccggcccaaaagcccattcgtattcagaaaacaaaaac

SEQ ID NO: 54923 - DNA, 885 bp, Oryza sativa
aatgacaaactctcgaaaattgcgcgtagaatctgatttactggaaaagtttttcgaagatcctggtgccgaagtatctgttgattcataagttaatcagcgcaattgtgagaaaagtgcgatttcaaatcaatgaaaatggcattgaatcagatgaaccactcacgtccaggtaccatgtggaacaaatagcgaacaccaaacccgaaatgagtccagatatcaagttacaatctataccatatttatatccgcaaaggaatacaaaattgggttaaaaatggttgttctctaccatttttatatcccaatggaatacaaaatgaagcaccaacatgctaaaaatggttttctatttcagggtggaggatggcatgtaagtggttattgtttcttgcgtctattgtacagctgtatagtatgccaccatttaacatgtacttacaactccctgtgtcagcaatagaacacatctagggttggttttgttttgtatcatggagattcctgcagaagagcaagcagcacgataatgctcaatgaaaattaattcaatgctcaatcagaattttccatttaaaaaaaaactagcaaatcaatgtgtatcaactagaaaagaatccctgatactacaatacggaatttgatggacgagcagaacaagaagtgtatctatgacctcaggaagcccgttgataacatgtgaatgcagcagctgcaagtaggttcttcctgatgaacaggaacttgagccaactacaccctctaatcattgggcagctcatcatgggcacattagatatttcatatttggatgctacattacaaactcataatagaaaaagaaaaacattcagctcagatctatatcagctttatctgtca

SEQ ID NO: 54924 - DNA, 220 bp, Oryza sativa
aatgacaaactctcgaaaattgcgcgtagaatctgatttactggaaaagtttttcgaagatcctggtgccgaagtatctgttgattcataagttaatcagcgcaattgtgagaaaagtgcgatttcaaatcaatgaaaatggcattgaatcagatgaaccactcacgtccaggtaccatgtggaacaaatagcgaacaccaaacccgaaatgagtccaga

SEQ ID NO: 54925 - DNA, 1501 bp, Oryza sativa
ctgagcgttacacaccgccaccgccaccgccacggccacggccacggccacggccaccgacgatgagaagccgcaaggcgcggctgtgcgagcggtggatgcaggatggggaatgcccaaatgggaacggctgtcatgacccccacggcttggaggatcagataagggtggcagtgaagaagacgaccgaccgcggacatcggtgcacggactacttgttgggacagtgcaggaatggagtcaactgcactagactccatgatgttggtccttgatcgatcataggaatggaggatcaggatcggaggaaacgcccagtttcggagtctcgatgatgatgatcttactgaatgtctgaatcagatgttttgtttctgtttgtgggtggtcagatcgatgaaccactgcgtgttttctgttgttctcaggtcgatccgtcttgaacccatttggtttgattcgactagtagtgtccgtcctgagaaaaacttgatgcattgatcatattgttgatttgtgtgcttgaattctggtttttggattccgttatttccatcaagtattgttgcttgctttcctggttgtgttcggactcagatcaggtgagtgatatatttcaatatttgtgttcatactcagatcagatgaacagtgtgtgactggtgaaagagttggttgtagtaacagcttactcggctaataattgatatgcagtttgacattccaatatatgcacatggatcttactcagctagaaaggttcataaactgttctgagaatcgtcatcacatatatgaaactactagtgcaggaacaagagaaaccttgatggaacattagttggaactgaacttgtgaattacggagtatatctcagatattttcagttagatttataagtttgtacattttctgcatgcagccacaccatgcagggtacaattaaacctatctccacaaagcagtactcagactgaaccttttgtttaaaaaaaagtagtgcaactaaatttttgttttataaaaatcgtaaaatctaaaccgagaaacctctcggtttagacttaaccagctacgggcatgcactattcagtgtattagtagcaaccaaagtgaggtcgctggatatgcctaaccagcgacgatctcgttacagtcacgtccctttctaaaacttaaatgccatggaaaaaatttctttgcactccctggaaaaatttacaaatgaatggacatttcgatctcctacaaaattactatggaaatacggaatggcccatgtggcttctctgggagcccattcgtgttcctcaagtaaaaaagaccacatctgtgataaacttactttgggccgaaagcaaatatcttttggcccactaaaccttgcttcaccttcttccttcgcccagagcaaagcaagcgcgactcgaagcttctcaaccccgagctcgccagcaacttgcaccgtggacgctgtcgtacagcgcaagctacccctcg

SEQ ID NO: 54926 - DNA, 926 bp, Oryza sativa
gacataaaaatgtttatattttgggacggagggagtggcttccttgtacggtcgtagcatatgaaaaaaaaatgcacctagacaaaatatccctgtaatgtgaacatgagacacaatgacttccgagcacttaaattgattggttaattcatctttgactgatgttttttttgcgagttaatcttctagcacttttattgtcagaactcagaagccattgactgtcctcaattattcgttctgctattcccaaaccttatcttacacctaagttaatttgattaactccgttccaacaatatgcatgcatacacatgcaggtcgtaccgtacgtatatgatgaactcatctacaagaaattatgactctggttagtacaagataacttcaatattgggacggtgaccaagttttttaacacatgcgccgctatgacgactcaccttattaattatggacatatatatatgagttggtgagcttggtaaagaaaagtttactgaagttagaaattcaaacagtttataggtcatcactagtaaaaactatttaaatgaatgtttcctgatgtcttcttgtaaagcctgtgtaactcagctagtaaagtttgctcatccggtcagttttagacttgtggtacagggtgcccgcatttacatctaattattctttaagtggtaaacgatctttggacaacaaaataaaacatatgttgtgacttcgtcgattttaagatatgacagtttagctttttagtatgctcattgaggtagagtgtgcgtatgtgattattttgtcgattttaagatatgttggtctggtattttggagatacttataagagcatgatatacatgtgtatatataaggatgtgtatgcgcacccttgagcgtgatactgtgttttttttttaaaaaaaaaaaga

SEQ ID NO: 54927 - DNA, 761 bp, Oryza sativa
atctcttccttttgaccaaccttttacttgtcttcccaattaatttgatctgttcctttgtgatgatgtctacagtaaattattgatagttagtgagcaggtgatgaaaaatgggcttcattgcttcattttactagctacaaatttcactaaacaacttgtccccaaaaaagacagaaagacagaaagacagaaaggcactaaacaacttcatttttctctagaaggcactacgttggtttttcatttgaaggtacagacagaaaggcatcatgttttcgctcatgcgtatccgccaaaatttaaatttttaaccttaaatttagaattagttttgaggttttttcataagtttattttttcagtctttgcttttagatcgttaagagcacatatataaaagttttattcacaaattactattcatttgtaaatatgccgtttcgcttattcctcgaataaatgaaactataggtctgaaagacactacccccaaattagagaaatagctagggcatttgagtacttatctccacaaaaatgcacgagaacgacggcttccttttttattaaagaaaactaggaagacaagatgttcattcattacttgtttatatatactccgtatgatacaagcaaagagtaatagatgtcactaattaatactcgaacaggatgcattatgcagctcatgtgaatttagttcagagcactatcctgataccctgaatcacgttgacaaacatggactttcagatgta

SEQ ID NO: 54928 - DNA, 1501 bp, Oryza sativa
agttcagctcgctgttgatctttgcgggatcgctgtacacttcggcatagtcaccgggtcgacgagggaagtagtcgaccttgatgtcaactcctgttgccttcttgcaagcttcgacaaattctttcactgacctacctgaacagccaagtggaatgaacatatgttagctaattaagatgctgaaaatgagtttgcattcatgttttcccttataatgaacttatgatcataatagaatacgatcttgacctttgcctgtgccaacattgtatatgccaactttgcccctttccgccttgttgagcgccttcacatgggcgtcaacgaggtcagtgacatcgatgtaatctcttacacaagtaccgtcaggtgtttcatagtcagtacctttaacctgtaatggaaaatgctattaatcagcaatccactaaaagctaagcaatccttataaatgtgaatctcaatgagtaagcaataggctatgctagcagcaatcagggcaccctgttcttgaatgtaataattgaaatactgggagtgaagatgtaccttcaaaccaggaattatccccagtgcagcatcaaagcatgcaccagatatacggccatgctcccgtaattcaggttttggagcctcgccaagccttccttcagggtcagaaccaatgacgttgaagtatctagaagtattaggttacatattcgtaagtcaggaatcaaatggtggtttaaatagtgggtttcatgcttttgttttgtaaacggtacataccttagaatcatcacagccatgtctgccttcttggatttggaaaaatccaagatgatgtcctctgccatcttcttggctttaccatatgggttgatcggaaactgtacagtaggatttggtgagcaaaagccttcagcattatctgaaagtaaagaggatgcagaagcaacagctgacctggggagttccttcggtgataggcatcttctcgggttctccataggtggcacatgtgctagagtagatcagggttctcacattgtgtgctgccatagcctctagcacaactaaagtgtttgaggtgatgttatgatagtacctgtttaaaatgttttcagtatctcgtgtgtcttgtggagaggtaatttgatggacaatagagactttagtacctcaaaggctcaagtgtgctctcaccaacataagcgacagcagcaaagtgcatgacagcatcaaaagcattttctgcaaatattctattaacctaagcatgtgctaaggaaaaaagatctttcaaaaaattccttcatcatattttgccgcattttgaatgaaagatatatctctacagaaaaattcgatttgagttattcagagaaataaatcaggatacagcttttggatcgcctaaatcagcatagatgaactgcaaccgcccaggctctgaaaacaagttctgaagaaccttgattgcccccatatttcctcttgaaagattatcctgcag

SEQ ID NO: 54929 - DNA, 397 bp, Oryza sativa
tatctgatttataataatattttaaaacaaagggaatagctaagtcttatatttgatgatggatataatacttcgtgatcagaacttagaaacgcgaacatatgctttgtttccggttcgaccactatttgcccttttgcacaataacaattttgtactgctagtagtagcagtgaacatggaaacccaaaccaagatgcttctgattggcatctagtgacagatatgaatgtataatgcacgtgctgccaagaagcaagaaggggaaaagaaataaggaaagataaatgcagcaaatgccgacgagcatcctcttgtcagcatccattgttgtttaatcacctcattattcttagcaagtcaaaataatatgaatccagatcatcctcactttagt

SEQ ID NO: 54930 - DNA, 1501 bp, Oryza sativa
tgggtggaacaagctgacagagattatccatcttgaggtgcttgaatatatcagaccctatcagggatggaggacccgaatggcgccaaggaggaaggcgccaagccgacacaaactcgcaagtcgtcatgtcaacgctgaagacgtgcaggctcctgtgcttctcatcctcctcgtagaaatcacccgccatgagatacacgacgccgtcctcctcgctgctcaacatgggctgggtcggcgacgtgttcgtcggcaaccctgatctcctgaacccctcctgctcccacaagctcccaacatggatactaccaaccttgtgccactgccttgagctcggcgtcaaatcccacatggataatagcatgtcgtatggaggatcggtgttgtatccctcgatggagacgaatctgatggagtcactgatgcaacggatatcacgatactgtgacggcagatgagtgagatagagcgagtcgcaaccaacgtagcaaccatcgggtaattggatgtaaccaaattgcaaatcgtcgtcgtcgttgttgttgatgttgttggtaccagacatgagatcatggcagctgcagaagaggatgccttgtccaagatccacccagtaagcagagccttggaatgagaaggtttgatgagcggtgaaactctttggcttctcggaggggaagattggccttctggttccccagcgacggcggtcgaatggtgccgatgacggcagaaggcagaggacttgcggtagatacccgtcagcctctgcatcggcgtccatgtccattgcaaagatggcaaggaggtagccgccgccatcggcgtcgggttgttgccggacggggtgcgggcagtaggtcacagacgggagaaacctcatcggaagagtcgggagcatcttgagcgaggcggcattgtccgcggcggcgacgtcgcagacgaggtaggatttgtggccgcgcgtgtcggggaggcaggaggagagcacgatgaacccggcgtcggcgagcaggacgctgctgcggaagccgcggcggtcctcctcctccgggtcgccgtcgaggcggatggacaggcgggagggccggggggggatcggcgacgagcgcgagcagcttcaggccgtcgtcgaacggcgctagctcgtcgacggggcgcaggccctcgacgttcgcgcggagcgtgacgtaggccgtcgtctcgcacctgatggttgcccaccccgggtcctcctcctcctcgtcgtccggtttgtggagaaaggcgttgcgatccagcaccacccaaggtggcaaagagcgcgccgccgccatggctgatctacgctcggtttcggacaaagacgtaatgtcttttgagcctacaaattcgttctcgtaagtcgtaactactccattattttagcaaattttatactctctctatttttaacgaaatcgaatttgtaggctctaaaccaattccgaagctgaggtggattcacgggcgctcgtga

SEQ ID NO: 54931 - DNA, 897 bp, Oryza sativa
agactattaataaaacccatccatgatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaaatagtctatatttaatactctaaattagtgtctaaagacatggactaaagttaagtccctagatgtaaacaccacctaagtcaccgaagctgagtccgcctgaacccgaccccgtgtatgaaagatcgtacgcctgggcccacaagcgctcggctcgaaacgccacgtcaccacgctgtgagatctcctcgggctcgaggagaagcccaatggggcaagacaaagtgggcctttggcctatttcccccaaagcacagacacgtggacagagagaagcttctacacaatctcgccgcgcttcactctcccagtctcccaagtctcaacgcactccggtcaacgctacggtcaaacagaaaccaaccagcttttacgtggtgagatcaaccctaatcccctcatgatatgctattataatctcttgagtgggatactacttgggatgcaaggaagcaacaagtacttaattcggttagaatttgtagcctccgatcatgcaggcgtttcagaaattcagagtcctatagctctgcgatgagttcagccatggcgtcttccatggccaagaactcctcgcctttcaaggtgcgtgtctccctccctttcctgcttatgatccattcatccgaattgattcactagccaattagccatagccact

SEQ ID NO: 54932 - DNA, 1501 bp, Oryza sativa
ttgaatatatcagaccccattagggatggagaaccagcatgccgccaacgaggaaggtgccaagctgacacaaacttgcaagtcaccatgtcaacgctgaaggcatataggctcctgtccttctcatcctccgcatagaactcacccatcaagagataaacgacaccatcgtcctcagtgctcagcatgggatgggtcggcgaagtgttcgtcggcagccctgacctcctgaacccctcctgctcccacaatctcccaacacggatgctaccgaccttgcgccactgccctgagctcggcatcatcaactcccacatggacagcagcatgttgtatccgggcaaggtgttgtatccctcgatggacacgaatctgatcgagttgccaacgcagcggatatcgcgatattgcgacggcggagcagtgagatagagcgagtcgaaatccacattgcaaccggtgggtagtgcaatgtaacggaattgcacgtcgtcgttggtattagagatgagatcgtggcagctgcaggagaggatgccttgtccaagatccacccagtaagatgaaccttggaacgagaaggtttgatgagcattgaacttctttggcttctcggagcggaagattggccttctggttccccagcaatggcggtcgaatggtgccgatgacggcagcaggcagaggacttgcggtagatacccatcgtcatctgcatccgcgtccatgtccattgcaaagaggacaaggaggtagccgtcgccatcggattgccggagagggagcggggtcacagaagggcggaacctcatcgggacggtggggaacatcttgagcgaggcgttgtccgtggcggcgtcgcagacgaggtaggagttgtcgccgcgcgtgccgggaaggcaggaggagagcacgaggaaccggggtcggcgagcaggacgccgccgaggaacccgcggcggccctcctcctcgtcgtcgtccgggtcgccgtcgaggcggatggacaggcgggagggccgggggggatcggcgacgagcgcgagcagcttcaggccgtcgtcgtcgaacggcgacagctcgtcgtcgcggcgcaggccctcgacgtccgcgcggagcgtgacgtaggccgtcgtctcgcacctgatggctgcccaccccgggttctcctcctccccgtccggttcgtggagacggacgacgggatccagcaccacccagggtggcaaagagcgcgcctccgccgccgccgccatggccggtctgtgttttcgcttctttctgtttttccctcttctccgagtcggaggcggtggcgttgaggaggggatcgatttcatttttttattttttggcgcggatcgtatgtccatcggacggtggatctgcgactgcaagaagcccacggccacgtgtatttctatttcacgagcgcccgtgaatccacctcagcttcggaattggtttagagcctacaaattcgatttcgttaaaaatagaga

SEQ ID NO: 54933 - DNA, 1501 bp, Oryza sativa
tgtttaggagacatcacaccagcagatacagctgaaccttgcatatatcaagatagagatcgcacaatcatttgcaaatatttcagcacaaaggcaaaacagtgcagaaattttatcgctggtagaagtatatgcagaaagagagacttgacaggataaaattgagcaggacaggttccatgtagctaagaaacatacggggtaaattgagcattaacaacttttttacattggcaatctagaatgcgcagaccatttgcaacataatctataatttgccactatttcaacaagattgctagcaacaaacagatcctgatgtacgcacaggttaatagccaccaccaaatgaatagagaacaaaaaaaaaaaagcatcacaaatccacagggaaaaaaaacgaatgcctctgcatctctgatctctacgtcgcaaatcgaataacagtgaacccgaccacaaatgacgattcaaatcgcaaacacaagaacccattcacgcaggttttcccttaaacataatgaaaggcaagaatcgaactcacaacgcttgttaaacctcaagcactagtggagtttctacataaacagagacttggcagtactaatagcaagcagaacagagtgcgcgtagcgaagagaactccacaatttctagcaagagagatcctaatcctgatgttcgcttaagcagccaccgattcaacaaaaaagaacatcaggatcgaagggggaaaaccccccaaatgcttctccgtctcaaatcatacaacattgaagccgccaatgattaaaatggagagataagaacctattcgcagacaagactgttccccctaaacacctacaaggcttgatgccgaacagcacgaactcgcattgctatgaaacgatcaaatgcttgtcaaattaacagaaccgctttggcactagaacttgtatgctaatcgcgtcttcgacatgatctattcaccaaaaaaacgaacggtaacctaagcgatcgattacattcccaccgatcgaacattctaaccacgcacgagatgaattaaacgccaagaactacacagaaaaagaaaaaaaacgacatgaaccaaccaccaagatgaactcgtattacacgcggcggccaaaacactgagaaactcagaagcgaaccaccaagaggaagcactaggactacaagcgcggccaagacaccgagaaacaccagcgaaccaccaagaatccaagacgaagcacgagtactacactacctacacgcgcggacaaaacacacagggaaaaactcagaagcgaaaacaccatgcatgatgcatcacaggttggatccaagcaaaagtttgcagaggagggaggaggagagggttaagcggggaggaattaccgagctgctcttctgtgagacgtactcgccggcggcgcggaacttgtccttgatgcagatccagtgcttctcggcggagctctccttgagctggttatagtagtccttgacgcgc

SEQ ID NO: 54934 - DNA, 1501 bp, Oryza sativa
catctagcctggaattagtttcaattgcttctgacatttgcttcttttcaatttttggttgcagtctggaacgcatggaaatgttgagacaggaccgcgaaaaacaagagtttgcaatgctagacagcatagattggtagcttatggcaacggatccaatgaaggtcttgcgcagtttgcagctggttgaatgacatgggggacccactttggtattacccatatgtcagtaacaagaagtgcactgaggagtttggttcattgtcatacttatggcaagccacactttcttaccatcttaaaccatatgtcagactacaaattataggccaaaaaaagtgtggcaagccacacttgcctaacattgcctaaaatgagttatggcaatgttagttaagaaccaaacagcccctaaagatatcatgccgtacttacttatttattacaccatccgtcccataatataagggattttgcatgacgatttccatataaactgtataatttgtttttctttttatctatactagaaaaatgcccgtgcgttgtaatgggtgaatgctatcttaatcttattattgttatacggtttagctaaagtgaattcactatagaaatttgcttggatataattttttacaagatcatgagctacaattatgagtctgatcatctcaagttagcatgcaaattttttaaagagatttcttatatgactccttctatattttcaaaagcaaacgaatttaaaaacctactcaaatacaaattaattccaaaagcaaatgacttaaaaatcgactcaaacacggatgacgtatcaaagtaccagcaaaaatatctttaatttttataatagtagagatttaatgctccatacatgtgtttaaatattcgatatgatattttttaggaaatattttctgggaactaaacagggcctaattaacatacccatgcaacagccccatggagcaggagcatatccgatccgattggtaagagcgaggccacttaccaggcctggcagtttcctaacacaaaaagaaccgcgtgattgaagcatataccccccgtttaacgccgttggctttttagcatatatttgaccattcatcttattaaaaactcttgtaaaatatgtaagactatgtttatataaaagtatatttaacaatgaactagatgggaaaaaaattaataattacttaaattgtttgaataagacgaacgatcaaacatgtttaaaaaagtcaacggcgtcgacggagtgtatatatatacactacaaaaattgtgcgtgcgttgcaacggatgaagactattttaataataatattattatatggtttaattaaggaaaaatttactgtgggaattcatttggttatatatatttttagagctgtagttagtagtccggtcatctaagttagcatgcgagttttttttggttaaaaggatttcttatacgactccttttgtatttccaaaaacgaaa

SEQ ID NO: 54935 - DNA, 946 bp, Oryza sativa
cgtttagcagcttactagcttagtatgagattttcactgccttaatccttaattgttaaattatgatctgatcgcacccaggcctcttgaaagctatagttctggaaacatgattgtatagataaatatgaaaacctacgtagaagctgttttttttttcaactgatttttgtaactggttttatatgcacaatggtttggtgcaactgagaaatataactgaacactcatgagatattgagatataaaatttgacattgaacttattttgtgcttctgcctgccctacaaaattgtttctaaactctgaaggttgcatactgagtagcgctgtttaactttggcattctcctttttgacacatgttgttgtagacatattattttagagctagaaaatttattatgttgctgccgttgttgttttgttcttgctatatgctgttcttcaacctcaaccataccgctttacatgttgaaagtttgatttgttcatttcctatgttatgttaaacatttggtggaaatttcattatgtttaaccttctacctgggttaagtgacagaagatgtcgaaccaatagttactccctatctctctttttatagttctgagttacttatttttagttcctaatgcagactcatgagtcatgatttgatctctgtttctgcactctctcagtttgatggaattccgaatttgtttatgttctggcttatgtaactataccacctgttgatggttctggtagctaaattttattcaagttgcatttcattgtgatatgacgaaagcgttcctcaaggtgttggtttctggctgaaaatatgcagatgttggttctggatcttgttatgttgatcttttcctaagaatccacacatcagctttactttgctggtttctttggtttatttcagacttcggatggaatccattaaga

SEQ ID NO: 54936 - DNA, 1501 bp, Oryza sativa
actctaggtacgtggttacctggggtgttacagcactgccagtcgctagagattgtaagatcaaatagaaagaactaagccaaccagagggggggtgaatagttggtgtacccaaaaattcaaagttttagtggaattaaaagttaccctcaaatcgatgtagatcggtctgaccgaggttgatcagtcggtctgactgctcctgcgccgccggtctgaccggtgtagatcgctcggtccgatcgctctgaagtcgcctctgctccctgtcgccgtcgctggtctgaccgccatgtacccgcctgtctgatcgccgtgatgccaccggtctgaccgccggtgtctcaccggttagaccgccgaacctgagcaaacataaatcgaatagctcttgatgtagatgacaactttattacttctctctgtgtttacaaagtgcaacaacaacactcctcacaaaaatctcgactaaactcaaaactctaactaaactctcagctcaatgctctcaaaagcgataccatgaagcctcacgctccctctctatttatacatgaggtagttagcctaaagccactaaccaaactcatacaagaagtcctaatccacctagataacatttccgtacaagaaacaaactttacaaactccaatcataccaaatttggagtctttccaaattcgactccgcatcccacacgcacacaatatctccatcgtatgacatatggaatctttaccaaccacgtgcattgatctttagcctaagtatcccgcatgatatctgaccgtccagacgtcaccttatctccaagtttactcccgatccatcaccgacaatactctcccgagacatcaagttacctacacatgaatcaaacaaagaaaccatatattccgagaccaagctatctccaacttgactcattgttaacaaacaacagtattacatacacatagtatccatcgagaagccataaacacgaaacatccacggatatccaaacaaacaacccgaaaccgaaaccgacatagagtcggccggtcagaccgcgggctggtcggtcagaccgctcgcatagcgccggtctgaccggacccgacaacagcaacacctgtaaatcatctgcaaatccaatcatctccaaaaccacttcgccgataatctccaaatatcaaaaccaacaatcacatatgccaattgttcatcatagaataagaatcaaacacactttgattttacagagatcaaaggcaagtgaaaatcaatgattttcataggtggaacacgcccgctataaaaaaaacatttggcaggtggcccctttagaggtaccgcaagtgaagatctgattatcagaggcgttagcgtaagaggcccgccaatgaaaacctacttttcgcaaaaaaaaaaaagaaagagaaaaaacggatctaaatcccaacttcaaattcaaaaaattatgggattggatcacaaatcgatagattccccaagctt

SEQ ID NO: 54937 - DNA, 341 bp, Oryza sativa
atgatgatccctatataatttatgtgttagcattaactttgaggatcagcttaacagtacagttagccttgattagggtcatcactcatcactaacatatatgtattatgttaggtcttgacaaggagtagtttttctagaactccttgataagagtcactccgtccttaagaaaaaactaacctagatatagacatgcatattttttagtacaataaatccgaacataaatctgttaagattcattatactaggatacgtcacgtatttgtggctaaggtttatttttttgggacggaggaagtagttaattacatgtagcgtttaaaatttgtcttaga

SEQ ID NO: 54938 - DNA, 186 bp, Oryza sativa
agaagtgggccaacatgagaaggcccatacatccagcccattagttctccctaaaaccaagagagaggggacccgactcccacctcccctcatagtgccgccacccctctccctggccggcacctccttcctccccttctcctatgttcgcatctctcccctctacaacaaattgccctccctaga

SEQ ID NO: 54939 - DNA, 240 bp, Oryza sativa
gtgccgtgccgggcggcccacatggtctatagctgttcctggatttttgacaatctggcccttttagaaaaagcttaatgtatagatagaccgctgaaaggccttatccacgaaaacgagcttttaggagggtctatttacaaaataagttttctaaaaggggctagattgtcaaaaaccaaagtcttcccgttcccctcggcgtcgactcccccccaaactccgtctcctcgcgcgagt

SEQ ID NO: 54940 - DNA, 480 bp, Oryza sativa
tttctgagtacattaggccaaacagagtacagagcaccagtcaggcctgttttggcaagatcatgaacctgaccaccagagagcttttaagtgtgatcagtgctcggatacgctcgactctcagttgcgtaagttccctggatctcgtggccactactggttgtcgggagacgaaggcctctgcttctctccccaccaggcaccaggccaccaccggcactgtcgcactgagccattttctctgtgagaagtgaaacgctcagaagtgaaatggctttgtttgaaagagcttttagccgctgtaacttcttttaaaatccgtagctccttcaacagttcagattttcatcaaaattctgagaattgatagatgtaaaacatagaaataaactgaatgtcaaaaggtagaaagcataacttttcagattttcattcagcttcttatcagcatcttgaactacccataggtgccatttccac

SEQ ID NO: 54941 - DNA, 1354 bp, Oryza sativa
  unsure (1)..(1354): unsure at all n locations
atgatgaagatgcagtccttggcaagttacacctcaccaacgataccctgaatttcaataaaatggagaacacaaatggatcaaatagcttgttctaatatgcaagatggaacacataaatattttgtcaaatatcgattgttttaaaactgtagtaggaaaattcattaggacaaattttatatgtctgccactgttcatgcttatgctctaccaactgccatttcgtcgcctccaatgcttacaggctcatggaaatcgaactatgacaatttgaaggatgtaaaaaaaaaaagagaaagaaagaagaattagaatatggctagagtttctccaggctctagtagtagcattatatcagaattcagattcttcatacatgtattttttttcctaagaaaacaacaaactgaaaactatgatgttgtctcatatattctttaaaattaatttatttatttttgtgcatgggtgttggatttgcctccaattttagtaagatcaaactaacaaaaagttcagttatgcctgagaaaggaaaatactaattttagtacgatcaaacgaacaaaaaaagtcagttatgcctgagaagggaaaatactctcgtttaacatagacatcatcagatcagaacaggttatcccccagatctcagtaccttcagtttgttcttagcgcatcatcagatcagcacntacactgtgccaaaaaaatttgagctaatcccagttttctttgaacaaggttaatccctcagatctcagtacctcagttttgttcttagctcatcatcagatcagcacntacactatgccaaaaaaaaaattgagctaatcccagttttctttgctaactttatctgacaaataaaatgatctaaactcatatcacagtaataaaaagacccaacttaatatcaaactttaaatcctaaaggttttaaacctacgacattccaaattttttatcaaggttttgctaccttaataaattttactgattgaacactgaatgtctagatcgtacttcctttcgatgcatagttgaagccaatactactcaatgcaccggtagaaagtgtacattatagttaaaatgccagctcatgatagtgtataaagagatggggatttcggtgcattcacgtttgggagggaaggaaccgggatataaatttgcaatttgcagtgaataaacatgcattaattattggccccggcattaccatcaatctatccagtctgcaaggtgctctaccattgttagactctcgtagtctcgttcccgctgtcctgcacacacgcaaataacaaagaaaaaaaatcagagaatggggattagactcaaggaa

SEQ ID NO: 54942 - DNA, 1501 bp, Oryza sativa
aaacatgcgcgagtttttagactccgagcctcacacagaacaatatacacaaacacaaaaaggaaaaactagaaaacttagtttcaaccttcattaatgactattctatccatcccagcacgagagggggaagaggagaaacaaatttagaatgtgtttaggaggtgaggttgggaactcacatcccgcgtacgcaaaatagagcgacgcattttcttatgattaattaagtttttattattattattttaaaaaaagattaatatgatttttttatattaatatgactttcgtgtagaaaccttttgaaaaaaacgtaccgtttagcagtttcaagagtgtgtgcaaggaacatgaaagaggtgagttggaaaagatgggagaagaatatagccttagtccgtaagacgaaacattgtctaaattttttaatgcgcaagctaccaactttattcaatagagaatgagtaaactataaaaaaaaaggaaaagaaaagctcacgatatttggtccgagctaattatagtataagccaatttttcagatttcttgcgcccactaaacattgtccaaattcatttcttttagataatagaataattgttcaaattcattatattcaatgatgttttattttgtatcagattaatttattttggagtgaagggagtactggtgacaccatcttttatctctggctctcggcggtggcctcccctaaaccaaccatgaagttccacgatgaacttgccccctgattggaggtacttccgattcttaacggtttgattattgagaactttttagacacaatatgttgtatatacaatcactaaattataccttaaaagttcttttcatcgtaagaacataagagtagtctacttctaacctcactaagtacgagtactacttgtcattggaaaaatataaaagaaaagaaaattttactcgggcaatccgacagaaaatttgcgaaaagagaagcttactaagtaatgtatgtcatatctgaaacttagagaacttcagtctgaatatttactgaccattgtttcttaagcacttataatagtagcaatgcatcttctctatgtttgaaatatgtactccctccgtttcacaatgtaagccattctagcatttcccacattcatattgattttaatgaatttagatagatatatatatatatttagattcatcaacatcaatatgaatgtgggaaatgctagaatgacttacattgtgaaacggaggattccgtccgtcttgatccagccacacacacgatatgacgtttctacccctcacaagtacaagtataatgcatgtcaatgagaggtagaaatgtcatatcatgtgtgtgactggatcaataacgatcaagacggatagaaaaattgacggaagtgctaaaaatggtaacagggtgaactttggatgctattaaagtgaaccggtaacttttggtgctataaaaccaaaaacgtgaacttt

SEQ ID NO: 54943 - DNA, 1501 bp, Oryza sativa
tgagcggtaaaaatccaacttgtatgtatttgtacacttcattatctaaaaaagaatgtatttgtacactttgttgtaaacaattcgatggaacaaaaaaaaactaaagctggtgaatttgtcgttgaatcaagtcctttttagtttttttttagttttgctgattgaagttctctgttaggcataattggagcttatgttgtttttagatttaatatatttcaattgttgcacagactgggatcgcagggaaacataattatttatgctaatatagtaaactgggttaacagcaaactgaaagcagcgggaagaagatctcaaatggaaagcttcaatgtgttcttcctgtagcctccagtctcaatcatttaaatactactccctccgtttcacaatgtaagtcattttagcatttcacacattcatatagatattaatgaatctagacatatatatctatctagattcattaacatcaatctatctagattcattaacatcaatataaatgtgaaaaatgttagaatgacttacattgtgaaacggagggagtaattacaaatttatactcattcttctttcttgatggaaatgccaagtgtaatacaggcagagcagcagtagttcatggagcaggaggcgtcagcttattgcccatttttctcttgttgctgcttgccgtcgacacgctgaagctgttggtgttgtcgtttgactttttttaacagaaagaattttatttaaaatgaaattatacccggcctctacatacatcctaggactcacacaagcgaaaaaaagaagaatatcctgagacaaacattaatgtatcatgtcatcagatcttctagtctctgttgccaaatgttgaagaaatcagacaaaaaaggagaggcatcattgctgaaaaggggatcagcttgcctactgatgtcaaaagaaaccgtgccatcagctcatcatccagcttatgttgttcaccagatctcttataattcttgtcaccagatccttagaccggcgaggagaagaacatcatagtttctgaagtcctgcactggtgctgcgccacaagggacacaagcaaaccttggtggattgcagaaaaggtgtgatttagcgatcagttccgtagttagctctcataggataaaaagtgatagtaattagtaggcaaaattggttatatagcatcgaaagttcacgtttttggttttatagcaccaaaagttaccggttcactttaatagcatccaaagttcaccctgttaccatttttagcacttccgtcaatttttctatccgtcttgatcgttattgatccagtcacacacatgatatgacatttctacctctcattgacatgcattatacttgtacttgtgaggggtagaaacgtcatatcgtgtgtgtggctggatcaagacggacggaatcctccgtttcacaatgtaagtcattctagcatttcccacattcatattgatgttgatgaatc

SEQ ID NO: 54944 - DNA, 1501 bp, Oryza sativa
tggcttggatatattctgattttaggtggattggatatattctagtataattaatttaggcagatagtttttaaatttattgtatttttaaatttattgtattgggacgtgttacgttcataaaaatcccttataagatcgaaacggacataccagatgagctacggcagattcacaaaaatcccttataatttaggcttaagtgcgctccatgtgaggccgccgctctaattcgaccgacgactctttagggctcgaagcttctgtatcgtgagccttttgggaagggactcaaggagtgatgggctactcgctatattcttctcgaaatactacatccatactaaaatgtaataatttttagctaaacgtataacttttagttataaatctgaacacataattatctagattcatagctaaaaatacatattcatagctaaaataattaaatgtcctaaatgtaacaacttttagctatgaaacttttagctatgaatctgaacttagctatgaatctgaacgtgaacttagctttttagctatgaatctgaacttagctatgaatctgaacgtgaacttagctatgaatctgaacgtaaagttgtttatattcatagctaaaaatacttaaattttagattttaggacgggggagtaagtcgttaatgggcctctatgacacctaagaagcattttcttctcgaaataagtggtgtttggataagggactaaacttcagtaccttactctggcaatccatgtttatgtaccgagagaaaaaaatcactgtcacgcatcgaaagtttggacatttggtctattaaatatagactacttataaaattaattatataaataagagctaattcgcacgataaattttttaaacctaattaatctatagtaagcacatgtttagtgtagcatcatataggttaattatggattaattaggctcaatagattcgtctcgcaaattagtctaggttattgtcggtgacatgggaccgggagtatcatgactagagccttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtatatgaggtaggtgagcatagcggggctcacctaaccacatttattgcggtttggacgagcgcgtcacgccgcatgtaacgcagtgcagtgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaaga

SEQ ID NO: 54945 - DNA, 1501 bp, Oryza sativa
caaaggggggcctgcgcggtctcccggtggggagccccacgctccgtcagttatggaataggttttttcaatagtctacatttaataattctaagatgtgatcggggctaaaaccttttaatcccatctaaacagcccctaagtctggttgccaaccgtaatatcaaaaaattaatttagggtgtaacttacagaatcatattacattcagtcttggataagaaactatctttgttcggtcggccaaaaaccacaatagttccggttgcaataaaaacccagactaaagatggtttttagtcccagtttataagcagaacgggactatatgatctttagtcccggttcacatgttgtcatgggctgtcagggctctccgggatctttagtccctgttgaagttaccaatagtgtatccgagatacactactggagaccggggaggaggggaggcagcggcggctgcgccggccgtgggcatgagaggaggacgggccggcggccggtagcgccggatttttgtcctttcttttttttaagaatttgtgattcattgtattgaaatgaagaatttgtgattcattggatggattgagatgtataatttcttttttgagaatctgtggtctgagatgtataatctctgatgtattgagatattactttgatttggggtttgattcggggatatgtatctcactcgatttgagagaaaatagttagggattaagtagtaagtatcaatagaaacaatgaaaaaaaaagaaactaaccggaactgcctctgccttctttagtcccggttggtaaagatcgatctttaatcccgagtatttgaatcggggctaaatataacgatctttagtcccggattcatagtcccagataaaaaaccgggactacagagaattataaactgggagtaaaaacgatctctccacccgtgatagctggttttgctagtggcatcctaaaatgaaaagaagaaaaataaaaaacaagtagaagatcaagactcaccttcttctactctccaactcttcccctcacccccacccaccccttcgcccactcctccctcttcacgccaacaagttgcacgtagatcgttaccaacggcctccacctggggcacctgttccatcgatcccgcattgccaccattactgcaagctcgagcttggcaatcaccttcccaagtgcccgccgatcctgcatggctgcatcgccaccatcactgcaagctcaagcttggcaatcgccttcccttcacacgatagctacggaacatagctgccgatcctgcatcgccttcaccacagctagctcgagcttggcaatcgccttccctttgcacgatggatgcggaacaaggaaggatggggacggggagctccacccagatgacagtggcgccagagcagaggaggcactgtgggccgctttggcgcatctttgtctttttgtcttattattattattattattagaattggcgcat

SEQ ID NO: 54946 - DNA, 1501 bp, Oryza sativa
cgcatcggttgttgaacggaggggattaccggctagccgacggcgccgaggagagacgatccagatagatgaggcgagatggggaaggagatcgcgacggcggcgggggaaagaaaagcggaagaaaaggatgcgagcgagtcgctaagccagagccagtccattcctcacgctcggctcgatgcgcgcttttggttgtgggagtcgacatgagcgagctgagccttctcttggtgcggatggagctgcgcaggggcgccgtcggattgctccctcgtccatgtgccgcccatttaagtcgggtatgcacgctgcgggttttgcagccggtctacgcataattttttttcctcaacaacacacatattggccccctctccttcctctcctcgtggttgccgacaagcacggcggtgacccagatcgaggtgtcgacgctcgccctgccctgcccgccgtcgctcttatccgctgctccttgctcggagcagcaatggccgccgcctgacaggagcgagaggggataaaaagaatataacttaggccgagtttagtttcaaactttttcttcaaacttccaactttcccatcacatcaaaactttcctacacacaaactttcaatttttctatcacatcgttccaatttcaatcaaactttcaattttgacgtgaactaaacacacccttacatagttacatgtgggtcctatgtggtttttatttttttattttgcttattgtgtcatgtcagcgctacgtcacctaaaaccatcttcaatactgctttggcctttgggactatatttgcaccggttttgaaagatgagggatgcgttcttcccggtttttgcggtttagggatgtatttcaaactcaacgtcaacatgagggatctcaagtgaacttattcctctcccgtcggcctcggcccgcaatcacgtatccagcccagcaagcaaccaaaagtctactaatccccccatgtcctctaactgtgttgtggacccatcgctacagtatcttcccctacctccgtcgaggttcctcatcttcccgatgcctccctgaagccacctcctctgtgaaatccgatcgtatctttggagataactagctgggtgacccgcgcaattgcgcagctagcacccaaacaaaatcatatattgttttagtatgattttacttaaaatttattaaatagctatctcattgtcttaagactttaaaagaccaaaccttatcattctcgtgtttctaattatatagtttttaaaagtcacaccagttgctactccttatgtcatctttttctttatttgcttgttcgatctatcactatttctatttattcttcttagaacctttaaaaattagattttatagtttttagagtttattgtcacgttgggtttcgtttttataatttctagatgtcccgtcaaacgttgtcattatactcctctacggcccgtccactgtctcttctctttattgatatt

SEQ ID NO: 54947 - DNA, 195 bp, Oryza sativa
tatcccctataactagtcggataaccatgccgtgtgggtatggggtacccataatctccacacacagcaatatttggcttgtactcttttggaaaggattgattttcaatatttggttgtagctacccagcagcacatgtttaggtgctctacaatatttctatctaattcaaccagttcacctggactttgaga

SEQ ID NO: 54948 - DNA, 906 bp, Oryza sativa
tattgcttccagccttccagcaagttgaaccgatcgcattaaaataaggagaaattttaacaaatagcattgacaagcgttcaattctacgctttttggccattaacgagagcaagttttctacaaaatgctatcatatggacgaattttgtctaagaaatatcaccgacgtcatatttccatccatcgcactgtgtttgctcacatgaaaaatatcattttaaccttatgagcagaccattttctgttcaataagaagatagagactgagatagagatagaacaatagcatgggctatatacagtttgagatggtgacaagaaaaagatagcaagagcaaaattttggatgggctatatactgtatgaggtgatgcatcgatgccaaaccaataaataattcgatgccaaacaaatttcgttcgacggatgcatgccatcggccatccccgcagcatctgcagtacttgtgccgctcgctgacaccatatggtttcgttgcgatgaaccttaactggaattcaattttgtgtaataaccactccgctatatatcctcacatattagctaattaattgagagatggaacggacttacggacactccgtgcataagagctgatgagaagcaacggttttccttttagtttttctagaaacagtacaaacgtagggttcacaaggtatacacactcacttctatgaacacacactttatttgtataaacatatcggaagaagccccggttttctgttttgacacaagctaggaaggaactaatgctcatgtgtctccacggaaacaaatcagcaatttaaggtgtgatacttcattgtcaaaaacggaagttgatatgatgacacaaatatatggtggatgatgtcacgcgttatgaaatattgatga

SEQ ID NO: 54949 - DNA, 1252 bp, Oryza sativa
tgtttttgggaacaattttaccacgaggatcataggtgtaacattcctttatatttttagtgcaataaactagtggctttttctggatagtttgggtgcatacatgtgcatttttaagagttccaggttgttgcttgaagtcttgagcattagtttggagttgtttgcaatttgcatccagtaaacaagtgctaaatctaactgaacgaatgtccatatgagcaaatattattttgaaagtagttagtaggctaaattgagcttacccagagttagtacctagatagttatttccaattcccacaggttgtcatacttcttctatgatcattttgttctgcggacagatttttttattgctcctctgtaatgtattccatgtttctttttcttagcgctatgcttgtaatcactcatggttttaccatttttatgtatgatcatttcattccatgttcacagcttgtttgatagtttctttgtattgacctctatactatctacaatggctgtctctggttggttgcaactcacttttaagtgtgcctggaagtttttatgtgtgtatctgtgttggatcaactcgggtgggtctatagtttaataagacagtaaaacttgaaataattgtatcttttcagtgtacaggagcagaaaactagacatgcatcaatctaaattcgattcatgtggaaattactgtgcatatcagtttggtgggttcaataagatttttcattagtaatactttaagaggttgagttgtgagttggataaaggttactttgttgtacttgtgttgttgtttaacttgatgggtctctatgagtaaaaaaagcatatgtccctgcctcctcagatagccaagctctcaactgcgaggcctttgtgtatatgttttttttcttctctctggccaggcagagttggtctaaaagcatttggcagatggtaggccagctcttttatgaataactttggcaagaaaagctagcaggtcatccaaatgagatgggtttttcccgtagatcagtgtattaaagaaatgctcagatctgctattgtgcttgtctaagtaccatgtcaatccactaggtacacaatcaacatctagttgtatgatggcaacaatgacaagcacattttacaaccctgaactttcatgaatatatgcacaagaattaaaaagtaaagctcaactcaaactatactatcaaattatgaactatcagaactgttcaattttcaacca

SEQ ID NO: 54950 - DNA, 463 bp, Oryza sativa
taccacttaattcgcatgccctctataatatatcattaggactgctaattagtttatttggtaccactttctctgtttttcatgtatcacttatttcttaattccatatgtatatctttatggacatttttgcccttgggcctaggggtgaaaactatcggaaacggtcagaatcggtagcatctctttggaaacgatgctcgatcggccggtaattgaccatatttatcatttaaactactcggtatcgacattaatacgatggagaaagaaattagaaaaaccaaaatttaaaaatagccaaaaaggtacggtcggaaacggtaccccttaaacgaaaatggcgcccggtcgatcgggaatttccttgaccgttttcacccctacttgggcccacctgtcagattcaaagagagaaatctctctctggatcgaatcgatcgatccctcctccagggtgagc

SEQ ID NO: 54951 - DNA, 1501 bp, Oryza sativa
agaccatcgtcccggcgcgtcattcgggctcaacacaaggctgtttggtcgctggttgcgatccgtttcggcccagtaaatatgggcatgcagcacgtaagaaaaagatgatcgagtatgttttagtatgttttaacatattgatcgaatcaatttgtatctcttaactgtcattgatatgtgcctgcaaggatgtataataagagagattcaccaagattggtaaatttccgttcgtcgcacttattttcgtctgccaattgttcgattccttctcccctctcgcacgtgcgtgcgtgacgaaatacatgtcgcatcatagtacagcagaaaaaaaaagagggtttggatagggctttattcctaggtcgataagaagcggatttgctcaaattcttagaaaaacggaaagaggaggaaataaggattgaaacccctcaatcaatctatctattatattattaaaacagctttgaaaggagacaccacgttcgctggggagactagaaaatcccacattaatcgaagaaaaagaaaaaaaaagaaaagtagagtttaagtagaagtacaatattaactaatttttttaaaaaaaataaattctgaaattagaaaaagaaaaataagatttcaattaggaatataatttataactaactaaaatatgtgataaaaataaaaactattgaaagaaaagaccatataaaacacatgacgagataaattaagtaacaggcctataaaagagtagagtggtggcggttgatataacatataaaaattgttaataaaacaccaaatagaatcctaatgacgattaaaaggagggacattaggcaggcggtgaagctaacaaataaggcggttgctgggacttctagaaagacaaaaatacattgataatcatattcgatttttaaaatttcaatgacaataaaaatgagaagcaccgggcagggtgtataagagtatagttgcagagccgccgacggttgacgggacttttagaaaataaaaaatgaattctaacgatagttatgttcgatttttagaatcacaatgacaattaagagtaggcggcggacgggctgtacaggggcatagtggcatcgtttgatgacttctaaaaattataaaaaaataaaattacaagtccaatttttaaaggttcggaacttctaaaaaataaaaaaaacaatgataatcatgttcgattttaaaatctcaatgacaataaagaatggaggcagcggacgaaccgaagaggagtacaatggcaaagccactaacggtttggcgggacttctagaaagtaaaaatgaacacaaacaataattatgttcgatttttaaaatctcaatatcaataaagagaagagacagtggacgggccgtagaggagtataatgacaacgtttgacgggacatctagaaattataaaaacgaaacccaacgtgacaataaactctaaaaactataaaatctaatttttaaaggttct

SEQ ID NO: 54952 - DNA, 818 bp, Oryza sativa
caaatattcaacaaaccttgttaagatggcagttgagcttcactcacaatctgtggattatggtgctccattttgtacatgttcttttcgtatttttattgggatcacaaagcgaactcaatgcaatttaagaacgagtgaaagtgcgaaactgacaagctgggagctcgaaagtccattctgggttctggcgatagtgttgggcttgggtaggaactcatcatgggccatctataactattcgggcccaatatgtatgggctggacatgaactataatactgttttggcccaatatatatgggccgtatgtgagccacattaccattccagacggcgcagccgcgttcaggcccatagatttgggctcagcacgcaggacctggccttcttgggcttcttgcgggaagttcaaatttttgcaccacattggcgcgggcgccactacacgtgaaagctacttgaattgggacgtccacgcacgatccgacggccatcattgcatggcgtcttcagccgatggcaagacacgctcaggctggtctcagatatactagatactagtactagattagcagctactagtagctaatttttgttaaaagaaaaaaagggggaaaaaagaggcaaaacgtggtaacatggattgagcagtaaatttgcaagaccatgaagcacccatttccattaccagaaatgagaagtttacaagttcttaaccctccaaaacaagagccaagaacatccacagttcacactgccagcacttgaagaccttacaaactaaaacgagctactaacctccactacatgtgtgaa

SEQ ID NO: 54953 - DNA, 1501 bp, Oryza sativa
acatgtgccgatatgatttttttttaattccgtaacaatgtacgggcatttcgctcgtcagaaaaagaaaaggacaacatggcaagcacggatcctgctttacatttgtgaccctaacttggtttgcaattttctgtttgttgacttcgacatttcaatgaaatgtactccatggacaaagaaaaggggggtggaatgtaccgatcaatgtatatgactaccgaggcagcattgacagcatcctcttttggactttgactaagagaaatttcaccaacgataataatggttttaggacctgttaattctagcataaagataatagtggttttagaacctgttaattctaacatctgcaactgctcaaaaacaaaatctaacatctaccgcataccccactaaatacagatacggtcagaaatcatagatctgacaagataccatgatacaacggaattcatcatcaagatttcgcaattttgtgacgtcctgtggtgtgagactacccatattgcccctcaaaagatgaattatgcctaattaccgcaagaacaaatcaccaaaaagaaaaaaaaaaacaagatttttggtttcagaaccgtaaaatacccaagattttagccgaagattgagctctacctctacggtgctatggatggaagattacaattaccaaacagacctaacattttcccggaccaagaacaatacaagaaccctcgtattaaccaggcgatgaatcaacgaggcacgaatctctcgcatcgcagcagccatcgatcccaggcatcccaagccgaacaccaagaacaagaaatggaagggagggaaaccaagaaaaagtctccataccagcgagcccggagacgaagcaaactcagaaccgacgcagcggcggcggcggcgtcactgcaggctcgcagggttgccgccggcgagagaagaagaggaagaaatggctctccccctccacctcctcctgtcgtctcgggagcgggagaataataaagaaaggcgagagaagtatcaaatgtcaactgtaccacgcacccccgtcctcctacctggagagtacagtgggatcagcatgcagctgcagcagcaatcgcgattgcgaatctcttttcgtggccggggcatccagtagggcagtgtttttttttttttttttgaaattgaagagaagttcggggaaagttgatagtttgaaaataaactcagtagaaaagttttggatgtgatgtgatgaaaagttgaaagtttatggaaagtttggtgttaactaaacagggtctaggtctcagattaagaaattctaggcgccgcagagagagaggggtggtgtttttttcttataaagacgaagatgaagatgaaaattaagttttttacgtaaaataaggtggtattaatgtataattaattgagttttaattattacgaatttgaaaaatagattaatatgatattttagattaattgagcatgaaatgtactgttt

SEQ ID NO: 54954 - DNA, 383 bp, Oryza sativa
attcaggacatgatacgcattcaaaactgcctcaccccaccattccttggaaagccctgcagtgtctaacatagcattcaccccatctcagttagagtacggttatttctttcggccaccccatttgattggggtgaatagggaggcgtcctctcatgaataattccaaactcttcgcaaaaggatgcaaactcattggaaaaatactccccacctctatcagacctcaaccgtttgattttcctttcaagttggttttctacctcagctttatagattttaaagtaatacaatgcctcatcctttgttttcaatagatacacatagcaaaatctagtgcaattatctatcagtgtcatgaaatatttctttccccctttagt

SEQ ID NO: 54955 - DNA, 194 bp, Oryza sativa
cgttcgttagtgtgtgttctatcttctctcgtttttcacgtacacatttttcaaacaactaaacaatatactttttttaaaaaaaattatatgaaagtggctttaaaaaatcatattaaactattttaagttagttttagctaatatttaattaattatgtgctaatgatttgctccgttttttgtgcggaagg

SEQ ID NO: 54956 - DNA, 245 bp, Oryza sativa
cggctctggtaagaaagagtgtttgaggctctcttcctgatggaatgggcgaaggcgtgcgtaaaccccctgtcgccacctaccccaggatctgatcggtctgtgactggtcacagcccggataaccaggcgcgttgcatggcgttacatgcggcgtgacgcgctcgtccaaaccgcaataaatgtggttaggtgagccctgctatgctcacctaccccgtatacgcggcgcaaaacccacaagg

SEQ ID NO: 54957 - DNA, 1501 bp, Oryza sativa
tcataaatgaaatattgtgctatggatattgttctactcacatattagaaaccaagttatagtgtttgatacgggggaaaggaaatcttgattctttttgtaactcaaatgtttcaattgccttcaggttgtcaaacatttccttgacccaaaatcaatccagaaggtgaattttgtatacctgaagaacgaggagagcatgaagatcctgcacaagtacattgatccagaagtccttcctgtagagtttggaggaaagaacaatgtggtgtacagccatgaggagtactccaagttgatggtgaaagatgacattaaaatggcaagcttttgggcatcggatacaaaaactgaccatgttaacaaagtcattaacgagcactccgtccccgaggttacgcaacagtcgtcgctggtggctgcgaaagcgagctgaggagtatcaatctgccatgatgggggttataaaccaaaacaaattctaaaagacgatgtagaggactattggtatgttcatgataaataaatggaactgcagaataatttacctgggatgttacagctccatgtattactgctaaaaatctttagctaaagaccagtctacaaaaaatctttagctaaccgacctgagctacagattcagagattatagcgagttcattacaaactatcaccagtaaaaggaaataacagactttaatttgcccggtattatgtcttgtctctggatgtttttatcttaactctgccattatttgtctatttggatgttattctcagtgttctactttctttaattattcctattccgaacagcaccatgaaactaggatggacaattcggattctcttcaggcctttagtggaaaaaactttataacaagttgtagggcatcacctgtaaggtgatgcaacttctttcaggcccaatgtctttcaaccattccctacaatcatttacacaagatgctttttaagaaatggtataagaaaatttgacactgttaaatacttcatccgtctcataatatagtaaactagtactagtagtagtagggacacatcggagacacattattgtactacaaatatccacatttataataccatatgtcccacaagatatttaaaacttggcattgtttaaataagatatttgcattaaaaaatgccgcgccaggaagggttcgaaccttcgactttttgtttaggaaacaaacgctctatccactgagctacaggcgctctcaatgatgatatggccaccacttcttcttgggccgggccggcctgccacaaacggccattgcaattttggccttttctgataggccgctgtctcagcttggccttttctgaaccctgaagacagcagctcacctagaattgtactctcaaatgaacaaacaaacagattacacaccatcaaactatttacagagaaccaaagagacgaagattctgaaaagcagcacagaaaccaggcactgccaggcgt

SEQ ID NO: 54958 - DNA, 1501 bp, Oryza sativa
ggttagtggtgtatgaaactgacatagataaagattaaattggtgtttgaataattaagttttaattattataaacttgataaataaatatatttaatattttaaaataaattttacatagaaagttttttttacgaaatacactatttaataatttaaaaagcatgtcaacgaaaatcacgtaaaatctgaatttcaacccacccaaagataacgcgcacgacgcccgcgcccacggccctcgttgacccgcccgaaaaaccccaccaaaccccccctcctcgcaaccggccgtacgtgcagccaccacgcaccgaaccaaacccgccgcgagagcgagacccacccaccacgcgcggccgggttcactcaccctcaccctctcagtggcagccgccggcaattgagccccgcgcaccaggggcagcgccgtcaaaacgcaacgcagccagggagaaaaggcaagttgtgagtgagcgagccagccagtgcacagggaaatcggggaaatcgtcggggaaatcgcatgccatttcagcccggaagatttgatttcaaaaaaaacatttaacagcttccttaaacaaccgaaaccccccacgatatcagctctctctctctccctcctcccatctcctcgtcttcctcctcctgacctcctcgtcgtcgtcgtctctcttcgccggctccggcggcggcggctgctcgcacccggtggcgtgaccgcggcggcggtggagtggagtggaatttgggttcggatcggcggagagaggaggaggagagggggtaataattgggaggcagttgggggagtgtaactttgggcattgatggcggggtagagaaggtgagcccccaaggaggagggtggtggtggtggtggcttctgtacctgcgaccctgcgttgctctgcgcccctctcctttattgcgtttaatttccctcccaattccgtctctccgctgcctgcctggcttctccgcgattccatccatagtttggagtggggaggaatggggagtggcggcggcggcggaggtggtggtggtggtggtggtggatggaggaggaggagatgatgcgggctggtggttgttgttgtggtggtggtggggtctgggcgcggctactgctgctcgtggcggtggtggcggcgcccggggcggtggtggcgcagcaggggaacctcacgtcgcgggcggatctctcggggctctacgcgctgcgcggctcgctcgggctgcgcgcgcgggactggccgcgccgcgccgacccctgcacggcgtgggccggggtgcgctgcagcggcggccgcgtcgtgtcggtcgacctcgccgggctgcgccgcacgcggctggggcgcctggcgccgcggttcgccgtcgacgggctgcgcaacctcacgcggctcgaggccttcagcgcgcccgggttcggcctgccaggctcccttccggcgtggctcggcgcggggctcgcgcccaccttccagctcct

SEQ ID NO: 54959 - DNA, 189 bp, Oryza sativa
cacaggaaacaaagttaatgctggtggtcctggtccatgctaatgctgcagttatgcataccctgtttctcaaaccaattcttgcgtagtacggtgtaccaatacccatacggccatacccagcgagtgctgcagtggtagcagtaaaaggagttcgtagtacactactgtatttattcataccgtaga

SEQ ID NO: 54960 - DNA, 207 bp, Oryza sativa
ccattctcgcgaaccttccacacacagactatgagcttagaatttcacccaaggccccgggccgaaccggcaaaggggggcctgcgcggtctcccggtgaggagccccacgctccgtcatctggcgcgccaggtaaggggctctgcgtgtgtttttctaagctctcgcattctttcgtgtgcgccaagcttttcctgttcagcccaa

SEQ ID NO: 54961 - DNA, 980 bp, Oryza sativa
tggtgcaaattagctagctcactctatcactgcgctgcattagcttagcatgacacgtgtctccgatccaaacctccatgggcccacccaatcaagtcctgatggcgaataaatccttctctatctggtcacccatcacacgtgtacagagcccggctagctgcatgccctttcagcaacttggctttgttaattagccgattaattagcgtcgattaaccacagctccaggttctacgtaatcgtgagattaacctaactacaattttaattacggatttgaaaaaaatgtgcacttgcttacccatgcgtacacagttatatattctcaaaatattgttattatattccctccgctcctaaaatataatggattttggttggatgggacatatcatagtacaataaatctatacaggaagcctgtccaaattcgttgtattatgattcttttttgttagataatgaaatatactttcagtatttgctcaacgagctacaaccaattattacaccaaatcgctcaaaagcgttcacaatctaatgagaccaaaacagaaagcaacacaaactaataagcatcaacacaagattaaatatctacaattattgaaatcttattcgtgaaccttcattcgaagttggcaaaaatgtacatattattcattgtactataatatatcatatcaatcaaaatcttttatattttgatataaagagagtattagttaaagatagatcgatcctggttggacaaatccaaccgcagttcaattccggcataatccagggaaatggtattcatgttctaaaacataggtagcgtgttgctagagctatctatctatctatcttctacctgtcgctaatgatcttttcaactgtgacatttgtgttactcaattaatccaacaactccccagcccaagagtaattaaactaaaccacgtaattagtcatgtaattaaactgcctgcagt

SEQ ID NO: 54962 - DNA, 996 bp, Oryza sativa
gatggctgcacttacaaacttacagaggcagagttccatggaggccaaccttggtcatggcccctccagctttagaaatattgcattattggagtccccaagtctttgatactctaatacttcacaaaatagcacaataaccgttcaaagaagctatcacactgtctctctccaatttattgttcaagctccgccgctgcaagcggagcaagttgctgcgcggtgtttcttttttttttcacgaacacgcagtgtgtgtcagcattagaagaaaagagttttagttatacaacacaataagcctgaccggcccttgccaagtaacaagggagggatagcaggggttgaacaaagagaagggatacaaactaacaaaattgctgctcctagacagaggaagaaaaaaggaaaaggaaccccctatcctcccaataggtcccaaaacgaagcggcactagctaaagactagagcgctgtttctgttaattatcacaaactaaagtacccatgtaactcgccagagatagaagggaagatgaggtcaaatcgtgatatattgcttagttatgagcatttaacaagagatgcaaggaaggtgggaagtctctctttgttttctatctcgatcgtgtgaatgaatctggacaatatttatgaaagacggcacacgaatccaggcagatgtacaagggattggcgtgacaattttacacaaaccaacggctaaaaagggattgcaccacatgtacatcactggagcaagtgaaatttcaccataaaagcagccagctttacgcgagataatagcgaaaggaggagagatttgctccggtccaacaaaaagtacatcgaggtaccagtacctcacggtaccaagtcgtttctgatcgttggatctaaaaatgcccattctatccagctagattcaatgatcggaaataatttagtaccgtgaggtaccggtacctcgagataaccggaacaaatctcaaaaga

SEQ ID NO: 54963 - DNA, 1008 bp, Oryza sativa
tctatatcagtagatataggccccactcaactcagttcatagatgattccagttcagatttgacatatacagattctagacattaccagtttaccacagctttcctacttaccacctggtgatatacgattaattcaatgagactttattgcattattgttttattttatattcattttataccactggtttattaaataatctttgaggagggataacttctgaagcaatttttatgacaaagtaatttctacctttgttatgctcagtatcactgtctgtacaattaagtgataattcaaaaactgtgaatagatggaagctttcagccatgctttttctttcaaagttaaaaaatgttgtactggaggaaataatctctcctttttccccacctaatttccttctgtttcaagaaacattatggtcagttgacacggctctatcgcaaccattggaaatctttaatatttcctatataacttctgcatattgagacatctatatataagctatgactacaaaaagaaatggtatgttttaattgcctaaaacgaagtacaatgatttggtaataaaaagaccttttatgcatatgaaaaatactaaactactgtgagacataaagagttcatatttctccaatattatttacattcgttaatcagaaagaatatatactgaaggaacaactcaaatatagaatgtccatgcggaaaatcctcttggaaataagcaaaccttcactgatataataattcaagaatcaccgagctaatggcacatgaacttttgattccaattatttgtgattagattgatcaccttccctagcattaaataaacagtaatctaaaactatattctgattacttagtcatcttggatactgttattttattattctggtcaatctctgatgattggcccatcaccactatatatatgatagttgcttattgcttcctctttgcctcctcactccatgacccctctctctccttgata

SEQ ID NO: 54964 - DNA, 942 bp, Oryza sativa
ataaaaccaaaaacgtgaactttcgatgctatataacaaattttgcctataaaattgtagtggttaaaattttaaaatttaatctaaaatgagaataaaatgatttattcaaatgttatcaatgtaatcgtatatctagattaatggattcgtgaagatagaaacacacagctttaagaaatcataaataataaaagctaatgctgtaaatttaaaattcaaactagtaatatgaatttgaatttcgcctgcggcagacaagctggagggcaaagtggcaaacgatggagctgataattccgcctgcaccgtaaaagctaactttctaacagtgtgtttacatgatttaccatataatgaaaaccagtccattatctaaaaaaaatataatgaaaaccagtaaacatgaattaatttggactttgctttgatggcgctatccgtttcacattgcagatcagaggagccatcacaggagggatgattccacacagggttgagttgcgtgtcatgatctgaactcaaagtattagcgatctcactacaacgaagaaattggcattctatataggccagtgtatcattaaattgttcagcacaaagaggatgccgctatagttatagacttatagttaacactgctgcatcttttgtgctacagcacaattgtaccattcctacggggtgtacatttcccccttaataataataataaagaaaagaaaaacttagctgattccacagttcagagtaactccagacatttggaaaaatgaattttacggcgcatggttcaaattacgtctataacacgggaaggcgtaaatgtgggtttacgtcaaccctgctcccggaattcgctggtgcagtgtgggcccatgaactaatgtgggcctaaataggcccaaatactcatgactagaaactgagctaagcccacag

SEQ ID NO: 54965 - DNA, 457 bp, Oryza sativa
ataaaaccaaaaacgtgaactttcgatgctatataacaaattttgcctataaaattgtagtggttaaaattttaaaatttaatctaaaatgagaataaaatgatttattcaaatgttatcaatgtaatcgtatatctagattaatggattcgtgaagatagaaacacacagctttaagaaatcataaataataaaagctaatgctgtaaatttaaaattcaaactagtaatatgaatttgaatttcgcctgcggcagacaagctggagggcaaagtggcaaacgatggagctgataattccgcctgcaccgtaaaagctaactttctaacagtgtgtttacatgatttaccatataatgaaaaccagtccattatctaaaaaaaatataatgaaaaccagtaaacatgaattaatttggactttgctttgatggcgctatccgtttcacattgcaga

SEQ ID NO: 54966 - DNA, 1501 bp, Oryza sativa
gcaaacagaaaaaaaaactgagaccaaattaacgaggtgacagttctaattggtgccaaatttattttgtgactactaatttatcagataaacaccaataatgtcaggaagtggtgttttgcgtaggaaacccctctttgaagtcgaaatatgtcttttaaaaaagtcgaaatatcctttaactcacctgagaattggaacgctatcatcgatccaagctgtctcattgattgagcatttgagctactggcttataaaccaagaaaaataaagccaaaaaatgaaaataaataattttctagtaagacttttatactgctaagactattcttagcagttcaaaacccaagctgaaaaaaaagggcaaaatcaactttaaaaagttctaaattaaattttcactattgctccctggtgattcaaatcgtcgccaaccaaatctaaaaaagttaaaaaaaaaactgaagttttcgggcgaaatcgattagtgcaggggggtccgaaatttcagaagacgagatcagattataacaatgtttgccctctgcatttaacaagagatcaaaggatgatggattgatgggaagtctctgtgtctgttttttttctctaatatggacaagattgtgtaagatggcacaccgatccatacagataagcacgattatcagctgaatttcgaacacaccacgagcaaaaagaactcaactgagatcccctgcagtgcagtactgcagacgacctgcatccaaaagaactgtatcacatgtacaccaccgaattaaatcagtggcatctccaggaaattcttcttgggtgtgactaagtattttataaagtatatttacaacatatttctcatctagagatagtcgaattctgtctggctgtacaatatttaccgtgtagtggattagcaaacaacaaagagagatgtgcaccacacattgccagcgacgacattacccccaatgactaacgtagccggccagctgccgccccaagctgcccatcctcaccaccaacaagccaccttcaaatagtgtaatttgcaactttaccctctcatatccttgattctttggataattattcccttccttgtactatttttaaatgagatggagaaaatagtagggcaaggattcagaagaggagtaaaaatctcagccaccacctatatgggtttgctacattcagttgttcggcagtgtatcaaggtgacatgtgaactcctgatacctcctaggccaacgaacatgaaaatttagtttctagttccatgaacaatgttcctctctctctctctctctctctctctctctctctctctctctctctctctctctctctagcatttgtgtccattgatctatatatcatatgatctaatgccatcatttaaatgcagaacttagctctggaaaaactagagacgtgtaattaatgctaattctttcttgagagtggactatctaacattgtgatagatcaatatctc

SEQ ID NO: 54967 - DNA, 348 bp, Oryza sativa
cagtagtaatgctgtgtgtgggcttattttcatttatgatagctttggattcggaacaactgcattattgtcattgagtgttatggtcggatttagcttttcaacctttttaaggaggaaatatatttttgcaacaagttcaagttatacttttcttgatggaattgtcttcagtagttcagtatattccatttagactggaacttggcatacgaactagctgggatttggtatcatagttcataggttcagttgctcatttcaaatatcgaggctgtgaaatagtgaaattaatcaaataacggaaaggcaatgacacgggttattatggttcctgatcctttttat

SEQ ID NO: 54968 - DNA, 726 bp, Oryza sativa
agtattcgattcattagacccggtaacagtcattggcattagtagcgatcgaattgagggcacatagagagggagtagctactcccggtagtagcatataattttcaatatatatatatatatcaataaatttaaatctttagtgctcacaatacgggccgggtgtttttttttttagaaattagctagtgaggttagggattaacagctaatgtctctctttgtgtgctttaatttgtgcttgtgttaaagggacacactagcttataggtacttctgcctatattgacttgtgcactcttgcgtgtctaccttacaatatcacaaaaaattattttatatatttacattaactttggcgtatacttatgaacacctcccgtagctggtgctactgtcgcacctacctttatgctgcaacatccatagccaaatccctgtgatatcacaactacctagctaagaaaatggatctttctcgcgatgggccaggctaaaccatcaagaaaatagggaaaagcatgattaaatatttgagtaaattttgtaaaactataaatattttgatcatactatcacaaaactacatatttaagtagtatattacagcactattgatttaactgttataaaatcagtccaaaatcaccattagaaaccaaacgcaaaagtaacatcataggagaaccaatcaagatgacgacaccgagacacaatatttgttaa

SEQ ID NO: 54969 - DNA, 378 bp, Oryza sativa
aattcctgcagccctatatatatatatatatatgtgtgtgtgtgtgtgtgtgtgaaaactattctacatccggcgtatagctattatataccccccctctctcctaagggcggctcaacccacctcccctctctttcaagggttcaaaacccacctcccacctcagttaaaagtcggtcaaagcattctcacattgatcaaatcccggtcaagccgcctactaactcctcccaccaaccacctcttctcagctctcgtctcgcagaacggtgcagtaacacgacgatcactatgtcttacgtgtagtaacgaagttcgaatatagttgaaatatagtcatgacggatctactcttgataagtactttttttagcatca

SEQ ID NO: 54970 - DNA, 1501 bp, Oryza sativa
tgtttaatggacttttagtatatgatagatagaagatagatttgtgcaaaattgcgatggctccaagacgaactacaattaatcttagcgacactggctcagtttcaagggaaaatgccaaagagaactctgaatcctgatgccacccaagagccaacaattatgcatgcctataacatataagtagcaaacacgctagctggagagatttggagtttcctctgtctccatgagaccatgacacacatacagtctgtttctctatctcattgtgtgcatgtaacatttccaactcctttatgttctatttgacctacatatatatgacatcacatttggtttgacacgatgattaatttaataccctttggctcatattttttatgagccaaaccaggagagtttgcataattgattttattgattagttcggcacatgcatctggagcactggtgcatcggagccgtataggcatgattattcagtttgtcacttagattctttttggatcgagggctcatcgccctgctttttgtgggttgcaatctttacaaagtacaaatccagacctgcctctaaaataccaccatacacaccgcttcgattgttcatcaattcgcacatctcagtcacccttgtctctgcaccggttcaatgtatgcacatcgtcataattaatatcatctaattaatagatttatccatgatcctctaaacttgtcccaattccttgtttgttttcactagggttgaaaccgatcaaacacaattgtgatggatccaacacgtactagtggaaatcccaatgtggtcgaatattgcttcaatggtaatcgaaggcatcacgatagagtaaacacgcaataatcactatgtgatttgatgtgattatttcacacctattgacttcagagcaagctgcattacccaacaatcatgcacatgcaaccatattctccgacaatcctaacctagtcgcctcaaggatgcatttgaaatttctatgacagagataagaacaaaatcgatcagtgatttctctgctcgagcggccatggccagacagtgtgcagcggctatggcgccgatgcatgcttccagtctccatcgcattgctcttggtgatgccagcatttccgtatcttattgtggcatgagaactcctgatgcatcctatgccaacagccatatcaaccgaaccggaccattgttggatcttgtggcctctgcccatgtccattaggagagaaaaacattaaagcaagagaagtgttccagcccttaataaagtactttggaggtaccaagattttataaaattttgatacctactacctagagatactaaattttacactaaaaaatgttatgcctcccggtgccgccttctcaaagatggtaaaattatgcttaaagcaaggcactcatcattactatttgctaacgtttctattatttgtccttttgtggccaaagggtagtaattcggagtctcagacc

SEQ ID NO: 54971 - DNA, 520 bp, Oryza sativa
ctaccaatgatttaacttggatcacaaaatttactttaaatattacaagtccctaataaaatataatatattttaattgctctacaaggcaatttgcctgtgtgcagtgacggtgaggacgaaatactttgtagtccccccttcaaatcttgtaggcacacacacatttcagaatttgaatgcatctcagaccaaaagttagctaaattagatgcaaaataataaaggcttcataggatgtagatctctctactctctccaaatgcgaatgcaaaatttttcctgggccgggcctcctccagctttcggcccactaccccctcccacaagcaaagcgaacattctcttccattttccttcccttccccactcgcacgcccaccgagcgcgcggccgccgttcgcctcgccccccgccgcgccgccgcggccaccaacacctgctccgtctcatcccggcggccggcggccggcgcgcctgagggctgggtgcggggattcccccgggcgccgggagccga

SEQ ID NO: 54972 - DNA, 1501 bp, Oryza sativa
aagtgttggcataaacatttaggtacatagttgaaataatgttttatgtattaatgatgtattagacttattttggtggtttagatggagttccatttattaaaatcatatctatcttttaagaacaatgataataaataatggtgataatagcagagtttacacttacctggacaaaagtgaattttgattaaatctaagagacattcttatcatttatattaaagtctacggtctatttcacaacataattttttgttactacgaggcaaaatctataatttgttatatgtatatggtgagatatgacttaattctcttagcattatttatataaacaataaataagatgcacgcgcatctgcgcgggcttcctttctagttacataaaaaaaatatcatcatcaaacccaaatccttttattttatttttattttgaagactaacccaaatcatgaaaggatttccaaacataccattttcgctcagataattttttcctaaatagtaatatgtcaagtgcaatgcatcagaaaccacattgtgctctaattaatctatcaaaaggatatcacaacgatattgaagtccactccttgcttcggcatcctctccactgtgtacttcttgtgattgtgatgttaaatcgtggtgatggactgacggtcaaattcagtgtcatgctgcatggttggagcggcatcagaatccatgcacggaacaatggtcttcaagatatcacagccctgttttcccacatcaccaggtatctgaacaatgtcattgcagttcaatgcagcaactgctgttgcggtgtttcgccgaagtagaagaactcccgatgtctcctaggcctaccatagcaacccatgatgctcataacaataagcgatcttattcactctctgtcagcttgtagcacttatgcttgttcatcgatatctcattttgtaaggagcaaaaaggggagtgagatatcatatatatgattcgaagttgtattcaatgtgcatctatgaattagtagcacttgtgcagttgtgctcgtgcatatcaccttatatggagaaaaatatattgttttctggtctgtagttggtgaggaagaaatgaccaggacctgaaaaaaaatcttatttctttttctattcttagtaccagccaagtttgttgtcttcagagattctctaattgttgtttaattggaagcgccatatgcagtaatctggaagggtgtttactactgtaattctgcaggttcctttttttttttctcaaacatgaatgttcaattgggcaccttctaggctaagataaaaagtgagtcatattggtttcaaattacataaaaaaccaccatgatcaaacccaaattctttatttatttgaagactaacccaaatcatgaaaagattttcgaacatatcattttcgttcagatattctttttcctaaatagtaatatgtggagtgcagcgcagcagaaacctcgttgtgctc

SEQ ID NO: 54973 - DNA, 265 bp, Oryza sativa
ttcccctcctctctcctcgcgccttgctgggccggccggaggccacgccccagctcagcccgtgccccctcctctctcccgaggtcaccgacaggtggggcccacctgtcggacccgtctcccacctcgcgccgcgccgccgcgcccgcaacccccgccacgcccatgcctccgcctcctccgggccacgtcggccacgcccgcgcgtgcgccgcatccctcgcgcccactcccctctctctcccgcccgcgcccgcgcccgaga

SEQ ID NO: 54974 - DNA, 1501 bp, Oryza sativa
aaaatggccggctcggcggtgattggtttgaattgtgagaggggaaaccacagtctatctttaattcaaccgtgcggcaagtcttggctcgattcaccccgggtagaatcaaaatcggactcggcggcggctttggacgggcgtgcacggcgtcgtgcggcggaggtagtcccggctttgtcgtcgccaaaattggtgtggcggcggcggtctgagagcgtcgtgcggctggcggtgcgccaaggcggttgggcacgcgcaagcggtcccgaggccgacacgcggcggctcggcgcgtggctaagtcggacgctaggcagcatgcgtgaaggggaggaagagacaaagaaaaccacggctttgagtagattgtggtccccaaggaccatatctaaactttgtgcaagattgggtagaggttgggctgctctagctgggctaggcatttcatcgagcaccttgagtgcaatgaacagtgttttcagaattttttaaatatttccctagaaaagaatgaatttaatctctgagtttggaggggtttcactagggtttgaagtatagcaaattctcactattaataggataaactaagggaataatttgaagtttggaatttgagagaatttgctcaaattcactaaggtttaaaataaagggaatagttagggtaaattagtagagttctaagaagtaacacttaaaccaattaagaatcaaataaatttttaaattaccctaatctagtcaaaagccagcatgatgcaatcaaattatagtttaaaatttgaagatgttacagccggcttggcctgcttcggcaatcagcaaaggcacgtaaataagagccgtcagattggctcaacggctgatatcacccaactgcacggccgtgactttgtagccaaagtcagaggatccatttccatagtgacctgactgtttttcccttgcacctctgcagtacagtagcccacacgtaggtcacacatcagcagtaaaacaaaccgaatgcacagtagcaagtcaaacccggacgaactctccatcttcttcgccaccgcctgccgcccaacgtgcctcctcgcctccgccttggccgccaccgctaccgccgggactggcacggagcgggaggagatctgtcgtcgttgctaaaaccacctggtgctgttgcaaaaatatttaccacccctttgtttctaccagctgagattaatttattaactctctttaacaagtgttgatttagtgaagaaatattttccttttaaccaattaggtaagcaacacaaatgcgtatatcctcatgagatcggtttatcctcattctgcatattgaaataaactttgtctccgacaacgttacttgaaattaatctaataaaaacaagaagaaaatggatatatattctagattatattatgctttctttttattgctggaataaggttgatctgcatcaattcctatttgtaattcagattgcttttattgctg

SEQ ID NO: 54975 - DNA, 382 bp, Oryza sativa
gaatttccagggatttaaatattgcttgtgctcaattttaattggtcaaaattatttctagggctctgaaaattccactaaaaatcctgttagtgaatttcgacatgtagaactcaagaaaaattccacatgtcaaattcgattattatttgtattacttccttagggttttctcttgatttgcaccggcattttcttagggtcatttataaattaaattttaggcttgggaggagaacttcggggtgtgacacccgccgtcccccaaggtgagatcgccagctcccctcccctatccctctccattcttggctcttccttttcttcctctcggctctccctcgtccttgcggcggagcggcggcggcaacctcgccaagga

SEQ ID NO: 54976 - DNA, 968 bp, Oryza sativa
ccttagggaccgatatgaccggtattataaaatttaggatgctaaatgtaaggtttcaaactttagaatgctagatggactttcaaataaagtctatggggttatttggatttttttctaataaatttttgtcctccaaagtaagatgctattattttttagtaacaaatataaagaagattcacatagcacacgttcattgtcttgatgttgctcatgctgacctattttggttaggctcttcggatcggtagatcataattggttagatatgcatactggtacatgttaagtgtaactcgacgttcacgataacatataagtttgatgcattgtatgagatcgtgtgtgtccaccttttatggtaagaaaccaaatacagaatttaggcatgtcattctatataatagtgaccggaagcggatcctctgacttcgaccacaaagtcacggccgtgcagtccgcgttgtatccaccattgaaccaatccagcggctcttatatgcttcttgtgctgatcgctgaagcaagcttggccggcccatcagctctgtagaaccacgccaattcttattttgtcgccagagtttttttttctaataaaaggtatcaccgaatataacactccaaatcttatttttcctgtcttggttcttcccttctacgttgtaaaagaagcagtcaactgaaaatccaatttttaccatggaccaatttctgtgtggtgaagtaaggaagaaaagactagtagagagcattatggatcgagcagtaaaatatgactactacatgcttattatttgtgataccttaatattacagagttattttggtttttttattttttgaaaactagttatttagttatggagcttgtgttacaatgcatcgcctttattttagttatgtattcagttttgtccttagattgaagttcactcatctgctagtaccccttattttgcagg

SEQ ID NO: 54977 - DNA, 788 bp, Oryza sativa
cctcacataaaaagagctgatttattttcacctttcaagcaacaaaatctctcacacataaagtagtttacctttagctacatcactgtgttgatactggtaccttttgtgatctaggagtaagtaatataatcatataggctttgactgttcgagctacggttgataagccgtagaaaatgaaaaaaacaataaaaaataatttataaataaaatttttaaatttgtgtcactagcagtttaaaatataatgttacaaaatattaaatttttttaaaatttaaactcttgtgtatgatatgttaataaacagactttttaaagcctaggcttaagtgatgttcaatccaggtaaacagaagggttataaatttggttatttttgtaaaaatgctttgacagttgacaccactaatccattccaaatttccaatacaatgaacactgatgactgaggaggaaccagccaggaaaggagatggtgcagaagaacccacaccaccatgctcacagatgcacagacacagggctcctccccagttttaatgctaggacactctccccatccttggaatctgttgcattcaatacagctctcaaaaaactaaaagaaaaaagaaaacaagatttaatgttgtcctagctagatccatccaaggctccaaaaacactgtttggctcctcccagtagctgaagtgaactgaactcctctcattttcaagagtgcattagtactcactcccccccctcacatgtgttgtgttttgcttgcttgtgtgattagtgg

SEQ ID NO: 54978 - DNA, 1501 bp, Oryza sativa
atccaggctacatagtttctcatcatgtgttggttagcttatcggttgtagccaaaataattaattttttagtggctttagttttcttttcatcatagattattttccatcattttcttttaaacccgctactaacattgatatattatcataaattatttttattgcttagtttatttttatatgcttaccaataatagctcaaacgattaataatatatcctgattagtgggtttattgtgctatatagtcttgttaactttaataaatagctcaagatggtgttagggaaaaggttgagggatgtttttgataaaccttgagttccactttacactcacggctgttgttggcccgatctttcgatgagttgataataactacgatttaggagaaacgttgatgacccgactacaatcgtataagacgttgcattgcgccttatcgatcgatacacctctccgtgggttgttgatcttgccgatacagatcaaccttattccagcaataaaagcaatctgaattacaaataggaattgatgcagatcaaccttattccagcaataaaaagaaagcataatataatctagaatatatatccattttcttcttgtttttattagattaatttcaagtaacgttgtcggagacaaagtttatttcaatatgcagaatgaggataaaccgatctcatgaggatatacgcatttgtgttgcttacctaattggttaaaaggaaaatatttcttcactaaatcaacacttgttaaagagagttaataaattaatctcagctggtagaaacaaaggggtggtaaatatttttgcaacagcaccaggtggttttagcaacgacgacagatctcctcccgctccgtgccagtcccggcggtagcggtggcggccaaggcggaggcgaggaggcacgttgggcggcaggcggtggcgaagaagatggagagttcgtccgggtttgacttgctactgtgcattcggtttgttttactgctgatgtgtgacctacgtgtgggctactgtactgcagaggtgcaagggaaaaacagtcaggtcactatggaaatggatcctctgactttggctacaaagtcacggccgtgcagttgggtgatatcagccgttgagccaatctgacggctcttatttacgtgcctttgctgattgccgaagcaggccaagccggctgtaacatcttcaaattttaaactataatttgattgcatcatgctggcttttgactagattagggtaatttaaaaatttatttgattcttaattggtttaagtgttacttcttagaactctactaatttaccctaactattccctttattttaaaccttagtgaatttgagcaaattctctcaaattccaaacttcaaattattcccttagtttatcctattaatagtgagaatttgctatacttcaaaccctagtgaaacccctccaaactcagagattaaattcattcttttctag

SEQ ID NO: 54979 - DNA, 1501 bp, Oryza sativa
aacagaagggttataaatttggttatttttgtaaaaatgctttgacagttgacaccactaatccattccaaatttccaatacaatgaacactgatgactgaggaggaaccagccaggaaaggagatggtgcagaagaacccacaccaccatgctcacagatgcacagacacagggctcctccccagttttaatgctaggacactctccccatccttggaatctgttgcattcaatacagctctcaaaaaactaaaagaaaaaagaaaacaagatttaatgttgtcctagctagatccatccaaggctccaaaaacactgtttggctcctcccagtagctgaagtgaactgaactcctctcattttcaagagtgcattagtactcactcccccccctcacatgtgttgtgttttgcttgcttgtgtgattagtggagtaatcaagaagaaatagtggggaaagataagtgtgtgtgggtgtggcaataaaggtgaagtcttcaagtttgcaatcttctccctttgctccccacaagattacaaatcttgtgtttgtcttgttgccactgccgctggtgatagactctaccatactagagaaagccatagaaaggagataagaagaaaccaagaaaagggagaaacaaaagttgaagaagactttctgctgatatttttgcacatatatataattttttctcctccatctgcactctctggaaagaagaagaagaagaagcagaagaagcttggagcttgagctttctgaatttgtaagtttattttgctctaattttgggctaccaattgggtttatatttctctagtggtggtgactggtgagtaattttccccttattttattgtgttgatgtgaggccttggggttttctatctctttgcatcgttttcgctttcatttgtttagagatttgttctttgaacaaagcatgcagaaatctctgaggactgaagtgtttctctctgcttgtcactttctccccaattgtggaataactaagaggaatcgacatggggtctagtcttccattccacaagatttgcatcttccccatgaatcttccaagaaaatctgtatctcttacttcctttctttttctctaggtcttgtcttgcaaactaggataaagatacaagttagtagtacaagaaacagtaaaggtgaaagtcttgtgttcttttccctgcgatttcttctgaaaaaggtcgccattaagaaaaagctttgcaatctttggagtgttcttctcacccagtggtttctctgcttgttctcttctgattaataacagtagtagctgctcattaaattgcatctttttttaatttatttaatttctgttgatgtgaaacgcatccaatctcttgcaatcaatgtgaggctttcattggcgtatgagcataaaaaggggggaaagaaaggtgggagtctttaggtttctactcctaaaaattgtttctttcttatgtgcagcagtcgg

SEQ ID NO: 54980 - DNA, 162 bp, Oryza sativa
ggggcacttccccgtcgactacttcgtctacaccgccggcggcggcgccgccgcctcgccgccgtcgctcacgcggctgccaccttgcttcatcggcgggcttctccgacccggccgaggacgagtactacaagccgtaccgagtccagcggcagcggatca

SEQ ID NO: 54981 - DNA, 167 bp, Oryza sativa
ggtgcctcccgggccgagactacttcccacggccgccaaatgcatacacactgcaaaaaaaaaaaaaaaatctcgtagtgcaggggaatgcaaactggtgtgcaatcatccagtgaaatttttgttctggtcgtgtgtgaaatttagatcgaaaggaatcaaagagt

SEQ ID NO: 54982 - DNA, 1501 bp, Oryza sativa
acctcccccagctccgtcgtcggcttcgccgccaccagacggctcagcggcggcgccaacagtggtccgccggcccacgcgccgtcggcggcaccctccccgtcccccggccgaggccgcctccaccccaccaccaccaccagcgccgcgcctcgtccgccgcccccgcggggctacggaggggagaggaagcggcggctcaagctcaacctcggcgagagggtcgggatcgcgctcgccgccgtcgccgcggcattgcaggtggccctcgtcggcgcgtgtctggcgttgctcgctcgccagctccggcggggcaagccccgcgacagcgaggatgcggcggcggcggcgtcctcctcttccgcgccaccgccggcgtgagttgtggagttcgatcgccgcgagacggcggcggctatgaaaatgtatgacagtgtagtggagagtggagtatatatacgttatttggcttaaatgtaaaaatatttgagtgaaattttacatgaatttggtcaattttacgaattgctaggtatactggagatcggatatcctttcttccttcttcttcaagctagtttgaaaaaaagaaaagaaaagatggaatttcattctgaatgtcaccaaaatagaaagaaattccattgaaatccaaattcaactgatatttgaaaattttaaaagaatacattctcttcgactctagggaggcaaagagacataaatatcacaattttaattaagaaacaaaaataaaataatctatctatctattatattgttaaaacagctttgaaaggaggcaccacgttcgctgtgggggctagaaattctcacattaatcggagaaaaagaaaaaaagaaaagaagagtccaagtagaagtacaatctaaaaataactgaaatttagaattaaaaataagcaatattgaaagaagtttccatataagaacccaatacaagattaatcaaaattcgaaataaaaataaaataaaatctaaaatataaaattagaaaaaggaaaggagagtccaagtagaaatacaatataaaaatagctgaaattcggaattaaaataagcaatattgaaagaagtttccatataagaatccgatacgaaattaatcaaaattcgaaataaaaataaaataaaatccaaaattaggaaaggattgagagtccaagtagaaatacaatataaaaatagttaaaattcagaattaaaaataagcaatactgaaagaagtttccatataagaacccaatacgagattaattaaaattcaaaataaaaataaaataaaattcaaaattaggaaaggaaatgagagtccaagtagaaatacaatataaaaatagctgaaattcggaattaaaaataagcaatattgaaagaagtttccacataagaacccaataagagattaattaaaattcaaaataaaaataaaataaaatacaaaattaggaaaggaaatgagagtccaagtaggaatac

SEQ ID NO: 54983 - DNA, 169 bp, Oryza sativa
  unsure (1)..(169): unsure at all n locations
ccccgtggnttgtagatcctctgatatacactnnnnnnnnnnnnnnnnnnnnnnnnnnnnnnnnntgcaagcgtacccttaatgttctaacagtaccagcaccctctaatgcgcttgtcatagcttacagcttataaacacgtacttagatggttccagcggcgacaaa

SEQ ID NO: 54984 - DNA, 1000 bp, Oryza sativa
atgctcgtacttaatcttgatattcgcctacgtttataatgggtgttggttacaaatctgtttacccttgagctcatggtgaccagatctaacggtctcagtatagcggtatgcctgttgaagggacaaccatgttgcctgctccgttaatccctagtcgccagctcgccacataaattctctaggcaattcatattatctgcgcccgctgccactacaacatgacccttcagcatcgagatgctgaaatgtagttgcctaccaagagcaagccaaagtcgagccacggttagaaatgtagacacctccgaatgaagtggttagatctgtagagaagaattaagagaaggaagagagggagagggagagacacgacttatatgatatttcaccccacatgcggctcggcttgactcggttttttgccggttcattaaaaaatattgatagaagttttctctattggttaaaaaaaccgatactgtgattagcatttttgctcatccaaaaatatttgcagggtaattagtggcataaatacatatattgtggtgtttgaatctcctgaagatgaagatgaagataaagattgtttcacgtaaaacgaggtggtaataatatgtgattaattgagttttaattattacaaacttgaaaaatagattaaactgatattttagagcaactttcatatataaagttcttgcacgaaacgcacagtttagtagtttgaaaaatatgccacgagtatctaaaatttaatccatgtcttgttggagaaacgaacacagagtgttgcacgtttttacaagcaggggcagtgtctctataaacatgcctaaatccttttaaatcactatgtattttttgagagagcaaatatcctataagttaagccctactcgagttctaggcgtagaaatttttttggctccacccctgtataccagcaataggccaacgattattgatgcatagtaggagtagctagcagaaaaga

SEQ ID NO: 54985 - DNA, 1422 bp, Oryza sativa
ttaatgtagtcagtaggaggggccaaccgtatcgttagctggtcacatggaagcatggcctttagctatgtgggcgcaaagtgatgcctaactgtgcagttatgttagtgtagttaaataagtgaaggtactgaattcatgttgtttccctgtaatcttgagtagggaaatgcttgtgagcttttttaaatgatccactgaaagatagactgttgtatttgtctcccaagaaactatggttctggtttttgtttgggagggttttcacactatttatatcagagaaatttgaatgaatgtgaccttaattaaaagctagactataacaccctcttttgtagtttctggtgatggtatatctagtaactaggctgaatctaaaaaggaaaattgtagtgaagttcacattattttttcatttgacaatgattggcacccaaaagacctttgtgaaagtgagcacttgtggtgttagcagtggttctcatgatagcttgcaaaaggctatctatacaattgatcatctttataggatgcatcatcgttgattctttgccaatggcatctcttcttgagcgatttgtgtgcttcggagcatgtgccattttcattgcatcttttccactagcctgtttaatgttcatctagcagacatagggtttggtaggtggagctgtggtccattttgaaaatgaaacttctacaattccctaaccttttgtacaatgaatttgttgtcatcattttccttggaccactgagcagtttgattagttatatctgtcatgcatagagttaatttctatgaatttgctgctttctttgctttatcattttgcccatggcactttttctaggctaacactctgtctctccttttgttacacttagcggtttcagtggggctggagatttgatttcatatgtcatttcatctttatcatgaagatgcattattagattgtttagattccagggaccttttgtttcaatgttcttttttttccaagacaaccttttcaccatccactgttgtgtgaccatttgcccctgcaatcattgtagtcagtcatataaataaaagcacacaatttatcagctattcactattatttcctccattgccatttctaatgtagttttgtgggagtcctcattgtgcaacatgattattagtctctcaattactccacaaaataatcaacagccatttctctctcaaaaatgatcttcaagatattcatatatagcaattaagcagctgtgagaccgcaaacatgcccctaaaaaacataacaaaacaatcttcagaaaatcggtgctttaactactgatcacttctttttttcaaaaagaaaaaaaaatgatacttatttgcttatctttggtgctttacacctatttattttgtcctaactctgc

SEQ ID NO: 54986 - DNA, 1501 bp, Oryza sativa
acagaactgacccaacatgatcttttgaaagaaaattcttgaacattacatcaggtactttgactgatattctatacttcatttccactgttaatcctcccttcacagcttccctctctctgaaatcaaatactccatccatataaaaatatagtagctacttttgaagtttctcatgaaaaataaaaaggtaaattggaaccatgccattataaattttcccaaaataaaaagggaggtaaaaagattagattgcccttcactaaatgtcagttgatggaggtagccagataggtgtgggatggtgggtattttggacatttcatccctatgaagaccccttaattagtacttagtacttcaaagtagttatatttcagcataaaatttaaacactggaaatagccatattttaagaggcgaggtgtttggatttcatatcaagatcgtcatcaatgaaagctctccatttgctctctgcttatctccataattgcacaagttgatgattgatcagcaacgcgtgtaccaaattggcctaatttggggtcccaaaattgataattagagggaccatgtatacaatgctgtcactcttgggcattaactcctgacagagaatggacggctttcattatatgacactgtggaatataatctcacatctctcatgcaaaatacgcaattatggatgcagtgtcacggctcctaaccttcactgtcaattgaaggtgagagatgctgctcatccccgacatggaacctcagaggtcacagcatgggccttgattttgtctgaaaggaactgatgcgatatgtgcgtgtatattttgctacatttttttcccctctccattccattgtctgagacattataggacatttattcttctttttcttcctttcttaagaggataataatttatcatctagaaagcaccagtaatatggtgtcgtattacgtcgtgggtacataattatatcctatctatatgtgtgcgatatttatgggttttcaacataaatttaaaaaggctagagatttcgacaacttgaacatatgttaggagactctgcatttacgaaattgcgagtatgcttaaggtgtgggtctctttagcatatgttaggggtgtatccatggttgtgtatgtataggaaatgcatgcatagttgtttgcttcttctgtcccatgaaaaacagaactaatacgagatttgatacatcataatattatgaatctgaacagacgtattatttactaggtttgtcttttatgagacggaggaaatatgtacgtacgatgtatgcgtcttccatccaacggaaaatattattgccattttcttttaaaaaaattaaggtaaagaggggaaaaaatgagagattttatttgtgaggacagagaagtccatccacttgccccccaccctacgggcactatcttttaagccaaactaactccattaccacctccctcccttcttgcattggagtagc

SEQ ID NO: 54987 - DNA, 1501 bp, Oryza sativa
ggttccccttctgaattatcgttagtaaatacttgaaacaatatgtataacagatgaaaccaaaccaaagaaaagaaattaaaactaagatcaaatcatagtgtaccacgccaatttttatgaagagtctgaccagtctaattttttttaaaaggggctgttcagattgtaatcaaaataaaccttaccaaattttagtaaatttgcaatattaccaaaattttaatatgatttcttatgtatttattaaagtttggcaataaactaaatgtaggcatttttttagcaactttacccaaaaaattgtatatttgaaaatggcatcaatctgaataggcacgaagagtctctaagaaagttttcgtgtgtgtatcattttctatttgagatagagcagcggctttctataataacaacaatttattaggccaaactaagggggtgttatcccaccctaaaatcttacaccccgtcacatcgaacgtttgaacacctgtatgaagtattaaatataggcggaaaaataactaattacgcagattgcaaccaatctgcaagacgaatcttttaagcctaattgcttcatgatttgacaatatggtgctatagtaaatatttgctaatgaaggattatttaggcttaataaatttatctgtgtgtccgtatatccgatgtgacacgcaaaaacttttcacccctaatctagacacaacctaaagcttcgaaaaatacgtgtaaattcccagaatgacgtaaccagatattactctaccatatcgactgcgtcatcgctgatccatagagaggaaaaaaaaacttgtgccatttgaggcgcaacttagcaagacgtcgtcttggttagttggttgccttggagacaaagcataaatgcataatcagtataggagcaaatcgttttaaaaaaaaactataggagcaaatcgcgattaaggaggtgtttagatggggctaaaactttttagcccatgtcacatcgaatgtttggacgctaatttggagtattaaacatagactagtaaaaaaactaattttataaatgagagctaatccgcgagacgaattttttaagcctaattaatccataattatcaaaagtttactgtagcatcacattgttaaaatcatggcgtaattagactcaaaagattcgtcttgcgaattagtccaaggttatggaatgagttttataattagtgtatgtttaatactctaaattagtgtctaaacatccgatgtgacagggacttaaaataagtccctgtaaaccaaacaggccctaaatagaatcttgggggtgcaaattggcaaccccacttcttcccggaggtgcatatatccgagacgctcagcttctcgaagcacacgtcgcgtcccaccacgtctctctctcctactgttttctcacccaaagatccgattttcaccaactaaacccgctccgatcaacggcgcagccaagccggcgcgcgttccaggcaa

SEQ ID NO: 54988 - DNA, 1501 bp, Oryza sativa
tgaacattccttgacggttattctcgagatttgtgacagtgaccacttatggatcaaggaaggcgacttctggtgcatttttctgacaccattgccaacttaacctacacgcaagatacacgggtacccacttttctatcccgtatcctttttctcgagcctcatgtctaatgggctgactagccgttttcacaccctaagattaattgtttctaagttctaacaaacagtaattcaactgatgtaacagaaacctttttaccattgtttctgacctgacaagcatccaatttttttgtatcattgcaacgatcagaaattccactggggtgacagacaaaatacatgaccttgattttttttctcccactacaattagtcatctcctatgctctatcaatacatatgaggtaaagcttatgctctcttattttcttaagaaaaaaaagccatctcatatcctttcttcagttttgggcctccactgtgacgcttgaaacgattggggaccaacaggtccacaccttctgtgggccgcatgggccgggccgtaggcaacgtcagcgcgcgcgatgcagcacgcgtgcgcgcgtcaacgtcgccgcgcacgcgcgtatccaaaacctgcaagttgcgcttattgctgactcgggccatatatctatccaacttatgcgttggttgaatatatgtgtgcttgtataccaaaagggaattgatgtgtctccatcctattctcacttttggaagctatatgtttgatttggagaacaagttgtgtagtagggctcgtttttttttccatggtttagaattaattttgaagatagttccaccgcttgctcttaagcttaacaaccacatctaaaatttaaaatttagaaaatccaaatttggttgtagcttatagtcgtccattaatgataacactgaagaaaatcatcggaaaaaaatatctacttgattttaaaattaagtactaaaatccgaatttggttgtaccttataattctatatattgctctaggtgtggttgttttcgaaatgtaagctgtattagttcaacttgtgtcacaaggatgaagaaaataaatcaaatgacttagttgcctttaatttatagtacaacattgaaaaatatgagtcatgtacttttttttaataataacatttatttagcaagtacgtacaagaagaaaaacaatagtgactaaaaattccaaaactacttacatttacattttgagttgagaaggataaaacaacttaattaagtacaaattcaatgtagcttttagtttttttttatttacaggattaatctagattctttttatgctttaatttgttaggttatagtttactgtttcatatttagcaagatccacgctaaaaatataataacattctaaaaaataagttataatttcatttgtataaattaaagaaaaaagttaatatattaattgtttgagcgtggatctagtagttaaaaagtgtt

SEQ ID NO: 54989 - DNA, 1501 bp, Oryza sativa
cgttgcatgctgccgtggcgcctggcttatcgatcgttaccctccacgtggacactatggtcaatgtgtactgcagtgatatgcactactttactccctccgtccataaaaaaccaactaatactggatgtgacacattctagtataatgaatctgaacatacatctgtctaaattcattgtactataatatgccacatcaaatcctatatttaatttttttttgacagagggagtatgtgtggttaatatttttattgttattagatgataaaactgaatagtactttatgtgtgacttttttaaaaaaattatattatttaaaataagacgaacgatcaaacgttggatatagaaacctacaactgcacttatatcgggacggaggtagtatctaccttcgtcgtaagatgttttggccatcgtctagatagaatattttatgacggagaaagtagattagttagtataataatttttattcaatctcatagcataactagttaatcacctttatttaacacatgcacaccggtggtacgcaaaattaaggctgtgtttggtccgatgagttgaaactaatctctcgcacgtaaaacaaagtgatttattaggatattaattaagtattagctaattttatatagaaaataaaatattacgatttttaaaacaacttttcctataatttttttttaagaaaacgtatcgtttagcagttttgaagtgtgacgtaagcatggaaaacaagaaccaaaactaaggtaggaaaattgccttgtgaaaatagaatttctgatggatcagcatgcacgtagtgtacacgtcactccagcctgacagccatatccatttggaagctactactactacatggatcacactagtacagtagcacaagtacaatacagtttggcagttggcaccggtcgccgcctctgctgcccagaccattccattggatcattccacgcttaattttccatcctgtggactagctcaattagctcctctacaccaacacaattaattaattaattaatacaacaagtaataaatactccatccggtcctataatatagcaatctaatacaggacgagacatttcatagtacaacgaatttagacatgcttcctatccagattcattgtactatgaagtgttccatccggtactagattactatattaaagacgggggagtattttgcaccatgcacacactacagtactacactctcttctcttctagaataatcttgctagtagaataatcaataactaatgaatcccaaccatgcatgtagtactaagcaagctagcttagtagggtatttagcaacacataatcaatcatccacagacttgattataaatctctaattcatccatgttgatccatatatttttctcggtgtttgaccccaagactccactccatctctctccatgtaggagtatatgtttctagtaggagtacttgtcctcctcatataaacc

SEQ ID NO: 54990 - DNA, 758 bp, Oryza sativa
tgcttcctgctgcaccaccacaaaaagccttcctttataccatcataccatagagctgtaaaagcaatgctgaatgtgatcaaaagagcccatctcattccattccattccatcccccaacagcacaaaagtccaccatagtatattattgctaagcagagaaagcagctgctcatatccaaatcattcataggacacccctctcaagttattcccccatgacaactcttattctttaatttgcttggcagattcttcccgttcgcctagaagttatcctggaacacatccacattgtgcagagagttagaacttagaaggcattggtttttcctgttctttttgttcattctttagtgaagatagatttctttaatacgcttgtaatgccagtatttaaggtgaggtagacctttgaaggaagggatgacttccataccagcatgagatgatagtgagagagatgaagaaattttagctgttcttctcctgtctttggtagcttaggaccatcatttgctgtttcagttggctcttttcctgtcgaagaggttcacctctgctgcttgatctttcctttgcgttgttttctgttgagaggagactaaattgactagcatcaatgctactgtttggaagaaaaagacttctcgctgtgttgggaagttgttgtacgattctttcgcttctcactccaactcagtgtgcttcaagcagccctgatagtttaaatcagagttacaagattgtccagcctt

SEQ ID NO: 54991 - DNA, 159 bp, Oryza sativa
gtttaaaagcatctagtagcaagctttgttcagcgatagccagcatactccattgcgtgctctctcttccgtgtgatgtttataacttttgcagcatcatgatggcaaacttttttttatgcttgtcgggctctatgggaacatggtgtggtacattct

SEQ ID NO: 54992 - DNA, 186 bp, Oryza sativa
gtgaatttttattccattatctgaaacttaagagcacttcaattcatggactactgatccacaaaataaaagctagagctcaagtgtatcaattcaaaagtcaaaagttactaattgtgaagtgaaaaaaaaatcatctttataacctgaaaaaattatggacagaactagttaaggactatctca

SEQ ID NO: 54993 - DNA, 1501 bp, Oryza sativa
ttttggattagtgtggtgtgcgtccatcgtagcaacaaaatcactcagaagtgagagaatttttttcatttttaattttttttcttttaatatttacagaaataatctatcggcgcaaaaaattataaaaatagaccctgccaccctagtggagggcggcaagctgacgtggcagacggcggctcgacggcgccgtctgccgtcgtctacgaaaattgcatttagcccctttgccgcctaaatgcaattttcgcggccctaaagagcatttggctggtactttttacatcggcggcaagggacccagatgcaaaaagtaccagccaaaaagtactaggcctgggctggcttttttgcatgaaggccccttgccgcggcaagggttttcgtgcaaaaaaaaaccctccctctcccgtctgccgtcaccgcccgtccctcccccgtttgccacgtcagcttgccgccctagtagagggcggcagggtctatttttgtaattttttgcgccgatggattatttctgtaaatattaaaagaaaaaaattgaaaaatgaaaaaaattcgaagtgagaagccagcacaaatgcaggcccattgaaattaggcctgcagaacaagcccctgtccgactagtggcccagtccacccagagaggatccgcgaattcggcccggcccataaacccaacagtgttactggatcggatatcttacctctgttgggccaagcgggcccacagcgttaacgccattgtttttgccgggttaggattatgagcagaaacgaaaagaaaaaaaatatttttttactccgtttaatattacaatagagtagtccgtactaattacagcgatgaaaagtcgcctcggacgtccgatcggagcgctaacatcggacgcgtaattagccgtaagatatccatccaataactgatagcaaatcaacaaattcagggggaaatgggaaaacaattctccatgtgttgagaatgtacagtacatgttcgggttggagatgtagcagactgatcgaactatttgatgcaagtgcaaggctagactgattaattagctagactgattgcaaggctagtatattaattagttagttagttaattaattatgctggccaagaaacgcaggccatgcatttctgcaggctgttctaattaattagccagtgcaacagcccaatcattccaaatgacgaccaatagttaatcaaatccaatcccaacttaatcaacgaattgatttcatacaagtgcctacccgtccatccacatccacaccatgttatgtagtattgaagtattctagtattttagataagcctatctatgagcatattaaagtcacataagttctttttttaataatatatcgaaatggtttatatatgtgacctatgccgttaagcggacaaccaataaattctaacagaaaagaaagcataaggtgttaggatatccatcttcctctaaattataacccagttaaa

SEQ ID NO: 54994 - DNA, 1501 bp, Oryza sativa
ctccaaactaaccaggatcaactcacagaacaaatcctaggaagcttatgctaccgacttactgttctattatagatttgtagaaacacaattctgaaagcaagaatagaaaaactgattttgatgtacaagagaggtgcctttttagcaagaaaaggtatgatgtacaagaaggtgcctttttagcaagcaagtttacaagaataccgaaaactacaacccagattaccacaccaataatcactatttttcttctggcactgtggcacaacgattacattccgacattcgcaaacacattttgtcaaaagcaattgaagcaactaaatctgcgtgaagaagtaaacttatttatcgccaaagatatgcatacacctaaatctctccaaagtccaaactagatcaatcaagccctgtgcgctgaaattctcagtttctcaccaatcctacccatgggaaagatgcacaatttcagagaataatgcaaagcaggcgccttcctccacctaccatcacaactcacaaccatcaccaaacaggaaagccacgccactgtttgatgatagtacactacactacggggaaagcagagtcgacctgcaggaatgcaagcgaacggccgaacctacccagtgccgacggggccaccgatgccgacggtgaaggcgcgttccgcgaagcgccgcgagatgagcggcggcgcgcgcttggagaaagacgcccgggggagtaagatggggctcgtgggaaagcggcgcgagggccgccgtgcgagtgccacacgcgccccgttcttcccgacccacgagccgccgcccccgccatggctgccgtccctgcaagcgccgagtcaaacaggcagcagggagcgagatcatcagtacaaaccaccagccgaaaaggggggcagatgcccggctgcacgcactggtggtgggaatggtggtggtcgccgtcgtcgtgcctgtggtggtggtggtggtcgtggtcgtggtcgtgagacgccatggattccgaccttgaattgcggcggattcctccgggatgcgggaggttagggatgacgaagccgatagattctctcaacatgttgacctcggctcgttgacctggcccatatttggttgggccttaacgggctttccattttgtgaggcccaataacggaataaggatcacgtgcgggccaaattggttgggccttaacgggctttccattttgcgaggtccaataacggaattggacttacgtgcgggccatattggttgggccggaatgggatttcgatttcgtgcggcccaataacggggttgggcctcacctaggtgtttcttccccaactccggcccgcggaatcctctcctacattggcgccgccgagaattcttcgccgccgacgtgacgccatccgcgcgacggcagaagccacggcggtggttggccgcggcggcgcttttctcaaccgtgaaaagacgcatgtgatcgagcaaggcaaatgta

SEQ ID NO: 54995 - DNA, 218 bp, Oryza sativa
ctggccattaaatgaaggttgaaatgtgcgtcaccgggaaagcgggcgagcggggcaggaggcgtgtgctctgcttgtcagaggtcatttccggctgtagactagccctcattgtaaaaagcatgtttcccttcttaggcaactagaggcccatgtggtgacccctgaccagataaaaaggaggcccaggcctaggagaaagggggttgggactctgg

SEQ ID NO: 54996 - DNA, 416 bp, Oryza sativa
aaaggaaaaagaaaaaaaagaaaaaggaagaaaggaatttccagggatttaaatattgcttgtgctcaattttaattggtcaaaattatttctagggctctgaaaattccactaaaaatcctgttagtgaatttcgacatgtagaactcaagaaaaattccacatgtcaaattcgattattatttgtattacttccttagggttttctcttgatttgcaccggcattttcttagggtcatttataaattaaattttaggcttgggaggagaacttcggggtgtgacacccgccgtcccccaaggtgagatcgccagctcccctcccctatccctctccattcttggctcttccttttcttcctctcggctctccctcgtccttgcggcggagcggcggcggcaacctcgccaagga

SEQ ID NO: 54997 - DNA, 396 bp, Oryza sativa
agtcgagggaggcaaggtagacttattccttactactactatagtacaatacaactatagggccatcaggttaagtcttttccaaagaaaaaggcccatcaccatcaggtaacttactcctcgtccgtccgtgtggggactcttcttcgtcctcaccaaacaaaccctagcctcttcataatcggagaaaaagaaagagaaaaccctaaggctctctcccctccggcggcgacaggacgggttctcgatcagggttgccagcgaacacgtctacggtacactcttcgatcgcctcgattctttcttccgattcttcgacgaaatcgcattgtatggccacctaatcttacctgtgtccctttctttctgtgttcttcttcttcatgggcgtcaaga

SEQ ID NO: 54998 - DNA, 572 bp, Oryza sativa
gcgcgccgcacggctggcgcaatggcgctggtgcctgcctggccgatgaaaatattgaaaacaacagtgcagagccggaacggagtagactaggagtgacgatgcttggatggtgtttgaatctcctgaagataaagataaagattaagtattttacgtaaaacgagatggtaataacatgtgattatttgagttttgattattacaaacttaaaaaatagattaatatgatcttttagaataacttgcatatataaagttttcgcacgaaacacaccgtttagcagtttgaaaagcatgtcacttctatccaaaagattattcaatttttgttggagatttgaacagggcccttagtgcaaagctggtgcaggccggcctagccaggcgttcgatggacgacggatgcagctgctagcgaaatcagcaatggcttacgttgtcactgagatgtatactggtactagcagcggacgccacacatgcactcgcggcggattcgtttttcctctgctggttgcctcatgcgatggcgatgcccattgcccaagctcttcttttttttattcagg

SEQ ID NO: 54999 - DNA, 1029 bp, Oryza sativa
actgtgggaattattatagttataatctatttatatgggtttgatatatatatatatatatattaaatttgttaggggcaccatggtgcccgggctccatggccatccaccgtccaaatgctttaggatccgtgcaacgctaatagaggatactatcacatataagcgggtcttacccgataagagttgcatgcatatactttccttagaacatgcatgcgggtatttccatttttgctgtataccgtgcatgtatttccaaatttgcgccctctaatcacgcctacacattttgattagcactttccattttctatatcacatttccataaatacaacgtttgcatgcagatacttacctattgaaacatgattctgtttttgaaaattgacgccattccactaattgcgattattgccatctattttcaaggttatattccattttcaagatacacatataaccggctacagtagtccttttttttatttttcttggccacactgtttcacggtcgaagagctagctatccacctcgtcttcactgagttacctcgccgggattgctcgccccgccgtgaagagggccgacgtccgtggttttcgtcactgacgacgttcgtcacgatcctcttgctggaaaccagacctcctcaaccatttttgtcaagccattacagcgccggacgtccatgtgccttttcactgccgtcgctggttgttcgtgagattcggaacatgcattattcaccagcgagctacattacgtgaaaggtatggtcctcagtttttatcactcacacagtttacattcacatgcagtccctgttatgtatagatgatttgccatttctctttcttttatctactaactgagcacatgatgaatcacctggaacctaaattttagattttttgttgaaatgcagttcaatttagattgtcttaggtatataacgcgtgtgtttgaatatcttggtttgcacatccaatgaacagaatttagctaggtagtgaaacagcagcga

SEQ ID NO: 55000 - DNA, 1123 bp, Oryza sativa
tgttgcgttctgagttccatgcattaaaaatgaaaacacatctaaacagtagtgttggtgctattttctccatcactagtataatttatagcggctggaagagctataaactgtcttgattaatccgatgtatgacatggagtacacagtatgctcattgtctgatcaaccagagcacaagcaggaactgtgttggcactgttctgttcatgtgcagatacctcgtggaagaacatgccacctcaaagaggcaaagacaatcctttgtgaatttcatggactgtgtaatgtgtgatgtgatattgggtcatttttatagtggtgtcaaaatctagataaattttgatattattactttttctttttagtaagatacagctcatatgaaatactctctatgtttggttctctaccagtatgcttgatatggtgaagaaagttacagtgtgttgcgaaattgagcactgtggcattacaaatgacttggctccaatccaaaccagtcacactaatactagtttagttgccaaatactactattaattggtaagacatattttggtataatcaaaggctcaatacactttgataccaaccagatggaacaatataagaaggcatatttgtttttagagacaaaaatcaggaagatgtattgccaaaaaaaagaggaaaagaaaatctataatttcattctgcagcattcagatttaccctaggcccagcccaactacatgctacgcgaggaattgtagcccatggaccgcactaattgccgggcctagcccatgacagacacaaaaaggaaaagcccaagaggtcgtgttcgtaagacgacgtgagcacgacgtcacgtctcactcaccttgacctcccaatttttttttactttctaccttccactaattaaaacctccgttgatttggggtgcatcgtaactgtggtgtgaacgacacaaaagagagtgggagaggataaaaagtgaatattctcgtggaaattctagatcatgtttttacccaactttttttcccattaatttacttttcacaaaggtcatagcaaaagataccagcattacatattacattcgtcataaactataatagacttttttttaga

SEQ ID NO: 55001 - DNA, 247 bp, Oryza sativa
cagtatactgaactaatccttttccttttcaatctactgaacggaacatgatcagaacagtgtacatgaaacagattcggctatagattaaagagaaaaaaaaccaacatgcataatcagtattcaccggcctatgaagtttacagcaagtagcaagctaaaggctactggattgttcaatctaaaaataaaccaagagaataagttctcttacgaaagagggaaaataaagcgataaagtccaaca

SEQ ID NO: 55002 - DNA, 1501 bp, Oryza sativa
gaatgtaacatggtaaagctgtatctggtataatgtatgttccagtttcacttccttcattgatacgtcctaactatactttgtaagaaattatgtgacccagctgcaaatgcaaatgaaatgttccttaatttcatgttttgtctcaggatcacagatcgataaagtttttttttctttaaccgtttcttatttttctcatctttatttgggtttgatttctttgcgctatgcatttacttactccagttccctcaaaagtccaacttttctaccacgctgataaggagctaaaaaatcgactaccgtaataccagtttcaaagatggataatttcatatctaactccataaagacatagagcatatatatatatatatatatatatatatatatatatatatatatatatgaatagggaatgttgcactagtatctacatggcctaaattgtcaacagtctcccactatgcaaccttcttaatttgattcataactatatatttttgtagggacataacaactatattttgtggaggaattgataacagcaaaagtgaactatattttgtggaggaattaatagcagcaaaagtgtgatttgtaattgtttgaatgattgatacctccccttacatcctttctgaatcacattgatatcctcaacctagctttttgtgtgtttgcgtatctcccaatttatccatctttgatagctaattcaaggctgatctttccaaatattattagctgtgtctaactatgcaaattaccagcagcatctcaagacgcggttcttgactgattcacaagcctgtaagcctgtccttaacgtgactgcatctcatgcttattataactttgtgtttagggacaacagcacgtatgcagctgaagacttagtggtctggaactccaatgtacctgtattcttgtacagttagattgcttctgaatacttttcatatatatgatttttattttttttcatttgtctggcaaaggcaggaaagcctgcacatatttgtctgttattataaccattttctgacaactcaaaagttctggagacccattttgctcattgttatgattttgctgccagattaaatgtatccataaaaaaacaaatattttcctttccttgcttcattccagctgccaaccttcataaaatcctaacaaatacaatcttctcatggatgttcctgacgccatactagagaaatagaatgggaggtgatggacctgttgcttactccaaatccttccattgagaacatccaaggagggtatcaacatcatcatcatcacctcccatcataacatcttgaggtaagtaaattcatcgataatcatatcggacaaaacatatcataattatctggctgatacatattctttcagcaatggaactgttgtgaaaccagagctcattgctaacctttgcttcttgtcttctgtttccagtgggattctggttgtgaacaacatctaccaa

SEQ ID NO: 55003 - DNA, 354 bp, Oryza sativa
agaaatatactactatcattttttttccaggtttgaaaagaaaacctaaaaataaaaagaggtttaaaaagaaaccaaaaaaaaacaaaatgccacacggccaccggctgcagcaggtgacctcgaccgccgaccggccgcaccccgtccacccatccgctgggccccaccccaccccacccatccgcatccacatctcgccgcgaccttctcccctcccctcccctcctcatcctctcctcgcgataaccctagctctccccccctctcccgcttccgatttccgatcgctatataaaagacctaggatttcgaaatttttccctccccctcccccttcgcgcgcgcgctctc

SEQ ID NO: 55004 - DNA, 527 bp, Oryza sativa
tacttgcttattaccgtgctcaatgctttgtccctggcctgtttcttatactttgctaaaatgtatgaacataggaaaaaggtcatctcagtgcagtgacattgtgtgcagcctacatatttgtagctccactgataaggtcaccttcacaatctgatccagtctcaagaatgtaacatggtaaagctgtatctggtataatgtatgttccagtttcacttccttcattgatacgtcctaactatactttgtaagaaattatgtgacccagctgcaaatgcaaatgaaatgttccttaatttcatgttttgtctcaggatcacagatcgataaagtttttttttctttaaccgtttcttatttttctcatctttatttgggtttgatttctttgcgctatgcatttacttactccagttccctcaaaagtccaacttttctaccacgctgataaggagctaaaaaatcgactaccgtaataccagtttcaaagatggataatttcatatctaactccataaagacat

SEQ ID NO: 55005 - DNA, 1501 bp, Oryza sativa
ttgagaagtccaggacgttcctgtagatggtccaaaattgttcaaagacgaatagtcaggcgaccccttcatgtcattcatctacaagtatttttcagatgattcagcttgcaaaattgtggccagtgtagttaagttgtcaaaacataattgtaattaacattgttctattatgtcaggtacccagctaggagaagccgcactccctgtcgggctatcccaacctatgtgcgtgacatgcttgacgtcggttggataaccaatctccatttggtgttccttcaccactgcaagatggtttaagcaagatcaagaaagaaattaggttgtgcaaatcaaatgaactgactattcatgccttgtgtaacattgtagaaaagaaagtaaaatctacttgatggtcacataccgaagatctgagagatgaccttgaggcccttgaaaacccctttcatcttgtacgccattggtagatgttgttcacaaccagaatcccactggaaacagaagacaagaagcaaaggttagcaatgagctctggtttcacaacagttccattgctgaaagaatatgtatcagccagataattatgatatgttttgtccgatatgattatcgatgaatttacttacctcaagatgttatgatgggaggtgatgatgatgatgttgataccctccttggatgttctcaatggaaggatttggagtaagcaacaggtccatcacctcccattctatttctctagtatggcgtcaggaacatccatgagaagattgtatttgttaggattttatgaaggttggcagctggaatgaagcaaggaaaggaaaatatttgtttttttatggatacatttaatctggcagcaaaatcataacaatgagcaaaatgggtctccagaacttttgagttgtcagaaaatggttataataacagacaaatatgtgcaggctttcctgcctttgccagacaaatgaaaaaaaataaaaatcatatatatgaaaagtattcagaagcaatctaactgtacaagaatacaggtacattggagttccagaccactaagtcttcagctgcatacgtgctgttgtccctaaacacaaagttataataagcatgagatgcagtcacgttaaggacaggcttacaggcttgtgaatcagtcaagaaccgcgtcttgagatgctgctggtaatttgcatagttagacacagctaataatatttggaaagatcagccttgaattagctatcaaagatggataaattgggagatacgcaaacacacaaaaagctaggttgaggatatcaatgtgattcagaaaggatgtaaggggaggtatcaatcattcaaacaattacaaatcacacttttgctgctattaattcctccacaaaatatagttcacttttgctgttatcaattcctccacaaaatatagttgttatgtccctacaaaaatatatagttatgaatcaaattaagaaggttgcatagt

SEQ ID NO: 55006 - DNA, 342 bp, Oryza sativa
ttgttctgacttctgaggatgaggaagattttggttcacacagtgtagtttttaagaatgtgattgcttagaaaagatgaaatatgataacaatgagaaaaacaccgatggcttgagagaacttaggattcacgaaacacaacaagtttagttttccaatttgttttgtttccaaaggaaaagttgtgcaattcgaatttaaaacaggcacaaccaagataactgatagttttctagctgccgttgatgttgtcaatattattaactcgataaattttgcagctgtatactgtatagagagtagtattactattacctcgacaacgacataaagaaaaataa

SEQ ID NO: 55007 - DNA, 1501 bp, Oryza sativa
tcttctacgaccaggtgcccgacgacctccgcagcgtcgggctcgccatgtcgctgagcgcgcagggcgtcgggagctacgccagcagcgcgctcgtgtcggcgatcgactgggcgacgacgaggagaggaggagagagctggttctccgacgacatcaaccgcgcgcacctcgactacttctactggctcctcgccgcactcgccgcattggatgtcgccgttttcgtgtacattgcaaagcgatatgtctacaggaacaaagacgagcaatgattcttctgttttttttatatatatatctgaaaaatggttcgcatggggaagatcagaagatgtatgctagtgtagtttgaacatacattgcattttcgcagcatttgcatgtataattatagtcctattgaaaatgcatgtggttgtataatttgacatgctaggacaatccaatgctattttttttttcctgttcgcatgtttcgaaaatcttgtgttccaaatgtgcattaaaaggagcaaaccaacttgcaatttgcatttcttactgcaatacttctacttgatatatttagtagtactctgcaatggatttaccaaagtggattttctctctctgcgttgaattttccagaaagaaataatcttttttgattttccaacaacaattagtgaataatatgtgggttctgtgacaaaagcaataccgttagatttagatttgaaatcattttgaaatgtttgatacgattgtgattaattttgttgtgaaatcaactgacaaagtttaataaaaaaaatccaaaaggccaaaaggggataacctcatagattgggtttggatctttggattgcaggagaacaagttagacaaacattgttacagtaagtttagtagtagagctaactacaaactataagctaatacaaaagtagaattagagctaacatatataataaattccccccaaaaaatataataaattagctacttcctccgtttcacaatgtaagactttctagcattgcccacattcatgtatgtctagattcattaacatctatatgtatgtgggcaatgctagaaagacttacattgtgaaacggagggagtataaaattatttctaatcttttatctcttactccctccgtattcataaagaaagtcgttttggacaacgacacggtctctaaaacacaactttgacttcttatttctataaaaatatttattaaaaagtaatatatgtatacttttatgaaagtatttttcaagataaatctattcatatagattttacatttttaaactcaacaacttgagagttattcatgatttatattcccaatgtttgacttaaacattgtcctaaacgactttctttacgactacggaggtaatatctctctcgcttatataattaatgcatttatctaggaatatgtatagagctagttaacactactcattttttcttattcgattgcacataaatatatagt

SEQ ID NO: 55008 - DNA, 710 bp, Oryza sativa
ccacctgagcccgcggaacacgcacccaccctctcgatggttcgtgggcccaccatacactcgccattacgatgacacgtggagcccacccagaggccaaatacgtagttttttctctggttcatttatactattcattccaaaatataataaaatataagtcatttttttaatgcttgctttctctattaaagtattatttattgaatcatctactcaagatatttaattctattagatacgtgcattatactatactcctcccaaaacataacaattttcggtgatatggccgttcactcgaaaattattatatttttagttggagaagtatttattagtgtgatcaataattatgtttttttaggttttagtatattttgtaatgtagggacgtactgtacttttttattttacgcggctgatttattgcatgcagtattattatgagactgatttattacagtaataataataattgcttgcgctctctctgactgaaacgtgggcccccatttgtgcagagcgacgcggcgcgagggtacagcgcggtgggaggaggcgcggccctgctgctgatgctgctgctgtggctgacggtgggcccggccttcgtctgagccggtgggggccacctgtcagagagccactgccgctgttactgtcacagtgtcactaccgatcattgcttctgtagagagagagagaga

SEQ ID NO: 55009 - DNA, 1501 bp, Oryza sativa
aagcatgctattacacctctatccttaaaaatatttttttcatgattacatggaaaatgtacacgcacaacacatcgcaatcctacacctgataacacatccaccctaatattttctttgtcccacgtaatgggtaagcagttggttgatggccaacttataagaattttctgacatgtactcaatttctaggttttataactaactttttagaatctgaatgaaaagctagatttatttagagagcttttagttttgagaaaagttgtagctacaaaaactagaccagaagctttccacacagatccaatacctcctccgtcacccaaagacatcacttctaggaaatctaggactaattagttgtgggaagaaatgactacatcaccgtgcatttaattactttctgtacttcaattaaatgtgcatacattagcttcgttggtaatccggttgatttcggactaattagttgtgcatttaattaaatctagaactaatccggttgatttcggcattacaccaaatggttccctttttttaaaaaaaatgtcgaattatgtaaattttgactaatgtttagtcgaagtgcaagtaaatcaattacggaaaaactacatcattaaataaattcttatgccaaagtgttttccacgtaatattacatagtttataactgttgttggtatttgataacataatattataaaagaattgtgaagtaagcgtaacttaactggttaaattctttacggtgaaacctgtccaccgggattaaagtcctaaacttggtacgtgtgcttgtatttctttcaataatagacgatatacccatcaataacgagacatttattgtcttcattaatctcaagatatgccagcctaatttttaagttgtaatgacttcattaattttaagatatgtcggtctaattttcagagatagtcatattataattttgttttgaacgaatagtagtcatattataataggatgtgcgcttatagagttgagtgtgctcattttaagagcccctgtttgtcgaaaaaatattctacaagcattgatcaaaaattatttcttttcttatagaaaataaaatacaccctaaaaatcagacttcctaagaaaaaaaaaatcagattcgtcttttttatcccgtcccgtccgcgtccggctccgaccgatcgatggcgatgcaaccacaggaagcgaccatccactgactccgagggaattcgcgggcccaccaaaccgctaggccattagccaaagcatccaaacgcccgagaaaaaaccgcggcgatcggcggcggcggcggcggcggcgaggggtacggctacggcggcgatggacgcgtcgagcgagctgcagtgcgtggggaggctggaggtcgccgcgccgccgccggcgcgctacctccgggtgggctccctccccgtccccaccgactcccccgcctcgctccccgccctcctcccatcctcgtccccgtgagc

SEQ ID NO: 55010 - DNA, 1501 bp, Oryza sativa
cgccggccgcctgtatcgcgcgccgccctgcgccgcacggtcaccgcgagccgcgccgtcgagggagagagagaggacgtcgccagccgcctgcatcgcgtcgcacggtcaccgcgagccgcgccggctgctactccaccttcccgctgccctctgccgcgtcgccggccgcccgtatcgcgcgcggtgctacgccacacaatcaccgcgagccgcgccatcaaggaagagagagagagaggagggggagagagaggaagaagatagagagagagagagaaagggcaatttgttcaaggcatgtaaaaaagtggggccctctcatctagtcagcacggaaattattaatttaatgggtgtagtgtccaccagcaaataaccacattttgagagtgtgtttccccaaaagtcatttcgcgcggtgtcctacagctaaaaccgcaaagtcacgatgtcctgtagcaaaatttgccttagtttagctatcagcatgcccaaacgggatataggccgtgtttagtttcccttattcctaactttccatcacatcatatcacattaaaaactttcctacacatatagtggcggcgccaggatttcaaagttggatattcttgtctaagcgctgtgccgttgcccgtccctgcccctcgcagccgccggccacccaaccgacctgaccgccttagcttggcgaagtgtcgggcaccgcccgccgtggcaatggcctccccctccgtggtagcacggtccagctcccgccgccgattgccgtctcgccgcgccaccacctagggtttgcaaatggggagtggcgcgagggagccgagccagggagggatgggtcatggagggagagcgagagggggctgtctggaagagtggtggctaagtgggtcaactgatgtctgatgggtcatgacggagtgggtcgggttggttggaagcatcgcaagagactagttgggctgtgtttggatcaaagagttgaggatttaggtgtacaaatatgtgtacatgtgtatatactataagtatatttattttttgataaaaaatgttgggtattcccgggaatacccaagaatcatggtggctccgccactgtacacatataaactttcaactattttttcaaactcccaactttcttcaaactttcaacttttttcaggaactaaacacacccataaaagagactcggacggcagcaagccttgggcacagctgtaaattgattcaaaacattgacagccaaaaaccccttaaaaatcacgcacagcagatggaaaaccgattaaaaatttccatatccaagactacaattaaacgattccatttcttttcgctgggatgaactgggaaatacgaggcccaaagataccattccggataacacggaccgtatattatacggtacaatacacactgcgtacgtataaaaaaaaatttagtaagaaatacgatcgccacacgcccacctgggcctccttaaatctcg

SEQ ID NO: 55011 - DNA, 1501 bp, Oryza sativa
aaagtgtcaactccgttataaaactacacgtacatcctttaacacttacccatacttttataataaaaattgtatatttcgttaaatgtaaccaaactccgaccgatttttgacaggttttcacaaacctgcaaagggtgaaaaaatcttccaaaaatattcatcacattcaccataagccgctgccgtcggagcttccttcaccgcctgctcgctcccggccggctcggtcgaatgcttctttccgtgctaggctgcttcgcgcaaccgcggccggcacaccggccgtcacctatgctcggtgtgccggcccgtctagagaagccccgggtatctactgctagctgcagcgccgcttgctgctcacccacgcaccgtaggtgtatgctgatgcaaagtatatgtaatatcgtaagggttatacattgtacgaatatctaatcgaaaagagttagaacattgcaactgaactgaacagctagctgcaacgggggaggaggtggtcgatgtggatgtgtggtggaagtggaggcagaggaggcgaccggaatggggaagaggcagggaggtggcgatggaagcgaggaggtcgacaggcagcggtggatgtgttctggctgctgggagtagatgggttctgcgtttttttatacctgcttagtgattcttgtatatatattctaccatgaacgtgggcttctcctttttcgtgaccttttgggcatgtttgagggagactgagattctgagaagcagctggttgatagccaacttctgagaatctggaaaaattgggttttctagcttctagcttctagtataatttttggattcgacaattacaacttctcaacatctggaccaaaaactgtactatttgagatagcttctgattctgagagaagctgctgcagctgaaagctcccccaaacagaccctttgtctgctgcgtggaacatggaccgttggctatgtgaaaactcccaaggattctaccattgaccatgatttttcactcatgtttattttagatacaatggcatcggtttaattccctgctgcatccaacggtcctaaatttctgatgacgtggcgctttgtggtagcgaaactttagatgtgatagtcccatggtgaaaagagagtggtgtgataaatcatggtaacatctgttgactttgtgtgaaaccgatcgagcttgaaattttcatttcccaatattcttttattatggttaaaaatggagcatagctcggtcgacagagagatacaaaatagtttgcgttggcctaggttcaattattaaattgacatgtaatcgccttctaataatattccaggttaaattgtttcttttaacattccacatttttgcttgactacattagtttagggtaaattttgttgcaggacatcgcgacttcgtggttttagctctaagacaccgcacaaagtcgcttttggggaaaacactttttgccagcggacaccgcacccattt

SEQ ID NO: 55012 - DNA, 1501 bp, Oryza sativa
gagagcaataaaaacactggctagtgagtggtggagaactgagagagaagaagcacactgaccagtggggcccactggcagcagcagctagcctctgtgtcagccactcgctggctcactgtgtgtgggccacaccaaggctgagtctctcacttccttttttttttttccttacagtggctttgcagttcattgtctggtgaaattaattttttcttctgctagaaaagaatgcaggtggccaggagagaagggagattttattcagggtttatattttcgacgaaagcccattcagaactgcgaatttttttactgtagatgtgagactaattttttacaggagagtagattctaagtgaaatttcaaatggtttttgagaattcgaatttgaaacagtaagctttgataaaaagattagcgaaaaatgttatacacttacaccactgggtacgaaatctagcactcgatcaaaaaaggtgaaatctagattgtttagcactagattgagatgatgctattaacggcttgctttggctttaacctttttttcctttagttactttgttcttgtttaagttgatggtaacacttaagtgccgaggaggcaaggaatgttggaggtgaggtgaagtcggtgaaaaggggaatttttttttatttataattttttttattaaaagttttacaaaaataattttccattttgaaaattgacggaagtagtcgcctaccgccctctgggaaaatcgccctctcagagggcggcgaaaatgacgtggcagacggccgttcactctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctccgctagggcgattttgtactgtgggggggggcgcttgcaaatgggcggcgagggggcatggaattttgcaggcggcccccttgccgccctgggggagggcgatttttgcctcccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 55013 - DNA, 1501 bp, Oryza sativa
aacagaacccccttcttttttcagtacagagtatgcttttgagatgcacaagaacactctctgctactctgactactgattatactgcattgtgtgtgtcaccacagatcaatttgcttttcctgaagaaaacaatcgatgagctgtcctgaaaatcatggagtaattggaagaagagaggctaaaacctcctgacaaaagtgtcttttctcaccatgggtgagagcttgctccctctctctttagcactttctcctctatctacaaagcttctactgttccaattcctcaccttttactaatcttttatccacaaaagatgcacactacattactattactaatttactactactgctagagctaaattttaggtttgcattgagctagtactaatcagtgagtgtacttgttaattctaaaggcactagtaacaatcataacaatagtgagtagagtagtagtaattgttaatggtaaaatagtgatgataataataaattaataataatcatccttgcaaaaagccattgcagtaggaagaagactgaaagaaagaaagaaaagaaagccgagaaagcaggagtgcttctctctctctagatgtggggcccacctcgccgtacggatgcgcctccctgcgccggcaaagcgtgcgccattgtcttgtcccttggactatcatccatcaccctttgcttaggctttcttattagtgcactaatcacttaaaaaatgatctcttcttcttttcaagtctccattattgtaagcaattcgtccctgcacaatacagctctcttcctcagctcttgaagctgtggacttagctccatcgtttgcttttcaacttttttttttcgctgggacggcaaagaataccgacctatgtatattaaggcttttcagcttatcagccgcaactaaaatttaaatttgaaaacttgattttaggttgattttgatgatttttttcatcgtagtttatttttcagaattgatttttaagtttcagcattcatttttaagttgcgaagaacgtatacataaaggttttatgaacagttttttttttatcactaataggtattacgtcttatagtcagctgtttgctgcaatggcacactagtagcatcagtgttgagtaatttggtcagtgaagcaaaattaattaagcaccggtgattaaactatgcagaccccacatagtttgtgcttgtgtcaggatcagagttcagacatgcatgcttagctgatgcttcctctcaaagggatgtgtctgcatcatcagcctttgcttctcctcttttctctgcttgcttggttttcctgcaatgcaaacatataccacagcaactgctgttaacaacaaacaacagtgctctgatttgtcaggatgggccaacaatgagacaagaacctgcccttcttatctccctcctcaaagatatgttgtgctcttggatgcatccatttggatagatattagatccctgcatc

SEQ ID NO: 55014 - DNA, 287 bp, Oryza sativa
aggccgccagcaaaaatgttgccggaaagttaaaattcaaaacagtgaaaagaagtgttaaagggggccggagagggcgagaatttggcgccataaaggaggcggttgaagaggtacaatcgtcggtggaaagaagggattaaaggctgtcaaagaggtaaagaaaggcaagacgccggtcaagaaaagttagtgagtaaaagtgggcgccgattatggatcgatctaaaagaatgtccaaccttaggtcacccctagtcaaaatcacctgtgacgggctccaaata

SEQ ID NO: 55015 - DNA, 495 bp, Oryza sativa
aggtattacaatccacaaacaacagaggacaaacttcgcatcatggattgccacttgaagccactacaatactagtataatttgtgttaatagaattgcaggcatacgtgagataagtgtgaataccccaaaatcccaagtagtatgggcaagctctcgtccgttccattgtacactgctaactcttccttggtccacaacctctgccgagtataacacaggaagaagagaaaatagtgctcactatacgatcaaattttactattcacaatatcaaaaggaacatagccaaaagcctaaaacagatactccttccgtcctaaaatataagcatttttagctatgaatctggataactgtgtgtccagattcatagtaaaaaattattatattttgggacgaaggtagtagtaaatctaaatatgtagcagcagtaaagtccagcatacaccatacagttacagccttacggggcatatcattaatttcaccaga

SEQ ID NO: 55016 - DNA, 610 bp, Oryza sativa
gggggaggggggggagaaaagacttttttgggtttttctttttacaaaaccattttaactttgtttatttcttcttaattatcatttgtgctctgaaaattccactaaaatttatttacgcattttaggcttttaggaaatgtacaaaaatcctccaagccttatttgacttttaactttgcacattttaattgttggaggctttcacacggattttaattattctaggcataattacgaggatgtattttagagtcgttttgggacgcgacaagttcgaggccgcgatacgccggcggatcgaggtcctcaatcgcaaccaatgcgagcaggaggggtgcggtcgggcacaggcgcaacgggcccagaagctggaggagcgggctcgagcgctcgaggagcgggcgcgtgcgttggaccagcgcgagactaccttggccgcccacgaggcaacggcggccgagcggaatccaccctttgcctccgcgaggaggccttggccgaacgcaaccggaccaccctcgccgtcgaggctttagtggcccgtcgcgcggaggagttgcggctctgagaggaagcgtggcgggaacgagatgaaccgctggcggga

SEQ ID NO: 55017 - DNA, 1501 bp, Oryza sativa
tcggcaatgagctcgatgccttgctcccgagagatgcatttcaagaggatcccgttggtagcacgccggtagagggtcccttctacgagcacgtactgcttagagatgcgcacaagcttctcagcttctgcgcgatcctcaggaagagtgttatcgtcgaggtacgcccggatgtcagtcatccaaacgacctgacgaggggggtcggggtcgaccccctcgggccccgaggcctgtggctcgccaggcatcggggcgaggaccgtggcgccaggctccctcagggggtccaactgcgccgacgactgcaggagcctttcctcgaaggcccctgggggagtggggctcgtgccaacgcgatgcgcgacaaatcgtcggcaattgcgttgtcgtgccggggtacgtgcctgagctcgagtccatcaaagttggggcgaaaattcaggggccaccggacgttccagagacttgccacgaaggccctgcaaccggtccctccaggggtgaacgcggggggcgggccgcctcgtgtggaggagcgcgacactccggatgaggaggcgccctcccccatgcgggcagcactgcgctcgtccctgcgtcgctcgatgttgattcgagcattgctcggcgggcgggccgtcatgacgtgtggaggagcgcgacactccggatgaggaggcgccctcccccatgcgggcagcactgcgctcgtccctgcgtcgctcgatgttgattcgagcatcctgctcctcgtagaggccgtcatgacgcctccagcttctcgagacccttgacgacgtcggggccgtcgatcgccacaaagtctgggctgaccgacggtccctcctccttgctgatgaggaaagggcggtgggggtacgcgaggtaccagtggcggcgggccggccacccgcagccagctgttgctgggcagtggtgaccaggttggccacgtcgtccaaccatcgctggacaggagtctccggcgccgagtttacggggggttgctgtagaagggctcccgccgcttgaagtgcgcctcggggcgagccgccgtcaccgtacgtcaggcggcatcgtgccccgacgctgcgcggtttcccctcgcccggcggcggggagagggccgagccacccgaccaggtgggatcctccctccgtggggggtcgcggtggggaggagtcggagagttgtggcggcggtggcgggggccgcggctcccgctggcatcctcactcccggagggagtgggggtgtgcgccaccacttcttcctccaagacctcgaccatgatcgttgaggacaaagagaaacttggggtggaaggaaacaacttctttctcaaacgcgcgaattccccctacctggcgcgccagctgtcgaggaatgatcctctctagcgggtgatcgtgagaccccccttttgtgagttcggccgggggaaagggcgcgttgatcaagagtgtatgtccgcctagagtcttccgagaccgcgcg

SEQ ID NO: 55018 - DNA, 1501 bp, Oryza sativa
tccctcctccttgctgatgaggaaagggcggtgggggtacgcgaggtaccagtggcggcgggccggccacccgcagccagctgttgctgggcagtggtgaccaggttggccacgtcgtccaaccatcgctggacaggagtctccggcgccgagtttacggggggttgctgtagaagggctcccgccgcttgaagtgcgcctcggggcgagccgccgtcaccgtacgtcaggcggcatcgtgccccgacgctgcgcggtttcccctcgcccggcggcggggagagggccgagccacccgaccaggtgggatcctccctccgtggggggtcgcggtggggaggagtcggagagttgtggcggcggtggcgggggccgcggctcccgctggcatcctcactcccggagggagtgggggtgtgcgccaccacttcttcctccaagacctcgaccatgatcgttgaggacaaagagaaacttggggtggaaggaaacaacttctttctcaaacgcgcgaattccccctacctggcgcgccagctgtcgaggaatgatcctctctagcgggtgatcgtgagaccccccttttgtgagttcggccgggggaaagggcgcgttgatcaagagtgtatgtccgcctagagtcttccgagaccgcgcgtgagagctgggattatacaggttcgggccgctacggagcgtaataccctactcctgtgcatgggatttaggatggagtgttacaaaggttcctaaactccagggagaactctaactcttcttggtggagctcaggctaactgagagtcgtcccctcctcttggtggggaaggtcctccttttatagttcaaggggataccacatgcaccgcctctacctactccttcacgggagggggacccacaccgcctgggtagtactgccattcgtgccttcgcctagaagctaagcaaccgtccgtccttgagtggggcccagcgccgtcccccgcctgacacgggggacgcccttgtcattcccctttaaaagaatggagacttttggcgattcacctcaaatagagggagctcctgacggtacattgatgggatgaagcatacctgcccccacttcgccgagcacagggcggaacgtgggggcaccgccgcccgtccgatcggatgtgaccggtcacaatccggtcatgcccgattgacgcaggtcaatcgggcagcgccgcacgtccgccctcaccgcattaaatgtggcgaggggcggttggggcaccgcgcattgatggcggtccagcttcgaccaccacctcactcactcccccaccacgtggcggccgggcgagggcctcagggcgaggcaacctgtcacacccagaaattctcgaaccagaatttctaagctgaatgtgcattaaatccctgtccaggaccagccaggatacacaaacgacaattgttgacatacagacccacatcttacaaaaatataaaagattacaaatgtagcggg

SEQ ID NO: 55019 - DNA, 1501 bp, Oryza sativa
cgcatcgccaccctcttttctcgagttttttacttatcacaaccgaacttggcacctgacgcagggttgcatcggctttcaatctccggcgaagaggtaagtcctacgttccgccagcccaagcaattatacctaccggctacgttggtgttgttcaaggctgtattgcttcgatctcttggatcgctctagtttggttgatatatttgcctacctatttattatatatcttagttaatctagtttggtagctcaatttacttgtatcggctgggatctactttagggttttttgccagtattggctaaatcgctttactagattagattaattaatgtatccataaccctgaaaattagtcaaaggcttgattgtttagactgtatgtttctttgcatactttgcgatgcatcatccctagttgtgcttagaaccataaaagctaacctgtctttgattataataagggtttcatcggcgtttcagccgatgagttatctggacgttgcatcggcttacaaggattacatacaagttggaattagccgattacaacaaagatttcactgtgtatctaatcatttggatttaatgctatcggacttccagcctctcagggttatggataccacatacataatagtagttgactaaatctcggcaggacccaccacataccatgttttatacggaaactgacttcggatatggagggagttccggataaggaaagacaaccagagttctatatggaaacgacaaggactactcagattgtatccatattggtttccctagttcaacttggataatgggacacctatgggtataaatacaaaacccctaggaggagagaggagacgatcaacacccaccacaatagacggaacaacagaagccacaacacacaagccaacatatgccaagacaagacgccggatatcgacttcagggataagtacggctagtcccatacggtgtctccggatactgtcaggggagacgaaagcgctatctctgatcttgtcgggcacggattcgaggaggaagactaccctgttgtcgactacgagtcagaccttcagactgccatgtcgacaacagttagataggctaccccaaatattgtactggtgtgattatggtgaataagagcaacaaccggcttcggccaacaggatgtagggttattacctgacaactcaggggcccgaacctgtataaaaatcctcgtccccgtctcttttacctcagtctcgcgtatatcctagcaccgacgatccccatactatacaaataccggaatcgcaacatcaaacgtcgacacagccgatgtatgatttaaccatcggatcacatattctatgatattattgtcagccgattgatttacattggattatattgttattttattatcatcagccgattgtctatatatcgatatttactcaagtatcagactctgcattgaacatatagccgattattcaaaaccct

SEQ ID NO: 55020 - DNA, 1501 bp, Oryza sativa
gcatagtagggtttcatttgcaaaagcagcatttagcaaacatttgagaatttagtaaaacagttaagtaattaaaccatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgaatcttaagttatcccaatagtgagctaatgtttctaagcagggctaagcaattatatctaatatctagttgaaccaatataaataaagctcaactagtcaaattataataacccaaggtatcaaggaataaagtaatcaagaacaaaaagggctataacaaagaataggttaaacccacccaatgacatttgaaaataaatgcaatatttgaatagaaacagtagctttaaacgggatcaacatgctcaaagggttgtttgggatctgtgtgacttgccttgctggccttggaactcttcaaactcttctccggcgaaaacggactctccggaaacgacggaatctaaacagaaaagagcaaaaacaccaaaacaacacataaacaagcttgaacagtacatgtggatatttttaacatgtagatctcaattttagaaaaatttagagacttgaaccaactaaatcggagctaagatgaattagttatgaatttttgaagattaaatcggattaaaacacttatatagattttaattgaattatgacgcaataatgaattatttttgaaaaggaaaaggaggattattgcgtcagcgggctagggttttggtggaccgggcgcacggcggcggttcacgcgaacggacggccgagatcgacttgatccaaaacggacggccgagatcgaacggtccacgaccggctcacgggagagggcgacga

SEQ ID NO: 55021 - DNA, 615 bp, Oryza sativa
agttttaagggtaattttctatcagaattttgtcgtttttgctacggctaaaatatattgaatttgaaggtaagatttcacatgtaggtgtaatactattgaaagtatgcgtccaatttattttcgaattttatttgatagttcgcatacatgggaagcctatgtgtccataggatatggaccgttgagacggatacgtaaccacacgagggaaacgtactcgtggaatacgccgtcaaccgaaccaagcctctctgtccttccccttcccctcgactctttctctctcgctgcttcatcccccgcttcttccctccatctccccgtttcaaaccctagggcacgtcctccacccccgaaaccctaaccctagctccccaatccgcccgttccggcaccccaccgccccggaatcccctctccgccatctccgccgcctcctccgctcccgcccgctccccgcgccgcccgcggccgtgccctcgaccacccctcaccccctcgcccacggggttcggcgtagtgcggggggctcgtcccgcgcgggcgctctcccgtgccccccgcgggaagggaaggctctccattgaggcctcgctgatgaagttgcggcca

SEQ ID NO: 55022 - DNA, 1501 bp, Oryza sativa
tctacaatactctttttttttgtgtaaaagcatcaacaacgctcaagtatcaatcaactttatttactgaagtagtagcttgtgtgatattttgcctgtcgatagaaccaatctttcttgtcaatttgagtgtatttcctgtcaactattcaatgttctttttgtattgatttgcatctcaattttttttatgtaacttcaaatttgtaggaggacattgtggcttgtttcaacataaatatggtaaattccctgactatttcatctctatatgagattttggtcctgtcatttaatcaaattcttatgttggatttgaaggcacaagtgctgtgctcaaggggagatgggaattggtacttctacctctggtgcctgggtggtgtcttctgttttggtagtaagttactgcttgctgatctaattattactacattttcttcatttcctatgaataagatcagtggaatagagataatgattttggatttataacagcattagatctacatttatttaattacattgcatctctactactctaaaaagtggactattgtctcccaccgatcgtgcacagcgcgagacccaactcttccattagaaaactggttcagaaaaagaccaaatgggcaatcctctctgtgtgtgtgtgtgtgtgttagtattcgatcctcagcattacatccctagacacgacagccaagatggcgatggcggttgcatggttaacacctcagtgttgcattggggctgggtctgctattttgattttttatactagattttctaccgggaaggatgggtctcactgcacagaatgggtgggaggggaggacaaaggaaactctgcttttccatccaatcggtactttgctggctggtccttgattggcatgtacaattattttgcatgcataatttatgattacaatagttggatgaattatttggtttaacactcggatcaggggggctcactgacgacaaatcagttgggggcagagttggccttgctcctaattaacatagctagaagtgatcctattacttgtgcagacgaggccctccaccaagctgttgcaatgggcaccttactagtatttggcaatagtgaatgagttgtggtgcttttgggttcatttttcagaaatccaaatttgttggactttctggacattatgttccttaatctaaattgtagttaatctattctcttagattgtccagtgatgaattttagctttttaaaaaatttatttagtaggatgcaagctcatagtttacttttgtaaaaccattggtagtaatatgattttagtgatacttgcctcttacactgagctggctaagcttgctcgcgttattaatttgattcctaccagcaatccatattttatgttcgtcagaattatgaagttctatttgatatatggtaaatggtgcaatttctcattcactgaatgaatgagtttttttttttctgaaataagggttgggt

SEQ ID NO: 55023 - DNA, 1501 bp, Oryza sativa
gctaacaacatgattgtgactttgtgatttattttagctctgaggtactgatgcatgcattgccctaattacaggtaaatcttttattcaggtaattatgttatcaagatagttaattaggcgccataatgtttttttgtataattttgtgatcactacattttacctgatatgacttgagatatagttttgagtttggtcattaggtaggctaaacaatgcgtaagtcatcaacctcttcttcagtaaaatatgtttatctaatatattctactcctacaattgcgttgataattgccatatagtactagccattatgcaactaaaacaggggcaactccttacgtgtcaccaagcatatatagttagtttttagtgccttgaaaggaattcatcaaaccatgagtggcaaatcaaattgtgctcagaagagcctcaataaacttctgctgatctgcactctaggcagctaatctttgatctgtatacttcctgcatttcatccacaacttttgtttggcatgtggtaattaagaaaaacaaatgacccaattaggtgcaatcagcacaagtaccgataaaagaccatgttaagataatttcaacatcctctggtgttgcagatcacaggacaagatcaaagatccattcttttcttttcccggtgaagatcaagatctgctgaaaaagctgaattaaacaaaaggcaatcaagcagcacacgaagtaataatttggcactactaagctgaataaagaaaggtaatcagcacacgaagtaataatttggcactattcatttgttcattttcacacgctctgagcacattatcctcaaccctgctgcctttttcttttctctctttcctctttttcatgtccagatctgcattctgatttgatgacatacgaaatgtgaatcttctgatctatgggatggagtggtgaacagaatttgaggaaaatatggacgggcacacggcactacgtcaaactggttggcaacttgtgatcatctgaacaattgcaacaggagtgtacaatatgattgcaaaatcacggtctctgctgccagtatatccatattttgcaatgatctaaatatagatgacaagatggacccgaatatgccatatccaggtgtgatataaatggaagatgtacacatttgctgttactgtagtaaatcagatcgagatcaagaaagaccataaagaaaccaaattaaaactggatcattcagctttgcaggagtcagcgtgaccttgtattccttgtttgtttagatcaaacattatttcgttaaatttgaattgttacaatactctctggagaaagtttacttgtaaactaactaattgattcagcatttgtagaaaaatatgaccgtattgttggagccaaactgcggaaaagtagtacagttctcaggagactaataaatctaacttcagaagaagaggaacctcaacatatctcaatgatcacatttgatccatgc

SEQ ID NO: 55024 - DNA, 540 bp, Oryza sativa
tcaaggaatctgaaatgcaaatggtgaatgagttacgaatatcaaattacgattatcattttgtcaacaactaccattaggaacaaataaccaaatctagcaaaatctgttttaactaatattgtaaataaaatagattggaaaatttagtacatggaaatgatgccttcactatgccattcattattgtcaagatatgacaaccaaaatctaacactgtaatgtattgtcaacaagactaacagttgatgacaatagcagatatgaagtttatgatttctaaaagaaataagatgtcagccacagtaataattttgatttgctattatctaaattttttatttgctacagtaaacgaaaggtaaaggggaaatagtaaaatacttactgcagagtgtatggtgagatttaagacacttcttttaagcttgtcagcagaaagaatcaatcagagctgaagatagacgtggtaacatatttttatttattacgaaaaaggacaaatatggtcagtttttaagcaaattgttcaaacagtag

SEQ ID NO: 55025 - DNA, 152 bp, Oryza sativa
tcacacatgcttgtctttgagaatcaattcttttttgaagtaaagaatcagaattgtttatgcatttcttctgatctgcacatgaagagcagtaatatttgcactggagagtaacattattatttttttcatgctgatgttgtttctgcagt

SEQ ID NO: 55026 - DNA, 1501 bp, Oryza sativa
gtaccatgaggtatcactttttctactgtaaatttggtacctcttggtacctagttaccatgagataccaaattttacactaaatttttagtacctcatgatatctactcaatgaccgtaaaattgcttatgcagaagaacaactgaagtcctgatgcctcctaagctcaccatagcaatccgacaggctacccttcatgacccttacatctctctctctctctctctctctctctcacagtttgtagcatctgtgttcatctgtctatttttatattttaggatggaaggagtaagtgttttgccttagctttaatttcagctagttatcctttcagaggagttggggaattgtcccatagcttgacgtttcttttctttgttcgcactgaaaccttttggagctgtgtgcttgtcagcagatactggagatgcaaatcatttccattatccaaaaaatactaggacctgctagcaaccctgtcctacttctagctctactggtgtgtgcacaagcacaatgaacataatttcagacattccatagttaaatgcattgaattatcctcgccaaaaaaaataaagacagtacatccttacatgatacagtgatctgctatggcccataaaagagaaggcaaaggagcacaagtgttgcaagctactagtaagacactgacagttagtcatggggcctggtcgaatgtcatttgctatggtaggcatcagaggcatcaggagctctgttcatctttcaacaagctgggctcttacataatgaaccaggagctctgttcttttttaacaagctgagctctagatcgatcatcaaccaggagcccagttcttttttttaacaagacgagtttttacaggatggccagcttgttttgttttgttctcttttttttttcaaaagaagaaaacgggtggccaccttttgtatattataagcacgcactgcagttataatatgtaactaaaaaactaaataaataattattaaaaaatcatgaccgtcaaggccttgagctgatagtgtgccatcaattcatacaaaagtagatgaaaatatggaataaaaagatcagttcatgataatgaaaataaaactattgatttaacatgcaatggtgtataggtgagtattcattatccaaaatagtatgggtaagtattgaaattgaactccactttaattgttttttgtagatggaaggctagccttgacagcatacggagtttactaggattgccaattagtaacctctgaacttgctagttgacaaaagaaacacaaattcagaacaaaagaaataaaaacaaggatcctttgattcgaggtctttgagacagaactcatcgatggccattgccggtggatgaaggtggacaccttgggtggccatgcaatcttccttggtttagagtgcttcaagttttcaggttgcgtgtgtagtgtgccttcaggttatagttgaccaaaaggcctggggctcaa

SEQ ID NO: 55027 - DNA, 1501 bp, Oryza sativa; identical to SEQ ID NO: 52064

SEQ ID NO: 55028 - DNA, 1501 bp, Oryza sativa
ccatatagcactctgaactctgttcctgaaagccagagtttataacgccttgcatccaaagaaatacaactcattttctttcactaactcaactacacttcaaaaacagagaacagaccagtgaattatgcttgaccattccaaacaacgacagaccatttgcaggtaaataccttgatcatttggtatgatcagcatttctaccagattagatataatcccggctttccatggctcgatcctacggctacccaaagtcatggccatatctagctacctcctactccctgtctcaacttctacactgaactgagcttcagatgattaatcaaccattcatagcatcgactgaatggagatatatatatcctttgcatacatacacgttcaaggtagtttcccaatgaattactttgctactggactatagacgcacaatatataattacagaatcaaatgatacatcctttatataatagcaaggtctctcgggctctcttttggtctatatgtatacatgttagctgatagctagcatgcagtaacaaacgaacagttagataaggagaccacttctgtgaccctgctatcgtaggcctaggaggcattgggagctctcgtcttaggaacatatcactcataagagccccactgcgatgctctctactggtaatagaaaacaatctgaaccattaatcttatttcatcgaatggtctatatctatttgtactattaccccagttggtggtagtagaaacatgtatgggcattattatccaaagatgtgtcgaggggtataatcatcatttagcagtgattaaaccttttttttctccgttttcttgttctgatggaatatgagtgatgctagtggaatggatgaccagatcgatctagacgaaaaaaaatgtaaatgataaaattactcctaatcactgaattagtaaattattaacttacccttaataacaaacggttcagagccctggagcatcactccagaggtagaaggacaggcctcaaccagatatctgttagatttaattgggtaattgatacatttaaatcaattaaatcaaataaattccaaggctcattatgctaggaattcatgtgaattcattctcttatgggatatcaatgggatgaagagttttgagaattaatccatttgattagggaattggtaacttatatcaattagtcctaattgatggatggttgatggttgtgtagtggatgatggttcatggctagttgatgacaattagttgctctattcctcttcctattacattggtgatggttgtgtagtggaggatggttgatggctaattgatgagaattagttactctattcatcttcctattccatgactcttactcttcatcttccattcctcttataaaatgagaatggatttgatctcccgcgtaagaggaagacacacttttatccattttccaaagctgttgctgctacggtaatcccattccaa

SEQ ID NO: 55029 - DNA, 762 bp, Oryza sativa
attcctgcagcccttgcagtcaacctcgatttcatcgatcatcggatcgggagaaaggaaagaagtcaagactgctccttttattttcgttaggagtcattctttccaatttctaggacctctgtgtaatttgaccattttaagggtctttctataaatgtatcgatgctattaatctcatcgctctttctatgagaaatgtgattctcgctgatgtatgttatacgagtactatgtaatcttttatattggataaatgcatgagtctaaaaggaaccataaacgagcaaaaagaatgctgccgtacagtacaggtgccactgccacatgtgtcgatgatccggacaaaatcagttgcaacaaaatgccacgtgtacaacgatgcgtggcacgtgtcactgaccagtgggcccaaccgcggtgatagcgtgaccctagtccatcaacgccttttttttattagtgcctggctcaccgattagggccattctgacacttgtttaaaatgtgctaatcaactcctcgctaatgacgtttttggtagtaaatcacgtcaaattcttggacggttagcgtacttcgcattcacgcgcctctcgtgttgaattttttttcttttacaaccgaaactgatgcagtgacagtaaactgtggaagaaacggagtgtcagtttcacatcacatgtggagtgcttaattagttgttttatactatgtactactccctccgttttataatataaaacttcttaacattaccca

SEQ ID NO: 55030 - DNA, 1501 bp, Oryza sativa
agtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggaggttggttgggcctgttgcaacgtggtgtagcgttggacagtgtttggttaatattgattaattactacagctgttttactgcttccaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagccgcccgctgctgaagtcaagcttcccggtttagctcgcttttattcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacaagttggtatcagagccgaccttgaccgtaggacaagccaactggaaaccctaagagccctctgaacccctttttcatctgcatatgccctttttgcacctggaattgtttcgggaaaatttggagttttgcctctttggtttgcgggaaaaatcttggtcgttctttcgggtcggattttttttttaaaaaaaaaaaaaaaattagctcagcctagggctttagaaaaattttagttggagtttattcgacagtcagtcgggaatttattgggggtttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcataaattggttcctatcccttgtctactttagatgtcagtcctatccctcgttcgcaagcgccgctccaagcttcagagtcgccacccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 55031 - DNA, 1501 bp, Oryza sativa
tatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtccggaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggaggttgaactcatgcaaatactctataactgttctggttccttgttgcagggaacggaactctctcttcttttgtgccacaattccctcgggaacctgtgctttattgaaactatgacgaaactctgtccaagtaaactctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagt

SEQ ID NO: 55032 - DNA, 1501 bp, Oryza sativa
tcgtcgtcatctggcggcttgttaccgcgggctggggctagcaggcagtctcgggcggacgaggagcggagggccgcgctgccgtgggcggttcacggtcatgggctgcgtcatgtcggtggcgtcgggcgccgcgtgcggggtgtgtgggggagtgcggcgtgcgtgtgtttgttgcatcaacggcggaggtggaggtggaggggtgaggtgcgggatcgcggtgacgccgctgctgccggtggcagctcctccctcgctagccaccgcccttgcccgccgtactcatctgctctctgccagccgcccgtggagaggggaggagagaggaagagaggtggtgaggggaggggaagaagaggctgatatgtgggacccatgtggatcccacgttgagtcagctgccacatcggacaaaaccgctaagtgacctagttagcactggttttataagttgaggaacgcgttgtatctggttttgcggttcaaggacgattttgtaattcgacgacaagttgagggacctttggtgtacttgttcgtaaaagaaaagaaacaccggcccagtattgataagaagcccagacggaccaacaggccaagcccatcttatcccaagaaaaaaaaggggaaaaattactcctttctaagcgaaggcctaggctaaagaacagagaagagacctgctcttgcgatccttctcactctcttcctccccgagtcgacggccggccaccgacttgggggaaaccaagccaccgccgccgcagccgccgtaccccaccctccctcccggcggccgcgggccatagccgcgttctcccccgcgcgtctgcctgcggcgtggaggcgtggggggcgacggcgatggggtccatgacgatcggcgccaagtacaagaccacgctcaaggaccccggcaccaccggcgtcctgcgcatggtgcgtcgcgatcccccctctgttcctccctccctctctctctcccgcatagcgtcgcctctctccctccagctccgattggtcgggtttaacccttgcggccgtgccctactggatacacactccgcgggaggtgcggtgggtgtgctgattctgtggagggatgtcgcttgacgggagggttttgatcgggtgttggtcgcggtagtgtttgattgggtatgctagggcttctgatgctttcggaggggtttgtggtggaaaggaatcgaaccgatctgcggtagtcggatgtataagagggatgagcttctggagacattggtttagctagcttggtggttagttatttatgttgggttcatgtagtggagcgttttgtgcctagtttctgtggatcagatgcaatgagttgcatatctgtttgattcgctgatgagttttgcgtagttgcgttgtaaattttgcttgagtatttctacctgcttaatttcatgcacagcttgctgggtctaaatggcatctatcgtttgatacttttaattgtagaacgaggata

SEQ ID NO: 55033 - DNA, 1501 bp, Oryza sativa
tgggcctgttcggtagcctattttcgcaactgtttgggctgtgccgcacaacccagccgttcggctgcagtggtctaggctgtgttgcatagcccagtcgttcggttgtggaaacggctgcaacccactccccgcaaaaaaaaagttggtttctcgcgaaaaaaaagaaagtacctatacatctttcgaaagatttttataatcgtatcacacagatttttaatctttatattaaaatctgatagatataataaaaagcaaaaagcaattaagaaacaccataatggacactaaattaccatatcctcaagaaaaagaccaaatcaaatataaaatttaaaatttacatgcgaagattcaaaaattacagtgtaacttacaaaagttatagtgtaagtttcataaattacactgtaacttacaagaaaatgcactgtaagtttgagttagaaaatcgagtgagagataagaaaaaaatctttcgagtgagatatagcgaaatccaaaaaaaatgacgcccctcttctagttcccatctcccagtcctatcgcgtagcccacactccaccctatcgcgccttctcttccatcgccacggcccacactctgccgagcgcgtctcgatcccctccgccttctctcccgtcctcctcctgccgagccacgccgtgccttcccgatctcctccacgttctctcccatcctcatccctccgagccgtgccgtgccttccggtcgcgcccgacgccaccccttcccatccccttccttttttcctctcaccactcccgatatgatcgattaaatccaataggatgtgaagttcatcttgattcagctgtgggggttgaggggaggggaagctcgacagtcggctggagttaacctcattagggtgtggttgttgaggggatagagtgcagccaagggaaacatcccgtcgggcaagacccacgctgtgtcgctggcgacgtcttctcccccagatccgtccaggtccggcagttaggaggtaagaatcatctcccttttgtgatttttgatcttgcatttttaggggtatttgtgtatggcaccattcgccatgtcaactcggccgaagggcaccttgtgcaggcatacgaactgctgatttgattcttggacatttgtaggaccgcaaccagaagcgctggcacataacctgagacgatatggcaccacggagcggttggcacttgtaaggtcacaagagcgacttgtacgtaggaatcctcaatctgaacaaacgatttccctccgccggtcgacatcgtcatggtctccacctgaagccgcatgatacaatctgcgtacaactcctgcacggcagaactaactcaaggcaagcattgctttctcatattagttatcagtgcgaaaaatgttttgcatacctgcaacttgatgttagtactgtgtttaagatctcaaaaactcctaagttggactacatgtaatgcaaaattacacatagatggct

SEQ ID NO: 55034 - DNA, 840 bp, Oryza sativa
tcaaaataattcggctttggaaaattaaggacggtaagaagtactgtatcaagctagagtataatataggggtaaatatttggttgggttagataaactaccaatatatgctcttgttgtcataaggtgcaagaggatagaagaactgaagaagcaggtttggtttgggtttggtaggatcggattgagtatttcttttttttttaaattacacagtacaacgcagatttcaactagctccgtcctaaaataattataattatatatttttagtacatattatgatttaagaagaaaaactattatgtctccttattaaatggtgtataggtgttatgagccctggcgtatgaatgaattggataagaatgtgacattggtggccctggcttgggtagcttgagaaagcagagaatgagagatgagagaatcagattgaattggcttgctttattccatctaactaggaaggtagcccacgcacatacgtaggtattttatttaatctgtttaaaatttcattaccaatgttaatttatttgtgggtgatttttattgaaatactttttgactatattccaatttgctagggattactttgaagttagttatgattttcttatagttacgcacgcaacataaaaaattctaaactaaaattaaatcaaactgtgtagttttgaatttatgagaaagtatatggtgtcacaacaattgagttggtttctacaaattaaactatatatcatttatactatgtatctttcttttctaatatttagcatttcttatttttatttgattttaaattaaataacaatttttcttgtataccataga

SEQ ID NO: 55035 - DNA, 1501 bp, Oryza sativa
agaagcaatactatgctccgtgaagctacacttttaaaattggtagccagcgatcttttattctattttggatggcgtagtttctataaaataatgttataaattctacatgttttatattcagtattttagttggatatcatcagagtgagatggagtttgttccatgaccacgtggtttttatgtatctcttctcttgactcgttgaccgtgtgtctgttgatagagttcggggatgtaaattatttcccttattaagaataaattttaggtttaaacacagatactaagtaagcagatgaaaattaaaataagagaagaaaatgtaggtagagaaattatcatattttagaataaatttaaatgttaccaaaattatattgtagggcggataaaatatgaagcatgtatttagagcaagtttaatagtatagccaactgctagctacaaatcatctatagctaatgtaataactaattcatacattagttgcttactatactattaatatctggtcctacctatcatacacacattacgtcttggagtccgtactgcagctgggctacagatctgtagcctgctgctcctcccttttcctttatctttttaaaatatgtttataactggtttatagtctgctattgtatctgctcttaaatacgtatgtattcgtgtacaatagtatacttaagtaggtggagagagagacgacagagcacgcggaatgatagcccgatgatcatgcgcggccaaagcgagcgaatcgatccgagagaaagcagaatgaaataggcaggcagcatacagcagcaaaggcaacaacaatatatatactgtatgagagaaaaagaagggaaaaagattgtgggcgcggcgtacgagaggaggagaggcctgacgccgggaaacaggtcctcctgccggcgggacgacgtaccagtgcactgcagcgcggcaggcagagcgcgtagccaacgcccgcccaacagtggtgttgtgcctggctactgctggctttgctggattttccaccttttggtccttttacaaaaacttattctataaatgaatccaaaaaaacatattctaaaaatgatcatttttgcggtgccaacaatggtcatgatagcgccaatgacattggcactgtccccttcatccctcggtgaaagctaactcactaatgtgaagggaatagcgtaaatgttgttagcgtcgatgacctatttgaaaaataaataaaaaaggacatatttgtaaaaaatggacctatttgaaataattttttttattacaaataggtccttggcacagaatgacagtcactgaggacttatttgtaaatttttattataaacaggtcctttttcaaaaaattacaaattggtcctctgaattagcttccactgaggggctatggggatggtgccaacatcattggcgctatcatgttaggacaaggcgctacgatgttggtgtcacaaaaaggatcattt

SEQ ID NO: 55036 - DNA, 1501 bp, Oryza sativa
aacattgtgaggacgtcccaaagcctaggtggtgcaacgctccaaggcatgtcagcgcgaaatatctagatggatggggtctcaaataaagcccaaataaatacggtaaccatccaacctcatcacagaccccgacatgtcttgaagagtgcactacataggctctaagccatcagatatgaaatagaagacacaaccattggaatagccacactagtcatctatgtcatacgcccgtcaaccactcaatggtggcgaccaaaagcgtaccccagagactcgatctcaacaaaggcatattccccggttatctcaaccatttcaaacccatcctcatgtgggactagttgcccaggaatgcaacatagtctcacataaatcatctcaagcatgatatccaaataataagtggttctaagcaataagcataaataatcttaataaggttctaagtagtacttggtgacaagccataaatattggttcatgcggtaagcgtgctacccaaaagcccataggcaaaccgactaggataaatccctagttagaaccatcctagaaatctgcaacatcacaagctgcatcaaactcctcatccaaacagtcattacctgcagcggggtccgagcataaacaagtaatagaaagcaagaaatcagtacattaatcaaattaatgtactggcaagtcggaaacaatcctagcatactacatgttggccatattcaaggataagctgtgtataggttaatttgcataaatgccaattttagttcacaacatgtttcgcaacggaattttataacaatagtatagagtaagtaaaacttgtaatgtgaatgaataaataatacacatctacccctcaaggtagatcatcaccactctccatcatctcatcaccattcaccgaactttacccaagttcacaaacaaaacattccaaccattttccaggttcacaagagtttatcaaaatcacaaattatactcatgacacttcaccatgccgctcatgaccgtgagcacggctaatcgattagttttagactctgcagagtttgtacaacttttaagcccacatgatatggatcgctctagtttttccgatacccgtcggtatcaccacactctacacattgagtgtgatctagaggtcataacggaaccgttacattgtttattgtctagccttgcaccagcacgatgtgtgttttacccacgctactagcaaggtagcgccactaggtagcgggcccacgctttaacctagcgccgtaaggaacccagcccggaatacctcacgaggcacgacaccgttgtattggatagactacccgctaaaatcatcacataccacatatcattaatcaatttcatcatatcacaaaccataggaagttccgataagtggcggtgtgtctcggtatgcccatgcatgtgtatgcagaggcttggttagtgcaaagggttagtgcatgtgctctcatatggtaccagg

SEQ ID NO: 55037 - DNA, 1501 bp, Oryza sativa
atcagtccatttcttgtctgtttgatctgatgtgggcctcatttttcggcctaacctagcaaatgggcctttagcaagttaggcccagtataacttctgtcagaaaaaaatgggcatttgcaaatttaccaccggttttttaatattgtaaagatgccactcgaatgacagttctagtggcatttttgcaattttctagtggtaaatttgaattgcctaaaaaaagggtcaacttggcaggcctacagatagttggaccttttgaagcaccctaacgaggggccgcctaatgggagccccccccatccccctatacactgctctcttccttcctccaccccttcttctcttcctaatacaccataaatttaaaaaaaataaaaaacacaaagttgaaaaaacttatgtatagaaatactatataaaaaaatttgaattcaaattcaaattaaaaacaggtatgtaaactttgggtctataaactaatatttgaattcaaattcaaatttgaattggatatgtaaacttttgatttataaactttggatctaaaacttttaggtgtataaactttagatgtatagaaatactatatataaaaaatatttgaattcaaattcaaatttgaatcggatataattcaaattcaaatttgaatcgggtatgtaaacttttgacttataaactttgggtctataaactttaggtgtataaactttagatgtatagaaatactatatataaaaaatatttgaattcaaatttaaatttgaatcggatatataaatttttgatttataaactttaggtctttaaactttagatgtgtaaacttaaggtgtacaaattttagttgcataaatttactaaaataggaaagtaatgcggtgccaaaaaaggaaaccacgtggaggagaggggggcgccctaggggtgatcgccccttagcaatctcgccctaatgactacttcctctgttttctattataaaactttctatcattgccaacattcatatatatgtcaatgaatctagacatatatgtttgcctagattcattaacatctatagggatatggacaatgctagaatgtcttataacctgaaaatgaaaaggaggtagtataaaaaaatctaaactatttaagagagattttatttatgagaaaaggtgcaacagccaaaagcttctcaaacaggtgttccgacaatgcaatggcttgtgtggtttggttccaaaacttagccctgctaaaacatttataacttcaatagtaacttatacgtattcgaattgaagtcaatgtgtgccagattaatataacttgagaaaccttgccttactatgccaaaacttaagcttttcacattaccaatattttgtaggctaccaatccaacatgccctaaatacacttcctgcaatgcaactctcagtgtatttttcaattgatatgattgtgttttctattcaaagtcatacaagaaatacagttccttg

SEQ ID NO: 55038 - DNA, 1501 bp, Oryza sativa
atgacgatggtgatggatctgactttgatttggggttaggattagatgggggagaatgtgacgggggttaggattggagcgaagaggattcatgtgctgtcttaaacagagtttattggagcacaacaacgagagaggcataagagcaagtttaatactaaaactttctaacattatccatatttatatagttgttaataaatctagacacacacatatatgtctagattcattaacatctactccctccgtttcacaatgtaagtcactctaacattttccacattcatgttgatgttaatgaatctagatatatatgaatataagaaatgctaaaatgacttatattttgaaatggagagagtatatgaatatgagcaatgctagaaagtcttacattatgaaatggagggagtagtatagcaaactgttggcttcaaatcatctatggtcaatttaatagctaattcatataataatcacctataaacatatactacacaattaatatctagtcccacatatcatgaattgagatctggtgatgtagtagtaacgactgcaactttagcagtcggagcacattataaccgttggatcgatggagccaacgctccgattcactctgtcatcctgttgtaccattgatactacagtaatcgctacagtacaaatttgctatagtattttatgaacagtatttacctgtcatctgagccgttgatttttgatccatcggctgcactgcaactgctaaagttgcagttgtagtaacaattgcaccatatctcgatctcacctatcatacacacatgtattttagagtatgtgctgcagctggctataaatctgtagtcttctctctcatcttttatcttctgtttatagctagcagtatgctattgtacctgctctaactaacgcgttatccgttcgatagagatgtcaaataacagtagcacaggaactatgaggatgaattgtctagtaccacaagtctcgcaagatggactccttccaaatctttgacccgctgtcagttcatcatccgtctactctactgtagggagtaatcccaagaacacgatgtgccactgatggctctccggtcacgaacacacgcatcaaaatccatcatccccctccgcatctcccttctgcttctgctgctgtcgacgccgccgtgttccagctcgacgatcatccagcacggcgaggcagaatccctcctccggtggaaatccaccttgtcggcggcggcgtcagcgtctccgctgaccacatggtcaccggcgacctccagctccgcctgctcgtcctggcgcggcgtcacgtgcgacgccgccggccacgtcgcggagctcagcctccccggcgcagggctccacggcgagctccgcgcgctcgacctcgccgcgttcccggcgctcgcgaagctcgacctccgccgcaacaacatcaccgccggcgtcgtggcagcgaacgtctccaccagggccag

SEQ ID NO: 55039 - DNA, 455 bp, Oryza sativa
gcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaggattttcattttcctctatactccttaatcaacatgctgtaaaactttctgtaggtccgaactgcttttatttaacgagtcgtttcccttgtttccttagcatgtgatcccgagtacctttgtcattgtaga

SEQ ID NO: 55040 - DNA, 779 bp, Oryza sativa
tttctttgctccgccgcacgtgcgcgccgcgccggcgccgctgctccccctctctctccgcgcagagccgcaaacctggcgcgcgatggccgcacgcgctccggcccccggcttcccgttccacgcgtcgggtagccagtggacgcagccgcaaaggaggagcaaaagatcaagcgccgtccacgtgtaccccaccaactccatgaattcccagggcctccaggtcgtcaccgatccgacgtcgcttacagccgggcccggaatctaccggcccaaccttgccagtgactaaccagaacgacgagtacgattagtagcccgattagataaagtggggactaatcgccaatattaaacttaacaggtggactccgctggtggcatgatgagctacccatcctcgccgtccacgtgtacacctcggcccctgatgccccgcaccaaccgtcctccgattaacccatccaactgaccccgggggccacatgttcgcggacccacctgtcagtgagcgatcaacttgctacgcggggacggacgggttagcggaacgaatggtgggcgataggcaaagcagccgcaacccacccgcaaaaatgcgaaagctacgtaaactgctacccgctgctacgccctcgcggggccggatcctcttgggcccacacgtcagtgaccgcggtggaacgtgtggggagaccttgactccgcagacgcggaccggtcgcgtagattagtatatgtggtacgggattagcaagcgatcgagctgtcccctacct

SEQ ID NO: 55041 - DNA, 1501 bp, Oryza sativa
atatactctctccatttcaaaatataagtcattttagcatttcttatattcatatatatctagattcattaacatcaacatgaatgtggaaaatgttagagtgacttacattgtgaaacggagggagtagatgttaatgaatctagacatatatgtgtgtgtctagatttattaacaactatataaatatggataatgttagaaagttttagtattaaacttgctcttatgcctctctcgttgttgtgctccaataaactctgtttaagacagcacatgaatcctcttcgctccaatcctaacccccgtcacattctcccccatctaatcctaaccccaaatcaaagtcagatccatcaccatcgtcatgacggccgcccaaaaagagaggtagatggtgctgaccatatctaacttctcctcggattggtaaggggctgtttccccgaaaacttttcccaaaaacatcacatcgaaactttggacccatgtatggagcattaaatacagataaaaagaaaaactaattgcatagtttgtatgtaaattgtgagacgaatcttttgagcctaattagtctatgattaatcatactacagtaacccatatatgctaatgacggattaatcatgaaattaattttttcattcgtgcccgaaaacttcttccgatatccggtccaacgtccgatgcgacaccttaaaattttcatttttcaactaaacaggccgtaagtatctgagattgtacacgttcctggcagatgaccatgtgattagaggagacactctgcgtccgccaccaaccagccgacttttgacacgcaattcacaggacaacacaataaccattgtactttcgtaacgacgaacggattcttttcaagcaaagcaacaaagatttatcctctttcgtggaagaatcctgattgttgaaatggcaaagataaacaacacctcggatcgacggaagaatgctgaaaattaccccaagtaccaactatatgataaaaaaaaaataacccacatgtagcggacgagagcctagcaatcaactgattgggtccaagaacatcagtgtctatcagtgtttatcagtgtctaatcgacaggcatgcgaaattttctgagcatgaagcccgcgtacagtagcaacgatggcaaggtaaagcaagtaacaacgccgcgggaaggtgattttaaagcaatgggactacctatttcagcaggatggtcagcggacgaagaaagaggcaacagctgtaatatctttccacgagagatgcagcagttgtgtccaccagatcttgggcgtacacaaaagggacagatacccaagttgcagtcacgagaacttaagacacagaaagaagaggaggagcatgaaatgtgatttaatcaaatcaaaccgatgatacccacaaataagacattaaaggagaagtgcattaataagggaggatatgtcaattgtggtcttgaagatacactcgatgtgctta

SEQ ID NO: 55042 - DNA, 1501 bp, Oryza sativa
tgtatcgagtgttgaatgaagaacgtgtgtaaccctctaggggtgctgtcgatccccttaatatagcagcagggtgaccggcggcaaggaggatgcaatatcccttacaatccgggctcctgccatccgtcaagatatggcgggatatgtttctatctccttattcctcaccatttatagtaacagattacatgggcttgggcccgtagcatgctagagatctggcctttgagtactgtgatgggctaccccagtacgataactcccacagtgggccgtgcaggcgtgccgggccggacaaaccaggaggcaggagcctaggaagtgctgcttccagcttgcttgctgccataaggccctatttgtttcagctcaaggccctatttatttcagcttagaattattataatctagattattagtagtaatctgaaataaacatgtagattattataatctataagacataatagtataatctggtaatctcctctaagcgtgttttttcatattatttggtggttaaagactcactatccttattctaccataatccagataaacaaccaactcatagcttattctactatagcttattataatccagcttatagtaatctagctcaataatttagattacatataaaacaaacaggcctaacttgcctcgttgcctgctacattgcttcttgcggcatgcggcttgcctcggttgcctgcatccagtgagcgagctctgttcagttctttattgtctagtgaaaaaatgaggctgtgaggggatttatcatttacatttcgtagtatttgatttattggtagatttgcaaattgcaatggagaagaaaatagcatagcttaattactttacaagccattcaactgatacatccccaacagacgagagcacaaatagaccaatccaacaaaacagataccaatagatgattagatgaagtgaggagagcatatttattgaatggtccaaattgagcaccaacatgtttttccaaaaacattggatggtaagatttagagattctttcaacgaaattggctcgataaatttgacattggaatatagtgtaggaaaggatgttgcattttctttttcacatttttccatttgatacttaaactaccggttcatattttctgataatggtatgcatttagccggtgccgtacagcaagtctgcgggatcgcgtggtgccacgtggccggcatgtgggactgacgcagtaccacgcgagcgctgcacgggattgtttcagccatcaatccgcgttttggtgtcgcgtcgaataatcgatcccacattatcatcttgcggtacatgtatatttttacaattcttttaaaaacacgtatataattacagaacgtcagaaatcatgtatattttaattttgttttctagatttcgccatctatcaaagagaaagaagtcttttgcaaggggcatctttcaccaaaaatttcactcacagcttaaaattt

SEQ ID NO: 55043 - DNA, 1228 bp, Oryza sativa
agcccatgccgcatggggggctaatgcgcgatcgatcgatcgccagggctgatcgccctgcgatcggatcccaccccccgctcccctataggctactcccacttctcccctttctccccctttcttctctactactactacagtacaccacaaaaaagtttttaaaaaacaaaaaatttagaaaattttatgtataaaaattttgaattcaaattcaaatttgcatcgggtatgtaaacttttaacttataaattttggatctataaactttaggtgtataaactttagatgtatagaaatactatatatagaaaatatttgaattcaaattcaaatttgaatcggatataattcaaattcaaatttgaatcgggtatataaactttaggtccataaactttaggtgtacaaactttagatgtatagaaatactatatatgaaaaatatttgaattcaaattcaaatttgaatcagatattggaattcaaattcaaatttgaatcggatatataatctttaggtctataaagtttaggtgtatacactttatatgtatagaaatactatatataaaaaatatttaaattcaaattcaaatttgaatcggatatatatacttttgatttataaacttttggtctctaaactttatatgtgtaaacttgaggtgtataaactttaggtgcataaatttactaaaatagaaaagtaatacggtgccaaaaaaggaaaccaggtggagggagggggggtgggaaagggcgagtgaggatcgctcgcccgcccagtagcatttccgcatgccgcatggtggatgtgaaagaaatagaggaaatatatcccatgctactttgattttttttatgctgttactttggttttgaaatgcagggaggggatatgagatttgggggtgaagagtagatcagaaggttgcaagctccacgctatatgcaataggaaaaaaatacgaattacctcccgaactatcacggtcaacctaattacccctctaaaccataaaaccagacattttatacctcaaacttttcaaaccagacgaataaccccctagtggaatccagagtggttttgatcctacgtggcatacacgtggtggtctagtcagtgaaaaattaattaaaaataagtgggctccaccggtcagctcctctttctcttctcccacctcatttcccttccatctctatctctctctcgctctc

SEQ ID NO: 55044 - DNA, 1501 bp, Oryza sativa
gtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcgacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaagatcgtctttgtaaaatggctttgggcaactaagtgacctttaaatgccgtttactgcaaaacttaacccctatattattatccccttgtactcctttgcattaattgtgcatctccggtgtggcttgctgagtactgtggttgtactcattcttgctcaatctttcccctcttcagtaagagaagctttggagaagaagtcttaggtggagtcctggcttataccccagttgagcgcctgtgaagatggagccgtaggcccgctagtccgctgctgtttattttttgtttgtcaggccttaagcgcctttgtaataatgtaaatattatcgatataataaagatgtgccttttttatcatgtttgtgtggtgtaccccggcttttcctgggacggggattaatacactagcgttcgggaaaaggaaatttttccggtcgcgacaagctggtatcagagccatctcgactgtaggataagccaagtggataaaacctaaggacatattttataaataaaactatttgcgaaagttcctctttttctccttcccctaatgttatttgcaaaaggtttactcttttcttccttcttcaaatttcaactagtactagatggtcagctttgcgaagaagaagatgtcgtcagttgtttgccgaagctccggaagactgttggatccgtcagcgcagcaaaggaagcagtgaagccagatgtgaagcaagaatgaagatcttgggaaccagtcgcagaacctaagccgtcctctaggatagtgttgtcagtcgtgtgtttccttgcttgtgtgtgtagcgcgtggtttgcatcggtgggttgtgatgtgaccatgctaggttgtttgcttaatcaacttgcagaataagcaaaacaaacaacacatcaacaaaaagagttagttcctttaaggtcttgtccctagttctggtctattctttccttgtatgcttcccctctcaacctctaccttgtgacagatggataacactggtaacaaaggctatgggaa

SEQ ID NO: 55045 - DNA, 230 bp, Oryza sativa
caccaagtaatcaaatactcaagcatcaaactactttcctcaatgagcgcaagtatgtaaatcccctccaatccattacacccacatatacaactaaaatattactacttcaaagggtaggttatcatggcaccaccattcgaaatggacccatcaagccttctttttcccattgcccattgcttccctatgttgcagaatggcatgcttcctttgttttctctcccaga

SEQ ID NO: 55046 - DNA, 1501 bp, Oryza sativa
ggattcgttcgaatcgcgcccgcaatcctcgccggcgtcatcaatggagcccgagaactccgcggccggtttccttcctccccggccgccctctctccctctcggcgctataaaatcgtcccccgtgcttcgctcttccgtttccgccgctcgccgctcgctctcgccgtcggattcgtgctcgcgtcgtgcacctctctctccgccgtcgccgccgagctccgtttcgccaccgtcgtcgctccggtcctcctcccgactcggcgtcacctccttccgcgtcgccgcgtcgccgtcgaccccgtccgccgctccgcttcgcccgccgaccgccggagcaccgtcgccctcggcatcccgaaccgcgccgccgcctttctccactccggccgtcgtttccgccgtcctcgttgtcccggggtgagccgtggaccgtccctctcgcttccctctcctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgttaacccggtccgcgcgccccctctcccggctgacgcaataaatgagatttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcttttccgtcggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagactttgggaattctcatatcttttggacactatggaatggttggcttatgttggaattggacacacacctccccctctattcaaaacccccaaaatggttttaggctgggctcgaggtgcgtggttgggttttgttagtcgtacctcgagtactataaggattaa

SEQ ID NO: 55047 - DNA, 1501 bp, Oryza sativa
gaacacagcatgcgtcagagctatacatgcgccatgatccaacaaactcggaatcaaccgcttagtggataactagagcaacaaatagccgatggcgccatggattacttcgacattctcccccctaattcttgccgccatcgccactgagctcagcaatgtcgataccgttgcacagctcctggaatcaaacacggccgagtggcttcgtcagtatgtccgtcagctgctcctccgtgcgaacgtagttgatgacgatattcccgttctccacgcactcccggatgaaatggtatcgggtgtcaatgtgcttgctccggtcatggaaaacggggttcttggtcattgcaatgatggacttgttgtccacattgatctccggcgctccgatctccgagtcgagcaagtcactcaagagtcaagagagccagacagcttggtaggcggcggccgtggcggcgatgtactctgcctcaaaaaaattgagtaaagctagttcaagtccgccggtgaacttgacgagctactacagcaccatcggtgggctgcgttatctggtgaacacgagcccggacattgctcacgccgccggctaccttagccggttcatggaggagccacacgaggatcatctagcggcggtgaagcatgtgttgcggtatattgccagaacacgacaccatggtgcgcactacgccaggggaaaaggaggattgctgaagctgcatggcttcagcgacagcgacatggccggtgatctggacacacgccggagcacgagcggcattctcttcttcctcacaacaagtctgatcacttggcaatcgacgaaacagaaggtggtggcgctgtcatcgtgcgaggcagagtacatcgctaccacggccgccgcctgccaagctgtctggcttgctcgactcttgagtgacttgctcgactcagagatcggagcgccggagatcaaggtggacaacaagtccagcattgcaatgaccaagaaccccgttttccatgaccggagcaagcacattgacactcgataccatttcatccgggagtgcgtggagaacgggaagatcgtcatcaactacgttcgcacggaggagcaactgaaggacgtactgacgaagccactcagccgtgtttgattccaggagctatgcaacggtattggcattgctgagctcagtggcgacggcggcaagaattaggggggagaatgtcgaagtaatccatggcgccatcggctatttgctgctctagttatccactaagcgcttgattctgagtttgttggatcatggtctcatggcgcatgtatagctctgacgcatgttgtgttcatgagggagtttgtttcgtttttttgttttctagggagtgcgtgtgccctgcatgttctttgatcgtgggatggcgcaatcacctcaggagacatggctggggcgccgggttagtaggaacgcatggcgcacacctcggtcgtgtgatggcacgatgc

SEQ ID NO: 55048 - DNA, 1501 bp, Oryza sativa
ctcaaaaacgcccggaatcgtaaccgcaaaccacgccggcgcaatcaatggcggccggaacctccgcgccggttaccaacaccccggccgccttccctgactcccaaccctaattaagccactcccgtgccctcctcctccgtttccgacgttcgccactcgctctccccgtcggaatcgcgctcgcgccgtcgcatattctctccgccgtcgccgccgagcttcggttcgccgccgtcgtcgctccggacctcctcccgactcggcgtcaccttcttcggcttcgccgcgtccccgtcgacctcgtccgcgcctccgtttcgcccgccgactgtcggagcgccgtcgtcctcgtcgtaccgagccgcgccgacgccttcctgcgtttcggccgccgttcccgtcgtcgccgtcgaccggggtgagccgtggaccgctccgttcgcttcccccttccctcctctctctcgggcgccgatccgacgcgctggtggtcgccggcggtgaccatcggggcgcgggcgcgccgtctcccgtcgaccgtgccggcgaggccccctttgggcgcgccccgcggctgccaggtgggcccgggcgtcagccgcccgcgcccgcgggtgcggctgacgcatgggacccacggcgccggccgccgccagccgcgtgctcccggtccaccgtggaccgagaggctgacgcgtgggccccactcccgtggacccggtccgcgcgccctctccctcggctgacgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggaatttattagagtaaaagccttttcttttccgttggtcgtgtagacgctgcagcttcggaagatccgctcttcgtggaagtcgaagccgtcggttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttgtgaccatattattattgttattgttattattattaccttgttcaccctagattaaacaaaacctcaactagtggacactctactcgtagtatccctagtttaaatttagatagatgcttcgcaatttaattaggtaacattaggtggtttacaactatagactttgggaaatattcatatcacctggacactgtggaattgttggatcattgtggaattggcttcacaccgccccctccattcaaaatccccaaaaatggttttaggctgggttcggggtgcatggttttgatggtagcacctcggccatataaggaccggt

SEQ ID NO: 55049 - DNA, 1336 bp, Oryza sativa
ctacacccaccgaacccatggataccccctgagccccccttcaattttttttaccaaggttgataaaatagggggtgttaatagcattttagtatagtttaatactgatattatgtgtttataccggtgtactcgatatgtttagtctctcaactttttattgctggatccgcccatgcctccatagaaagtgcaacgtacgttttgatcgatggagaggcaaattttgagacgtactggttcgtactgatcatccacgcctctccggctatggttcgtcctcgtcggcgaggcgtcgccgtcgcatgcatgcgtgcgttcgtgcctccacgcggtagctataggaggtggagtaggccggtttgatgcggtagagcgctggagaaagataaaaaggattttcgcagatggccaaaattgctctgtgcaggtggacacaagcgtcgtctacaagtagagatttacgaaaatcatcgattttcacacgaggttttcgcaggtagacggtcggtccgtctggaaagatggattttcacgggccgatgtttgagggcaaaaatttgactcatatgtttggtgaaatggacatatcagtttataaaaattgtttatctagtagttgtcgaagtaatccatggcgccatcggctatttgctgctctagttatccactaagcgcttgattccgagtttgttggatcatggcgcatgtatagctcagacgcatgctgtgttcatgcgggagtttgtttcttttttccgttttcttgggagtgcgtgtgccctgcatgttcttcgatcgtaggatggcgcgatcacctcgggagacatggctagggcgccgggttagtaggaacgcatggtgcacacctcggtcgtgggatggcacgatccagtcagaggtgggagacgtgtgtatgtttgttatttaagttccctaatgcatctgaaaatcgttgccaagttcatcacaacacaaaacctcgctttctcgcttgctctgttttgatcggcatttcatcgaacaccttcgggagtttgccaacaactggtatcagagcctcgttggctcgctggtgccatggcggagcgttcactgccacatcattctcgcacacctccgcacgtttcgacgccaccaggctcgcgctctcctctttctcgcccattgtgtaccccgccacgccgttgtcctgctaagtccccgccgcgccgtgggcgcgggcgtggcgagcgacagcccttggctgctcagccgcgggtcgtcagggagtcgagcgttgccgttcactactcggttctgacgaggaccaactacgaggaaagggcgctcctca

SEQ ID NO: 55050 - DNA, 1501 bp, Oryza sativa
agtttctatatgaaagttgcttaaaaaatcatattgatccatttttgaaaataaaattacctaatactgaattaatcacatgctaatggaccgctcaatttttcgtgcgctagaaatgtattcccaacacacaacaacgaacccagcctaggactatgatacaatagaatcctgcatactctctctatcaaaaaaaataaatttagaattggatgtgacatattctactctgtccagatggaataaaaacaaatctaggtttttttacagtgacagattaattccatgtgcaggtgaaaggtctacacaggtagtcaacttcttttgtctttatcgttgaaaaatcaattatgagagaagcctgaaccattaaaatggggttgcgggagagcacaaggcattacaatttacaagccttgtgctgctaggtaaaacagcagagtaccccatttttcgtatggctaaggctgagtttaatgagaaggtgaaagagatgatcgggaagatacgcaaaacgaacgatatgagctattagtatatgattaattaagtattaattattttaaatttcaaaaatagattaatatgatttttttaaagcaacttttctatagaaatttttttacaaaaaacataccgtttagtagttcgggaagcgtgcacgtcagaaaacgagagaaatcttctataaaatcagtcttcatcacactctcagtgagaagcctgtttttgacaatttatgactcctgtattgtgtgcagtatatatgtatctttattatgcctatgtatgttggttgattttgtcgacttgtgtcgataagggttaggagaggatctaaaccaccggtttccttatcctaacaagaaacaaactaagagataaattcgttttttgtgtgatcggtacagaaaacagaatcctaaactaattgagataacccccgagcctcaccaatgtcgcctatataaagaaagagaaggaaggagacagacgaccaaactctctctctctctaatctcaaaccctaattaatcgcccgatcgatctaggcactggaaggggttcgtgaggcatctctgcaagaagaagaaagaagaacggcaatggcttctaactcaggtaagtagatcaattatttttccgcataagcaagaggtgattgtttatagactaaagcttaagatcatgtaattagaactccaacattgtggtatcagagcctaatttttagtccactcaatccctcataatcacatcatccctgtgattagaagccatccttataaaaatacaagattgattcggcatgagcaattttgaattagattggattaatttctttaagtattaagcccttttatactggtggtttcggccatcagtaggagaagcaaattattgaagaagctgtttaattcaagttttcgattttgattatccatcagtggagattaagagaagaaaagggattgggataaacatattgaaactcccaatt

SEQ ID NO: 55051 - DNA, 1501 bp, Oryza sativa
ctcctgccgccgaccgctgccgccacctcccacctctactgccgccaactcccaccactgccgctgccacctctcctctcgctgcccccgcctcccgccactgcggccgccacctccctcagccgccggggaggagaaggtgagagaggaggcgcaaaaaagagagagagttcgagagaggcgaagagacgcgcgcgcgtgagagagagagagagatacgagtcagttgactctgatggatggataagaatgtgggggctccccgtgtggctcgcctcggtgtcggtttttttaaaaaaaaccggcacctatttctttaaccacaaagatgccggttcttaggtgggccctacgcctactattccgatgggatggatactaaaaggtgccggattttcaataaaaaccggcatctttctctgacaccagtaataggtgccggttctttttaaaaactggcacctatttgaggataaaggtgctgattctttggattttggcgggttgatagacgcatggatagggaaaggagctataggtaccggttttacctactctagcatctgtaatagcggtatctatttgatgttttgtagtagtgatggtactgagcttcgtgtcaatgatccctgacccaccagcgatgagcggcagcagcggcctagcgctccaccctctcgaacgtctgccatgagagatggaactctcttacatggtacaggagtatcagtttgctgctttggactttggagtcttcagggcctgaaacatgttggaccaggttgttgttgtgctgttcgaaattggaatcatggctgatagataactgccccagggagcgagcgtcatgctgcatccttgttctatggttcccatgataccaccacggtgtggaggctcacacgggtcatgagaaattgagcaaacgagaaaagtaatgagtgaaaactggatgtgtggggaggaagttagaagaaaaattgagtagtggacttgtggggggtcctttgtacctaattgagttgaagagggggatgatgaaagtataagtgactcgtgcaaaaagaatagttccaaaatttcaaaatttcggtggaaaacgaaagtgaaaacattgcatgggagtggacccaaatggccacttccctgtagatacgaggacagcgatgtaatgttgtactttctcacatacacaatgaccgtatgtattaacaagtcattaagccccttttaaattttgacttgtcgaacattgccgaaagtaaatgaattttttgttgttcgagtgacaaagtagaccacgttatggcagtagcaatggctggacggtgcctaaaaaatattgtttgctctgtaatctcgatttagagtagtatatttttttttttgcgggggatttagagtagtagtatattattactcaaaatttcccccaacctttgacgcgacaagcaacatcaagaaatctcaccaaatggaaggcgaggagcagcagagggtg

SEQ ID NO: 55052 - DNA, 1501 bp, Oryza sativa
ttcaaccggacacgaatattaagaaaattgatgaaattacatataaaagattgagaaaaaaattaataaaaaaataaaataaaagaattggtattagttggaaatagaatgtaggtggaaaatttattatatcttagaatgaattctgaatgcaaaaattattactccattcgtctcataatatagcaatctaggcccttttagatcccccggtaaaatttttcaccctatcacatcgaatgtttggatacatgaatggaatattaaatataaacgaaaaaaataactaactatacggattgcgtgtaaattgcgagacgaatcttttaagcctaattgctccatgatctgacaatgtggtgctacagcaaacatttgctaatgatagattaattagggttaataaattcatctagcagtttacaggcggattctataatttgttttgttattagtctacgtttaatacttcaaatatgtgtccgtatatccgatgtgacacgccaaaactttacacccctggatctaaacacagccctaatattagatgggatacattttactactgaatctggacatgctcggatttgtctcattcaaagtttccgtgtccaactttaatcgtccgtcttatttaaaatttttttatgattagtatttttattgttattagatgataaaatatgaatagtactttatgcgtgacttatgttttttaattttttacaaaaaaaattaaataagacagacaattaaatttggaaaaaaaaacccacggttgtacttaaaatagggtggagggagtatattttaagatggagtgagtaatatgtaccaacctattctaaaatgattggaaaaggggaatacgacgtgtttgatgaaatctaggcattatgttgttcaacactatttactctttttttttgcagttctcattatgttgccctcccaaatatttttattttcacaatttggaataggttttgaattttgtaagatatttttagatttcatgtacaagggtaaattttttttttggaaaattttatctccccactcaaagagaatgtattaaaataatggttagagatttttaaaaaaataacaaaaaaggaaaaaaaaaaggtctaactactccctaaactttgattgaaaatccacctagcacattgaattttcaaaccagactttcaacccttaaactatataatattgtttatatagaaccctaaggtggttttgcagagtggcttttatctaatttacatatatattggatgagtttgattacgtgatatatgaattgcacatatatgttaaaatctctacataatcattcattttgactctattttttttgttgttctcacttacacaaatggatgttaatataatactaatattggagaaatagggaccagggtccccatcacgagttgttcaaggcatccctcacacctgtcctgagcatggaacatatgtgttggtatttgttaca

SEQ ID NO: 55053 - DNA, 1501 bp, Oryza sativa
  unsure (1)..(1501): unsure at all n locations
ataattcgtgagaatttgcagcacaaacaaatgtgatttcagatatgagaagaatcagcataccacaccatcgacatcaagtatggtcgtagtagaatcaatatgccttttcgctgcaatagagcatgctggaaacttttcatggaatgctctctcaaactcttgtacatgatactttatatagcggtcaactgtagtaatgtgcatcagtttatttggttcaacttttcctagtctctctatgtataccggncttccctgcctgtcaactccatggtaaccctgaggataatagacaaggacctcgtctagctcttcaaaattgaagtcctgcaatatttatttgtagacatcagttatcctttcaaaataaaccgatttgagcttggggataaaatacgtactactactcatcactctatagtctataccttaaagcactcctagtttaagatgccagatggaatctcctatttatgtaaacaaaacaatgtgtacatggaccaacatatttgaatatccttcaggaagtatctggcgaagttaaattttcaatttttatgtatcaattaatagcagcattagccgtttagcctcacctctagtattgtgtctgcgccgaattctttcctccactggagcatctcagcccacatttgaatggctttctcagtgtcaaatttcctagccttcaaaaacctatagagataatgaaggcatacaacttttagacacatattgcaaataaaactagaaagagcttcagcacaaaagaaaaaaagaaaggaagaaagaaagaaacaaacaactgcatgcttcagtagctctcaatctttcagcattgttccaacaccaacctcagcaacatgtggtaatcgttatgcttgtcaggcagcaagttcctgctaaaaagctcctgctggaaggaaaagacagcacgctcctcttcttcatccctgacatcttcgattgtgaatgagggccgattctccacctttctcttccccctcttcttgagtgaatgtgttagcttgtttgatgcattcagtgccttcttcttgagtgacccaatggatagccttctccgctcgtcctccgagttctccacatctgaccttcgatctttcctctcgtcaaacgagaacaggccctccatactctctgatcggcgccgaactttacacacaaagcacaatagcacccattagtaaactaatgagcaaccatttcatcagcaacccatcacaaatatataaataagataagaaaaaaaatgatacctgacattttgatggaaagagcaggagacctaatttgcaggctgtttgatacctttttcagagatcaaccacagagaatgcccaaagattatgttctcttcttatctattcagatgcacctggaatggagtagaaattgagaaaagtatcatgagaatatgccagctagactttcagagtgcaaaacacacttccactctctttgcaagggaagacttctt

SEQ ID NO: 55054 - DNA, 1501 bp, Oryza sativa
caagctatcgtagggtgctcaactttgtagctaacgaggaagggaaattactatgttacccgcttattaaataagggttaatttgatccgtgccattgccaatatgcctatttagataaatgccataacattcgtctattcgtaattgtgccactcaaattttacaaaattggaaccatgtcatcgtcgtcacgttttccatctcccccctcatctgcaaatgggactcacccatccgattcatctttctttcgccctcacttatcttcatccttccccatctctctatcacggcgaggagtgaacaacgcgggcaggacgggagggggtcggcgacgggcgtacattaagtaaacggtggttgaatggaacaattgtactttagagtcacttatattttgggaaaaattgactcggtttatggtataaataaagacatctatggtatacaagaaaaattgttatttaatttaaaatcaaataaaaataagaaatgctaaatattagaaaaagaaagatacatagtataaatgatatatagtttaatttgtagaaaccaactcaattgttgtgacaccatatactttctcataaattcaaaactacacagtttgatttaattttagtttagaattttttatgttgcgtgcgtaactataagaaaatcataactaacttcaaagtaatccctagcaaattggaatatagtcaaaaagtatttcaataaaaatcacccacaaataaattaacattggtaatgaaattttaaacagattaaataaaatacctacgtatgtgcgtgggctaccttcctagttagatggaataaagcaagccaattcaatctgattctctcatctctcattctctgctttctcaagctacccaagccagggccaccaatgtcacattcttatccaattcattcatacgccagggctcataacacctatacaccatttaataaggagacataatagtttttcttcttaaatcataatatgtactaaaaatatataattataattattttaggacggagctagttgaaatctgcgttgtactgtgtaatttaaaaaaaaaagaaatactcaatccgatcctaccaaacccaaaccaaacctgcttcttcagttcttctatcctcttgcaccttatgacaacaagagcatatattggtagtttatctaacccaaccaaatatttacccctatattatactctagcttgatacagtacttcttaccgtccttaattttccaaagccgaattattttgaataacccttgcatcctctacctaccataactgctaaacatagagttagccaatgcttatcgtatcattggttcttcctcgaaaaaaaaaaagttggcaacatcggagatggtatttttttcccctaatacagccaactgccggcctctcagcaactgccatttattatacaattatgtgatcggtgggctgaacacatggggatataagtgattatttgact

SEQ ID NO: 55055 - DNA, 1501 bp, Oryza sativa
tagaatataggaaaagagtgaggggaagctccaaaaggagtgccctagatgtcgaagttctctctaggggagttctagaggagtgccggggatgtcgacactatctatgctggagtcttgaaggagtaccggagttgtcggcactttctccgatcttgtatctcgacggatgcttcatttatataagtaagtatttgtgattcccttttgtatttacttttcttatttaagatagattctcattattacgggtttgtcacttagtatttataaagaagcaagttcttggctgagtctagagtagtaatcgataacgtaaacatggtgcctagattagatataaccttcgtttgttgtgtgctccatggaaagtgaggtgggcggcaggtggtgacagtcatgtccctcctttgtattccttcacgtttgggtacatcatagagttacagggtagactcaacttggcggaccaggggagagctagtgcccgaaataactaatagagttgtaccttgtaagggttacggataaggcatacatcctatccttagggttacgcattgtacaaatacatatactcgcaagtatacgagaaggttatgttaatcgtaagaaatttagccgaagtataaggaaaccgtccccttgagtagaaggtgttagagtcctattcagaggggatgcagactttggtatctcgtacatgtgaagtcctctccgagttgtacttggaggtcaaggcacttaggggtataagtacaagcccttcatggggtacgtgatcatcgaatcataatctcaccaccagccgtagcagaagcaatctggagggctcgaagacccagccgccgatcgatctcggcaagttgatctagatagcattactcaacggttttgttgttctctattgtaatctctgtgtttctcttcataatctcatataaactaaattaaggcttttaccttacaaggggcctgaactagtataatatttgtcacttgtcttcttgatgtcgtatcgtgtagatccttgctccgcgtaccccaataccctcaaaatacagtctacgggtatcactgtcgacataccttaacttaatattaacatagttaacccgcagtagttctctctattctaagcctctcgtttcattgttgtccttggatgaatcctattcttagactatacacatacgttctctatgattcggtacccttggaatactataaagtgaagggctatagcgcgcggtatttgtgtgcttgcagatttatatatgactgtaacaaataccaacacatatgttccatgctcaggacaggtgtgagggatgccttgaacaactcgtgatggggaccctggtccctatttctccaatattagtattatattaacatccatttgtgtaagtgagaacaacaaaaaaaatagagtcaaaatgaatgattatgtagagattttaacatatatgtgcaattcatatatcacgtaatcaaactc

SEQ ID NO: 55056 - DNA, 1501 bp, Oryza sativa
acttcatccatctccaatccgtgtacttttgtttataaccagactgagccacaaactaagccttatccactagacatgtggaagtacggtagtgctttgcaacagaggcccgagcttaatccttatagtactcgaggtacgactaacaaaacccaaccacgcacctcgagcccagcctaaaaccattttgggggttttgaatagagggggaggtgtgtgtccaattccaacataagccaaccattccatagtgtccaaaagatatgagaattcccaaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccgacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgggagagggggcgcgcggaccgggttaacgggaagtggggcccacgcgtcagcctctcggtccacggtggaccgggagcacgcggctggcggcggtcggcgccgtgggtcccacgcgtcagccgcacccgcgggcgcgggcggctgacggccgggcccacctggcagccgcggggcgcgcccgaaggcggcctcgccggcacggccgacgggagcggcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagtggagaaaggcggcggcgcggttcgggatgccgagggcgacggtgctccggcggtcggcgggcgaagcggagcggcggacggggtcgacggcgacgcggcgacgcggaaggaggtgacgccgagtcgggaggaggaccggagcgacgacggtggcgaaacggagctcggcggcgacggcggagagagaggtgcacgacgcgagcacgaatccgacggcgagagcgagcggcgagcggcggaaacggaagagcgaagcacgggggacga

SEQ ID NO: 55057 - DNA, 1501 bp, Oryza sativa
ctgcaggttctcctgccgcagccccaggatcttcatgttgttctcaaccatcccgcggcgcaccatctgatggaagtcgatacgagccgcgtcgtacgcctccaccatgcgtgccaggtgcacaacggtagcgtcatcctccgagctagcatctcggaaggtggcgtagtcgcgggctcctccgcgacgagggtagtagcggtagggcgagtgctgcaactcgtccgggtagcgctggtgaagggtgccgatggcgaggagagcggcgttctggcaagcggcggggaaggagtctccacccgcggtgactgccagcgaagtccgctcaggagagccagagaggatcactgcagtgacctcccaaccagcgtgaggctctgcatcctcaccctcctgatccggaagtggcctggcctggtagtccactccatgtggataccccaagaccacgcacatgcctcgcagctccaaaacgaagccagtcatatccaaaccacgacgggtgactgtgccggccatctacaaacaaaaacaaaaagagaaacaacatttaaaagatcagattttggcgataaatgaagcagcaagacagagagagactagacaattttcacaaataaccaaagatttttattttgaaaatatcgctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagaattattacatgggcagcgaaggcccaacacacaaagacaaacgaagaagcagcggaagactagggcgacgaccacaggcgcttgacggcaggcacgagctagacaccaaaaccttcatcttcaaggagctcctcttctggacttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacgcgatcctagaactaaacaatattattaatcaaggccgtgaacccacacgaacctgccttaacccaaggcctacgatgattcagaccgaactggcaagccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacgtctttctcacgtgtatccacgtgccacataccaccacggtatacagacggaagacgtgacatagtttccaacccatcctagc

SEQ ID NO: 55058 - DNA, 828 bp, Oryza sativa
acttttgtttatgactagactgagccacaaactaagccttacccactagacatgtgaaagtacggtagtgctttgcaacagaggcccgaagaccggtccttatatggccgaggtgctaccatcaaaaccatgcaccccgaacccagcctaaaaccatttttggggattttgaatggagggggcggtgtgaagccaattccacaatgatccaacaattccacagtgtccaggtgatatgaatatttcccaaagtctatagttgtaaaccacctaatgttacctaattaaattgcgaagcatctatctaaatttaaactagggatactacgagtagagtgtccactagttgaggttttgtttaatctagggtgaacaaggtaataataataacaataacaataataatatggtcacaacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaccgacggcttcgacttccacgaagagcggatcttccgaagctgcagcgtctacacgaccaacggaaaagaaaaggcttttactctaataaattccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaa

SEQ ID NO: 55059 - DNA, 1501 bp, Oryza sativa
ttttcccatgccagcaaagctcaaagagctcatctagaaatcaccgatgtgaaaatgtcaaaataataataataataataataataataatcttatcctcgatcccctttgtacgagtcgtcggtgcaatggattttcaccaccatcattgatttccaatcggacggctacggaagccaatcatgctcgctgcaccaccatcattgattataatcggacggctacggaagggctgcaaatacgtggctgcttctcgatcctagaatccaaacttagttctaattgtggtgccacgtggcccaataaaaaggtagggctgtaaccctgaaatggtatataagataaggagctatgaatgtcactactgcacacatgaaaacatgattattttgggttagtttagtttgtttccctaatggaaacttgataaaatatattatgcctaaattttggtgatgtatcgaatccaatacttcattaattctattatatactaaaagtattttaaacttcctatgaacgatcctacgttaacacgtagcacctaaaagcgttcttaaactgtcacgtggcactctaataaattagaaaaaatatgagaaaaaagaaaatatctcacttttgatttttcactaaataggtgtatccattatttggagccattagatttaagtttcaagaaatctctaatccatcccctcctctcataatggacacgtgcctgcctctggttctccgcacgcaactattgccctatcttcccttatttttttctctaagatagttaaggtacacaccataatcctttcaagcaacataattaaaaatacaccttattttacacccgctataacacactattagatatctaagcaacttaatttctctctaatgcatacattgtagaattgatcttgataattttataaataaacattttttaaaggattaccaatatcggttgtcaaataatattttaggtaattaaaagtcacctataattaaaaatttagacagatgcctacacatctgaactagaggggaagggtagcttgatgatacacataatacatttattaataaattcttataagatttcataagacgaaaaggtctataagcccgttttcagaaacatctgacttaattacaaatttgaaattaatttgctaggtatgtttaattttagaacaaacaaatacacattcccgtgcgttcgcgcgggttacattactagttttttttttaaaaaaagaagatagagctgtagaaagagaggttgggaaagttgagaagaacacaacctgagaagagatagagctgtaacacaacctgagtatcaaacagaccctataagcttccaaactggatgctccatggcctgaactctcgaaaccgtccagtacactttttacatccctaaaccggactggtttctcttacgtggctccctttacattacagcgtaatcaagcgtcattatactatctgtcccaagctg

SEQ ID NO: 55060 - DNA, 294 bp, Oryza sativa
gagaatctagtttgttttactgaattcaaattcattgacaagcagtgccaataaaaacctgtccatgaagcttacaagaacaaatgattggtccagttagggtaggttttgggttcaaaatgatccagtttgctcaccttgcttctataggctatagctaagataagcaagagagctacaaggttccattgcctcgcacatgaatgttcatgttcatgactgaacttttcacaatacatccctatctttaattactttgattttgtaggactttgcctttgcctcccaaggtca

SEQ ID NO: 55061 - DNA, 1264 bp, Oryza sativa
aagatactgatgcctattagtagtgacagcgatgtagccagccgtgaagaagatagcatcagttggcgttagaacaggccagccgtgcaggcggtgataccagtcagcggcggatgcggcggccggtcggtgaagacgtagacgcccaacaacggcagcataataggctagccgtgcaggcggaaacaccagtcgacggcgggcgaggcggccggtcggtgaagacgtagacgcccaacaacggcagcataataggctagccgtgcaggcggaaacaccagtcggcggcgggcgaggcggccggtcggtgaagacgtagacgcccaacaacggcggcataataggccagccgtgcaggcggaaacaccagtcggcggcgggcgaggcagccggtcggtgaagacgtagacgcccaacaacggcggcataataggccagccgtgcaggcggaaacaccagtcggcggcgggcaaggcaagccggtcggtgaagacgtagacgcccaacaacggcggcataataggccagccgtgcaggcggaaacaccattcggcggcggcgaaggcaagccggtcggtgaagacgtagacgcccaacaacggcggcataaaggccagccgtgcaggcggaagcaccagtcggcggcgggcgaggcggccggtcggtgatgttctgactgatccattcctggagcgtaagagataagcttaaagccatgaatcccttttatgcatatctggatctggatcctgcagaacaaacatataggatgagtagtatctgatataaatataatacttgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatccaacgagcccccgggtgctaggaatcggcccaaaggcaaccatccattggcaaaccaaacggaaagcataggaggatagaactccataactcgataggtacttttgtactcagattatgtcgcaagcaatcaagataaat

SEQ ID NO: 55062 - DNA, 1389 bp, Oryza sativa
tcggtgaaaatgtaaacgcccaacaatggcgggataataagtcagccgtgcaggcggaaacatcagttggcggcggcgaaggcaaaccgggttggtgaagacgtagacgcccaacaacggtggcataataggccagccgtacaggcggaaataccagtcggcggcggtcgaggcagccagtcggtgaagatgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacggattagaatttactactcaggtacttttgcaattattaagagcaaaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtc

SEQ ID NO: 55063 - DNA, 1501 bp, Oryza sativa
tatttttgccacctctggtgggcaatattctatttatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatatttttaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattgatacaatatcattgcttttcgccagtaagtgtgcatttttattgaccaatattatggcttaggctgattatatattgtggtcattttcaggcggttggtaaatcctttatgagtttatttactcggattttataccacatatgccatatatttccaggtgtggtggaaccatgtgtcttctagggacttaagcacatctgttaaagagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtaaaggtctcaggggctactgtggagattatgggtaccccatacccacacggcatggttatccgactagttataggggataacttatatgtatggaatatgtaacagatcatgacttgggtattacgtttcctt

SEQ ID NO: 55064 - DNA, 384 bp, Oryza sativa
atttaattgggtaattgatccatttaaatcaattaaatcaaataaattccaaggctcattatgctaggaattcatgtgtattcattcttttatgggatatcaatgggatgaagagttttgagaattaatccatttgattagggaattggtaacttatatcaattagtcctaattgatggatggttgatggttgtgtagtggaggatggttcatggctagttgatgacaattagttgctctattccttttcctattccatgagtcttactcttcatcttccattcctcttataaaatgagaatggatttgatctcccgcaagaatagtgagacacactttcatccatttcccaacgctgttgctgctacggtaatcccatcccga

SEQ ID NO: 55065 - DNA, 1501 bp, Oryza sativa
tcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagatgcgcagttgtgaaaataaaagcactagtcggcgacagcataaccagtcggcgacggaagacgatgatgttcatcagtagtgatagctgtataaaccagatgtagaggcgagggcactagtcagcagcagacgagacgaccggcgatgaagatggtaaggccaatcaacactggcagaatcatgcagccatggaagtgaagaaaccagtcggcaaccatggcaaacgtaggcagcttgtattgaagatactgatgcctattagtagtgacagcgatgtagccagccgtaaagaagatagcatcagttggcgttataacaggccagccgtgcaggcggtgacaccagtcagcggcggatgcggcggccggtcggtgaatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaaataaacagcagcggactagcgggcctacggctccatcttcacaggcgctcaactggggtataagccaggactccacctaagacttcttctccaaagcttctcttactgaaggggggagaaagattgagcaagaatgagtacaaccacagtactcagcaagccacaccggagatgcacaattaatgcaaaggagtacaaggggataataacataggggttatgttttgcagtaaacagcatttaaaagtcacttagttgcccaaagccattttgtaaggacgatcctagagctacacaatgttattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagc

SEQ ID NO: 55066 - DNA, 277 bp, Oryza sativa
ttgaccgttcgttttatttaaaaaaattatgaaaaaaattaaaagacaagtattaatcatgttttatcatctaacaacacatcttcttctatattgagttttttttggacggagagagtatgtcgtatatgtatgtacgactcttacatgcgcttgtacagtagacaaccgtacgttatactccgagcgagtacggcttagttgggcacatacgttggcgcatcatcttaacattatctttcccgccttagcgtaaaaaactttttttcttcgcagg

SEQ ID NO: 55067 - DNA, 316 bp, Oryza sativa
aatggttaggatgaagcctggtatatatctgaccgggaccaacgtgccatctccaggagctaacacgccggctccggctagggacgagtgcttggaggctctcatcctgatgggatggggcgggctgtgcgtcaaaccgcctgtcgccacctaacccacgatctgatcggtctgtgactggtcacagaccggataaacgagcgcgctgcattgcgttacatgcggcgtgacgcgctcgtccaaaccgcaataaatgtggttaggtgagccctgctatgctcacctaccccgtatacgcggcgcaaaacccacaagg

SEQ ID NO: 55068 - DNA, 760 bp, Oryza sativa
atagataaggaggccgcgagtgcgatccgttttcatcgcttcttttccggtgttggtttctccttctccgcctgagttgctctcgcttcctcgcttctgatctcttgcgcgcacgagagattggaaggagcagtgcctccgaaaccacaccttcgcctgagatctgcaccgggtaggcgggtgatcaggtttttggggagtgcctcccacacgactgctcatcgcgatgtctggagttgccgccgctgctggaggagatggcggaggtggtgcgccgccaacaggagccggagctagtgcgccaggaggaggtgccgtgaacgacaacaacaacggaggcaattctgcctcaccatccagcggagggccattctcggggtataatcttctcctcctgttcccattgttagcgctattcctgttccattattagcgctatcgctatactatgtgcgctatgttcttgttcctgttcttcatgatgcctctatgcgttactgttatgttcctgttcctgacattcatgatgcgcatagtatgctactggttatgttaagatcgccctacactgcttatgccatgattattgctttaacattttggattaaaatatgccgattaatgactatatttccaacaatccaaaaacttgataggtcattttcggtagttggctttgctgctgcactgaaaacacatgcttttgatggttcaaactataaaagatggaaagcacgtgcactattgtggttgacagcga

SEQ ID NO: 55069 - DNA, 1501 bp, Oryza sativa
gttcttcacgccagtgaggcgaaaattgttcaatcggttcaatcttcagagaatttctttatggaaaaatcacaacttccgattagtggatcaagtctctttctttgcggtttttcccctgcaaatttttatgtcaagttttgaggcggtagcagcagcagtcgttttcagcatagaaatatgcacattggaggtatcgaatattgtttaatttgtttggtagttttgctgaggatattcacccaagaacatagtcttcccggtcagaaaaaataatctgatatattagtggcagtcctcttctgaagtcatctcagctgaaatctagcctgtttttcttgcgggtattttgtcgctggagttttaatttagaagtttaaattaaagttaaggttgtttatatatatacgcttattgctcctcaccaattagtacagtgaattaacaagccttaatttctttattaatctgatatacattgggggtgaactgctaaactctggtcaaaggctgcttgcctgaccacacacttctttttttctgcaacttgtgacaggtcaagtagtgcatgttacacggtttcttccgagtggtgcaagaactagaccttgtttaggcttaacgtctgatttgtttttttttaacttagaaattaagctacactaaaatacctagtagtagcatgtttttggttttggtcggttgcacattgtggtgagacaggaagtgcataacacttttccattattagaaaaagattaggttgtttttggatgatttccttgattttgggggtgctaaatagtagtagtgctgtttgattacatttcgtcaaaattacttttttgacctgccttttgctgtgccatggccgatagccgtgcagggtttgtctgggctttatcagtgcacatatttttatggttctttaatctgtggttactctctgctagtggtttattacccagctgtaatcacctgttcatagcgtggagcgttttgttaatgcctatttaatggagtgattcattttactttcctgccatgtcttggtaactgcaagccagatgtagtagtatattaaaagtttcccctcctagttttgctggggaccaagaacattgtccagcttgtctaaataccaaaagaagtcttcccttgcaaagagagtggaagtgtgttttgcactctgaaagtctagctggcatattctcatgatacttttctcaatttctactccattccaggtgcatctgaatagataagaagagaacataatctttgggcattctctgtggttgatctctgaaaaaggtatcaaacagcctgcaaattaggtctcctgctctttccatcaaaatgtcaggtatcattttttttcttatcttatttatatatttgtgatgggttgctgatgaaatggttgctcattagtttactaatgggtgctattgtgctttgtgtgtaaagttcggcgccgatcagagagtatggagggcct

SEQ ID NO: 55070 - DNA, 943 bp, Oryza sativa
ggaaaaccaaatgatttcttttaagaagacataacaccggggtagcagtactcttttggtgttattgctaggtaattagtatgtgtatgctaaagacctcgcctccacggccctgagataataaaattaatattttgagccctgaactcgtgagttatattgcctgtgcttccatactgctgagttttgatctctgcaccgcatgagcatcacatattcacatacgtatgttcttccatcctgagaagtcatttttgtttgttagcatcttgtattgaattgtgtggattttttacctacattagccctgtggttttggttgagggcaccctatcgaagaagggtacctataccgttcacccactgtatacgaccgttctctctagtctttctgaaaaggttttgaaatcttgtgggctctgggctcccgtggaggagaaggctctcataatttccaccttgaaattttgatgagttcttgaggcgttcttgctaccaaccttgaaagagaagtgctacgactcaacttatttgcttatgtgataatgttttgtccagctgaattcttcgtgcttctcacctcattatatttttcttcgcgattgaaaagaaggttagtataatcaccacatagtaggcatctggaagaagcttcatgtttcttttgaataattggggtcaaagaattgagtatggtagtgttttgttggagctctagcttattcgacatgactgccgtactaatgaacggcctcttttagggcattaggagtgcgtcgcaaaaatataccgttcctcgtgtgataactcagctcaagaacaccaggaacattgttagctacatgctccatggtgcatatccctttgagtggatcctactagtctttttttatactctcactttttctctcctctctcactcctctatcccttctccaccagt

SEQ ID NO: 55071 - DNA, 472 bp, Oryza sativa
ccacctgtcggcgaccccgggagaggagggaggagcggcttggctgggcctcggcctgcggccagcccagcagggaggagggggaggaaaggagagaatgggccagcggcccattcgaaaaaagggaggaaaaagaaaaagaaaaaggaaaaaggattttccccagaattaaaatattgcttgctcaattttaattggttaaaattatttctagggctctgaaaattccactaaaaatcctgtcagtgaatttcgacatgtagaactcaagaaaaattccacatgccaattccgattattaattgcattgatttaaaagggtttactcttgctttgcaccggtattttcttagggtcatttataaattaaatttaggcttgggaggagaacttcggggtgtgacaccggaccgccgacgccattgcacacggcttggcgctgcccttcaggcacgcccccagccggccgaga

SEQ ID NO: 55072 - DNA, 1501 bp, Oryza sativa
aactaatatttagtttataatttcttatatactataaaatttttatcaacaaaattataaccatataaaagtaaatttaaatcacaatctaatgatatagtttttaacaaataaaattcatttcatattatactaagtgttggtcaaatgttttaaaggttgaatcttgaaatacgtgcacaccttatattatgggatggagggagtagttggtagctagtttgcttccctattataataaagtgatacaacctagagctatatataaagtgaactagagttattatctatcctgaggtccaaaccagtataaaaatccattctcccacctactttacctcaatctcatacaaccttagtatcaacgttttctatactatacagatatcatggtcgggaatagccccttgatatatattattctggggctgaaagttttttatgccaaaattttgtattaccaactaatttgtcttgtagctggtctgaatcaaactatgacgctggagaagtatggtttgctttcgccttctctggttaatctagttggctgaaagcactgtagcacatggttcagaattccaaccgcagaaaatgtcctgcaggtcttcaggggcagtcacagaagtcacaaaccatctgccgcctatagccaaatggttcgacaacatgcacgtagacgtacgcgtgaactacattcgaaaccaagatgagcactcgcagaaacgtgcccggatatttgaaaatataatcgaaaagatgattcatgcctttgctaggacagtaggaattttatcagattttcgacacaaggtaaatatgtatagctcacgcacttttaaatttagttgttgcaaagaaaagaagaccgagaaatcaatcagatttctgtagagaaaaatcaagtaaaatgtaaattagaccattgccacggcccatggcccattggtatcattgaatggaccacagtacaagttgctgatatttgagaaaaaaaaccctatataactatattgccttaaaaaataacacaacttagtgttccattggaagaacacaacaaaatttgaacttctgaattaatctagaggctgtttcttcgctttctatttttcatccttgatttctacgcccctcagagtagacatacaaatttatactattatctcattattgtatactccctccgtttcacaatgtaagttattctaacatttcctacatttatattaatgttaatgaatctagacatcattaacatcaatatgtctagatttattaacatcaatatgaatgtgagaaatgttagaataacttacattgtgaaacggatgaagtagttatttgtttgttacgtttaaataaacacagatattaaaaaacaaaaagtaggagggggtaaaacggaaaaaatgcaaatagggttaaagcagggttttggagctcgctgtcacgctcatcagtctaatcccacccatttcggctgcgctggctgccacca

SEQ ID NO: 55073 - DNA, 1501 bp, Oryza sativa
cgctccaatgaaatatcggacgtaacattatctcatcacatgcatgcttctatccgctgccttgtctccatgcaaagcactttactactcccttgctctatgtagagcactttaccaaatcatgcaccgatgcacgtatacatttttatatttaaataatctttttcttaaattacttctccaatttacaatccgattacactattaaacttgttgcaattaaatctttacaacaagatcacacatggctatattccgatgaaaaaatattttttattcttttaaatgtgtcaactagtactgtttcgctaatacatatgtaaatgttgcacatattgttttttcaatgttccaatttgtattttataatgtttcagatgtaataacttaatgttttataattacatgaaaatattttaataatatttcatatttgcaaatatattatatctttcatatgggtttttatgtcatttgtttttttatttttatgtctcactcattgagactcaatgtttcataccgtgattattggtgttacaattagtatttcttaaatgttgcatttctctgaaacactttatagactgagttagaacattttaccaagtttttttttgtctaactcattgagactcaatttatcataatttatcatacagtgattattggtgttgcagttagtattttctaaatgttgtatttctcagaaacatttttatagactaaattggaacatttgaccaagatttttatgtctcactcatggggactcaatgtttcatacattcattatcggtgttgcatttagtatttcttgaatgttgtatttgtctgaaatattttatagactgagttggaacatttgaccaagtggtgaaacatttttttacaagtggtgaaacaatgtttatttttttctcatcaaaatataaccatctgagatcttgttgtaaagatttaattgcaaggagtttaatggtgaaatcgaatcataaatcggataattaatttaaaaggaaatttaatttaaaaaaaataaaaagtaggttgagacaagtactgcatagtaactatgcagtcatgcatgcacaagcatataggcttcttacacgtgctaatcaactagagtataaacaacagtcatgcatgcacaagcatatagactttttacacgagctaatcaactagagtagaaataatagaacacatgtatatatgcatatgtatgcgcacgacagtgtagggtcgggcgtccgatatttacaaaatatcgaacgtccgacgcgtagcatcctccgacagacagacgtccatggggtccaacttcaaaggggtagcctaacgccgcatggccacgtccgaccgatcacgtccgattggtcatgtcacgcacagattctaatctgtcatgtctcgcggatgatggttaggcaaaaaaaaaaaaaataggatggcgccgaaacggatgaggcaggacgacggaccaaatcgacacgga

SEQ ID NO: 55074 - DNA, 1501 bp, Oryza sativa
ttatagtgtcactgcgacactacccaattgcatacatatgctcttctgtgagcttagcaaatagattagcaaaggaggataggagcggatggggactccgggcacccttctccttccccttccccggcccgaggccggagagctcgccccgcgccgtcggccgcccatcactgcgcctggctcagcagtgcctcctccgttctccctccctgctctctctctctctctctctctctctctctctctcgtgcccttagcttttgagctagcacccgtagcactaccgaacgcgcgtgtacgctgccccgagcccctccgccgcccggcatggcctcgccgccattgccgtccgctcccggaggccgctgctcgtcgccggccctccttggtactccttcgtcccatccggcgccggaaacggattccttgaaccccggagatgctcccacccctttgaatcgaacccccgttgctccggtgaagtttcccccttttctcgccgctggcgtgcgccgccgcgatccgtcgtcgctggcctccctccagcgaatccgatccggtggctcactccctctcatccgtcccatcgttctggtgtactccctctctctcgaatcgtcgcgacgagctccggtgaactcggccgccgtctgccgtccatctcggcctccccttcttcctcctcccaccgacccacgtggctgccacgtaggcgccacgtcggcgccacctcggctttgaccgggccaagccggtcagccaccccctccctccgtcttccttcccatgtgcacggtccacggagagcctaacggctgcgcgtgggcctgccacccttcggtccacccggtgcaccagaccgtgcgccactcctacccgaaccctagcgcgcgccgcatgcaccgctcccacggtgagccgcgccactgacaagcgggccctactcgggaccctgcaaggtggactcggcccaccggccctccatcttcctcactctccccgtgccccttgggccgcctcttcgggccggccggcccattagttcgaccgagctgcgcctctcctctcgggccgcgcccaagccgcccgaggaagtctaaatcacatccctccttcaatttctttccaaaaagggtttaataaactattaaatcctttttcctttgattagaaaatcaatatctctctatccgtaactccgattgactccgttcaacttccagcaattccgtaaaattgagatctatctaatggcactattaattagtctaaataggatcttttgggtcttgtgtaggtttttaattgtttgcgtatagttgcggttaccggattttcgtcgatcgtggatttctcgaagattcgtgaagctcagtgaagaccttgagcaaggcaagtcaccctttgatcaattgctcctataattggaaaatcattattactttgtttgcaacttgcattattagaatcacacacttaatttgcttggcctcggtttgcg

SEQ ID NO: 55075 - DNA, 1501 bp, Oryza sativa
aaccatacgattaaatacgttaatggctcggattactttctatcacaaatagaaagcaccggagtagggctcgttttattaatatctgtagaatagaatatgtatgggtgtgtcataggtttaacaccgcacagggcgcttcatgcgtagcgcctggcggcggcatcgcgcatgtgcctcagtgcttctacgcgcatgtctcagcccctcgcgagcaggggtcctttgtataggcagagaatatggcaaaagtgtgtgttaatcctctattacattcaggtagtcacacgttataattcctttggataaagagaaaatctattatatacgtctgaaatatagctaacctcttatatacctttgaattttgcttccttcattacatacccacaaaatttgattttgattccttctatattccttccgttagttgatcattaattgaccatcccattgctataaaatgactattttaccctttggatgaacataaaaatttatgaattacattattgaaaatgcaatactttgtcgcatgaaactattatagttatgagtttgctatgtgatgacaaaatttagttttagataatgaaataaaaaaaatatgtttttattttattttttaaaaaatcataaaaatgaggagcattcatacaaagatagaactaccaatgctcataatattttttttatgaatgctttgaaaaaaatccattgtcctattataatttcaaataaaatttttaatttattttattttttattttcaaaatttatgtcaaaattttctatactagttatttagtctcattagtttcataaaatacacatactgtgtatttaaataaaattttcaatcgtttttcaagcttatattcaaacgtaaatcatcgagagcataaaaaacatttcaaccaaacataacagaaatgaaggaaaatgtaacggcaaaagtatagaagggatgaaatttctgagatatagaagggatcagctaaatttttcgatcgtcacctccaactttcgtccatcatccgcatcagacctttcgtcctacagcgcgtgcatcaaccatcgctagcgagtccgtgtcgatttggtccgtcgtcctgcctcatccgtttcggcgccatcctattttttttttttttgcctaaccatcatccgcgagacatgacagattagaatctgtgcgtgacatgaccaatcggacgtgatcggtcggacgtggccatgcggcgttaggctacccctttgaagttggaccccatggacgtctgtctgtcggaggatgctacgcgtcggacgttcgatattttgtaaatatcggacgcccgaccctacactgtcgtgcgcatacatatgcatatatacatgtgttctattatttctactctagttgattagctcgtgtaaaaagtctatatgcttgtgcatgcatgactgttgtttatactctagttgattagcacgtgtaagaagcctatatgcttgtgca

SEQ ID NO: 55076 - DNA, 1501 bp, Oryza sativa
ttcaagtttctttatgttctttaattaatttatttaattgagatatattctcatcggtgcgggttcattgcttagtgtgcaattaagtgctctattactagaactctggataaagaaagaagttcctgcgcaaggttagagtagtaattaataacttaggcgtggtgtctaggttaaaaattaccttcgtctgttgtgtgctcaacggaaaatgaggtaagcggcatgtggtgatagccttgtccgtccttcatattcctccaccatcgggtacatcataaagctcaaggccaaactaatcctggcagaccaggggagggacggtgcccgaagcattcaatagagttgtacctttaacttaattaattaattaaaagatataggaatcctctctagccaatttatactaagttgttgtccttggatcgaatcttgatagttgattatacacacattgtaaggggaagtgctacaacggtattccatgccctggccatggcttcttcgagcctagtctagccatgttcctccccttgttgagcctccggcggctatcgtcgccgaccccccgagtccaccgctggttgccatttttctgacccagtcatctgaccaacattggtgatgcatgtggatgccttttccttttctctttatttctttgtttggattgtccgattggatttcaatcggatttatggacaaaaattttcatggacgatgaaagcaaattgaatcggactttcctttttttttgttttaattttttcatcgttattacggacgacagaaatgttttcactttttaagtagtagagatacactttgataccatattgttcaacccaaaagcttaagctgatgagaaaaggtggacaattcactttatattccaacactccctcatgcgatgtcacaccctgtagttctcctcccaagcctaaaatttaatttataaatgaccctaagaaaatgccggtgcaaatcaagagaaaaccctaagaaagtaatacaaataataatcgaatctggcatgtggaatttttagtggaattttcagagccctagaaataatttttagtcactaacaggatttttagtggaattttcagagccctagaaataattttaaccaattaaaattgagcaaacaatattttaattccagggaaaatccttttcttcctttttctttttctttttcccccttttcttttcgagtgggccgccggcccattctccttcctcctctcccctccgctgggccggccgaaggccaaggcccagctaggccggccgcctccctcctcctacccgggacgccgacaggtgggccccacctgtcgggcccatctcctacctcgcgcccgcgccgccgcgcccgcaaccgccgccgcgcccacgcctccgcctcctccgggccacgtcggtcacgcccgcgcatgcgccgcacctcccgcgcccactcccctctctctcccgcccgcgcccgcgcccgaga

SEQ ID NO: 55077 - DNA, 1501 bp, Oryza sativa
agtgaggttaaatatagttttgatgtggccaagtgtgacaaaatctttgattatcttttacaagaaaaacaaattatattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttctggtgaacacaattaatttcaatgataagaaggtgttgattcggccggagtaagccgaatctactaagggaaaaggagtggtcattggcgaaccaaggcctaagacgatagtgccaaagaagccggaggttggcatttggaaggagaataagagtggagcttcaacttctaaagcccctaggaagaccaaaatgacttttgatatgcttttggagaagtatgagaagcaaggtggtgagagggttcacaacaaaggaaaaagaccaagatcacctcctagggaacaatttggtcattcaccaagacggtcgcattcacctccatatcatcatccacaagacatgtcatggggttcttatccaatgcagccgccgggttatccttatccttattacatgccatggggggcaacgccgccaatgttcaatcatatgcctccaatgcaattcaaccaagggtggggaggatcaagaaggccaattcatgagcgtttgtcttcaccaaataatggccggttttatggcaggaaccgggccaatgaagaaaggagggaaggaaagcgcatcaaggtggaggcaaggacttcagaagtaattaccatcaaagtggggtctcatgatgtgccaataccttctggagatggaattggagtatcttcaaacaaaaaatccgaagccgaaaccagctcctcgcagtcggccggtctgaccaagccttctggccggtccgaccgcagccatgcggccggtctgaccgggccatcaggccggtctgaccgccgacccgacagcggtccgaccgacgcctcaggccagtctgaccgttcgccaagtgtcgatctgaccggcgcatctggtcggtctgaccggtggtctacggccggtctaaccgggctccagcgccggtttaacaggagaattgcaaagggcgatgtgagggcttcatcgttttcaaacaaaattattaggggacattatttacctcctggaacagagccgaatcctagatggatgcctaaggatttgacggctactcaaaagagaaggttgcaacgtcttcgggctcaagaaataagagagaaaaaggctgaagaacaaagagataaaagattcaatgagttgcgaccaccaccggtatggaggcataaatccatagagaaggaaaagccggttgatgtagaagagaaggagaaacaatcggttgataaaagtgaatcatctccaaaagaagaca

SEQ ID NO: 55078 - DNA, 1501 bp, Oryza sativa
ctcggattcgtccggattcatcccgcgaagttcgccggcgtcttcaatggcgcccgagatctccgcgcgcggtttcctctctccccggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgtcatcgtcatcccgaaccgcgccgccgcttccctccactccggccgccgttctcgtcgtcgtcgttgtcccggggtgagccgaagaccgccgttcgctttcccccttctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgttcctgctgttatgtggagtttagtagtgtaaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaa

SEQ ID NO: 55079 - DNA, 1501 bp, Oryza sativa
ttcacactgttcatgtgtagccatgtagatgaataattgggctgtttcccgtattaagaaaattattatgaccagtaaaaatcacatcaagtagtagctagctcttgctatagctacctatagcccccaccacaaagggagagaaaagagagatttctctgtagctctagcgctagttacacgttcgtatatgtgtgatgtgtgctgttcatgccattatattgatcgttttggatggaggagagctcacaggccggccgaccggttggtgctgatgattattggtacatgtctgctggctgatccatggcatcattttgtacccagttctgacataaaaattaacaccgttagtaattaattaaaggcgcaaatatatcgcgtattttttttaagataatggaagatgtgcgaatattttcatacatatgtaaatcacattcacggtgacacaacatgcagagtgtgtttggttgctggccacactttgccacaactaacgttaggcaagttgtgacagccacaaaagtatgatggacaaattgctagccacaaaatgtggcaaagtttgcaagaaaattaagtctatgacatgtgggacatgatattgaaaaagtgtggcaagccataactgtggtagtgaaccaaacacatgtctaacaaactgtggcagcaaaaaatgtgatgtggctatcaaattaaggagaatggtttatcttagtgtaacacgcaaagaatgtttttttaaaaaaaataaaaggacagtcggggattgttacattataggtatcactagaatatattaatagctccaatataagtttttagttacggagtatttggcgtggacaacatcggtctgtgcaacaaattattggttgcgcgtgattgccacacgctttattttcaatggcgactttggttgagatatttgtccacctatgcacaccctatcataccctattggcctttgtggaaggatgtgatgcatgagcacctatgcatggagtgactcgtgttatccctatttgtgctcctaatctgtacttctcctgtttttattattcatttaacaatatactccctccgtttcaaattcaaaatatttgaaaccgttgattttttagtacgtgtttgactattcgtcttattcaaaaaatttaagtaattatttattcttttcatatcatttgattcattgttaaatatacttttatgtacacatatagttttacatatttcacaaatttttttaataagacgaacggtcaaacatgtgctaaaaagtcaacggtgtcaaatattttgaaacggagagagtctatcgtattaagttagttaaccaaaaaacactccgatgtttcatgatcaattcaatccacacttttatccatccctaattatgtatggattcatgtgacacatgaccagttaaataggtccattacaaaacacaagcgtgttggtgtcctttaaatacccgttagatcgttccttgtga

SEQ ID NO: 55080 - DNA, 1501 bp, Oryza sativa
ttaataatatttataaaagtttttgaataaggcgaagatcaaacacgtttaaaaaagtcaacgacgggatggagagagtacatcatataatatatggtttcatctcttataggcatataacgtattgaaatccgtactgtagctggttatgggccctactgtagctgactatgggcctgttcggctacatgtgctatggctgcggcctgcggcgcagccagcaccaacagtgctgcacacacatggtgcagccgcaaccagcttgccgagcaagccctataaatatgtagcctaattttcttttctctcttcccttctctgattcacatatgcttacaattgatttgtactcgttattaaaaaactaaaaaaaaaagaaaaaaaaatctcggtggtgggcccacgtggcccacgggctggggttccagaatcgtggaggacgaggagggctcttctggaaatccctggacagctttgctgccgcggccggtggagttggtcgctcctgcccaaaaccaggaggattaggaggggtttacaggttaatttaatcgattcacacgcgattagaggatgggttaccgaggcacgccgactattgtggagccacaccgcgcgccctcgcgccgccacgtgctcctcccgggttgacgtggcacaagaggctcgtccgagtaggcacctcccaaaattttggtatgatcagtacagtttgaagtttgacttggccagtttagtcaattctagtatcctcttacggcaaaatactaggaaaccagacaattttctgaacgaccgtttgcaatttacagcaatccaacgacgacaggagagaaggcgatctgatgttttcgcaggggaaattatcaggaatattaattaccatgataagtacaatatgatcatgatagtgtccactgtagaatccatcggcgacactacaaaatctctgtcattaattacgagaatgctacggtatcgtcggctagtaatttgctgaaaacaatccattgatgcatgtataatcaccaaatggaaatggacccctggattactgatgctgtactttttcgtcagggaaagaaggaatctgatctgaagaagataattagcggataaaactttacttgcaggattaactcatgaaaggacgcgaattttactgtgtaattataaaaaaaaaattaccaccggaaggttcgccatagcccatacagcatcgaaaaggaaacggaaagatacaggggcattccatggctatcaaaggacagtaagagaaataaactgacaaaaaatataatttaatttataaaaggaatgagttgttgtggctcccacacaaaaacctctataaattgggcgcaaattagcctcccatctcttcagcaaagccccaggcttagcaaaacacaagcaaaccaaagcttccatctcttcttccagttcaaagatctccaagcctccaggaaactcaaggccagcctcgccatggcgcccaacc

SEQ ID NO: 55081 - DNA, 1065 bp, Oryza sativa
agttggcacaatgcatcttaaaaggtgtcacacagtaagcctttatatagctgccccgctgtctttttaatatagtcaaggtcctgtttgggtttatcaaccaattgattgaacacaatatcattgctttttgccacgtaagtgtgcatttttattgaccaatattatggcttaggttgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttcgaaatttctttattcacagcattcaagcttctttatagttgttttgctatgtgaactttcaaagatgttgtcaactttaggttgtacgcatcatattttgccaagcagtcggtatatcacttggatcatattattcagggattcacaccgcatatgctatatattggtatcaagtcacttggttgactataattatcaaaaaccactcggttaattggataatttattccttgactatatgtttagtttgttcagctaatcacatagtcgggggctacacctattaggtgcatctagtcgatgcatctgactttattttttcagccctccacagtcttcagacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagtaataggggataacatatatgtatggaatatgtaacagatcatgacttgggtattacgtttcccctgtatattatggaacgggcctaaaatcctggtttgataagattgtaaagtagatttaggaaatcggtaccttattggttaaggtttctattttgtaatcctgctcccaccctatataagggggcaggaaggcctttagggggca

SEQ ID NO: 55082 - DNA, 249 bp, Oryza sativa
aaataacaattaacaacagtgagttggggggccaatatatgcaagccaagctagatgatagtagatctaatgcactgatcacaagcatgctaaagcaaagcaaagcaatttgataaagcatatgcaggcattgggttggtcaggttgtgtgccaaagcgacagtttaacttgatctaactttgagacaatgagaactagagcaccaaagcctgcatgaaaaaaaaattaaagtgcactatgctccctca

SEQ ID NO: 55083 - DNA, 495 bp, Oryza sativa
tgggggcacaatcaatggatttgtttatgccagataaataattctgcaaatgatttggctcagtttaatgccgtcagctgttcgtgcaagcacaaccagaaccagttgcagtgtcaactggtctgcatcataatataaatggctctttgcagtacaccacgaactaaaatgatggctcaccatgaacattgaacatgtatacaatcactcaattagactgatggctcttccaaaaaaaaaaagactgatggcaaggtcaacattctgactatctgcttttttatgcgctacagatggagcaaccgcgtgaacgcccaaattggtgaagatgattgaccgcatcagttatatacttatgttagcagtgaatttttcagaagattcctttgcattttagaactaatacagtgcctggtggtggctaagagcgaggggcaaagaaaacctgggcacagattgctgccagattgtcctcagataccctttgtcaacaga

SEQ ID NO: 55084 - DNA, 1057 bp, Oryza sativa
tacgtagctcatcatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattatccccttgtactcctttgcattaattgtgcatccccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctttttctccttcccctaatgctatttgcaaaaggtttactcccttcttccttcttcggatttcaactagtactagatggtcagctttgcgaagaagaagatgtcgtcagttgtttgccgaagctccggaagactgcaggatccgctagcaaagtgtaggaagcagtgaagccagccgtgaagctgaagctaagatcttggagaacccgtcgcagaacctaagccaccctctagtgtttcgtttgtagtatgtttccttgcttgtgtgtgtagcgcatggtttgcatcggtgggtggtgatgtagccatgctaggttgtttgcttaatcaacttgcagaataagtgaaacaaacagcacatcagcaagaagaattagttcctttaaggtcttgtccctggttctggtctattctttccttgtatgcttcctctct

SEQ ID NO: 55085 - DNA, 552 bp, Oryza sativa
attttagaaacacatatgtaagcgaagataatatgcagtgctatattctttagtccgggttcttaaccctaactgggtttaaaaaaaatttgaaaataccggaaagatatctttagtcccggttgttctcatcaaccgggagtaaagatccgggggtatatatttttccggtgcgccctcgtcttctccaccaacacttcacgttttcggccgatcgatctctctcggcctctctccttcaccgccactacctagggcaaatccccgcgccgacgccaccgtatcttgccgtcgtctcgagctcgtcgttgtggagattatgggtaccccatacccacacggcatggttatccgactagttataggggataacttatatctatgtaatatgtaacagatcatgacttgggtgttacgtttccttgtatattacggaacggcctaaagtcctgatttaggaaacagataccgtattggttaaggtttctatcttgtaatcctgccccccatcctatataaggtgggcaggaggccctctagggggcatatata

SEQ ID NO: 55086 - DNA, 1501 bp, Oryza sativa
cgacggcgaggaggcgatcctggtcccgcgcgggaagctcgcgctgtcgaagaagctggtcgacaagatcctctccctggagcggagggagctgccccacgtcgccgacctcctcaaggacggcggcggcggcggcgacccgaacccgtcggaggcggagaagttgctcaggaagagcgtgcgggagatggacaggtacaacaagaagcgcgaggacaagctcgcggagtgccaggcgatcatacggcgcgtccgccatggcaagggcggctacgccgtcgtcgacaacaacctggagatgagagtcgccgtctccaaagctgagggtatctttctggatgacgccgagatgaccgatctaattattgatgagggatttaaccttgcctccaactgagcatgtagggtgacgttttatcacttagcttagtgatctactgttagtttacttaattaactgtcgactatctatctgtagctatcaaccacctatatgatgatgtccatgtatgcagctgagtaggcttggttgttgaataaccatatgtatccagataagccaatatttataggacgactgttttgtacacccaggtgtatgtactccctcttttttgttggatatccattagttgataatggatagttgagttagaaacaaaaaaaaggtaatgttcattttattttcaaaattctgcatatgcggctggtattcttttgtttttcttttcaattctttgcatgcatgcacaacggtccgtgaggaattaatggccatattcaaaatttaagatatattattttcttatttagttagtagatcgaagtatgtactcttttcaaaaactagtagtatatactaatttttcagtacatggtactaggagtatgtagagtgttttcaagtatccagtatatactcgatcggttaattaggtgtatgtactgtttttatcatgtatccagtatatactaactcactcggttaagaagtatgtactgttttttttagtattcagtatatactaaatcaatcggttaatgagtatgtactgttttttaaaagtatccagcatatactgaaaccctcattgaagcggtatatactatttaattgcagtatccatcgtcgatagaaggtatgtatgcatgtaccttttattagattattagcaaaataattgatgaagtacatactacttcaccgagtggtacttattaaataattaagaaaatagtatatatgtatatcacttggtttcaccgaatggtatatataccgaaccataaaatgaagtatacttgatgaaattgatgtatacatattgccccgaaaaaaaagatagtatatatatattcaaaacaaaagcagtatgttatgatactacttttatcatcgatggaaaaggagtatagttgtttgaaaaaaaagtggaaaaagtagtatctatcccagaaaatagtgcatcgtcggcttcgtcgccatcagcatggcgtggca

SEQ ID NO: 55087 - DNA, 1501 bp, Oryza sativa
ttgttgttgctgttgcctacgttggtgttgttgttctcgcctcctccagtaccgctgccgacatgtccaccgttgacgcctcccccagtcaacatgttgatgaagatgaagtagacattgatgaatagtgagtagtcgcgccttgcactccccaaaaacctgatcgcccacctgtccgtgcaaacgtcgtacctgtccgtgcaaacgtcatagcagtgtgtggtttcgaaggcttactctcctaatacgtgtgcacacactcgtcaggatgggattaccgtagcagcaacaacattggaagtggatgaaacgtgtgtgtctcttctcccattctcattttataggagaaatgaaagatgaagagtaaaagagtcatggaataggaagatgaatagagtaactaattgtcatcaactatcctccactacacaaccatcaaccaaccatcaattaggagtaattgatattggttaccaattcattaatcaaatggattaattctcaaaacttttcatcccattgatatcccataagagaatgaatacacataaatttctagcatagtgagccttggaatttatttgatttaattggatcaattacccaattaaatctaacacatattaggcaactatgatcagatgcaaccatggaacatgtagattgaataaaaataatatcactatcatatattgttaggactttggtactccaaatgaatactgcaaacacaaatccagcattactgaatgactaaatatccagtgtttttcaggcagtttgataacaatggttgatacacaaatcaacacagtggttgatacacaaatcagtgcaaaagcctattgcatataaatttgtcgctagcaagccagacccttgagcgaacaaagatgttctgaccaaattcttatcattcaccaaattttgataatgcaacttggcaagaatgtattgaaagcaatgagatactctggtaacccataaaaaagatgctcgcatagtgaaccacactgtaaattaaatgaaaatcctgtataaccgagcaattgacgatatttatttactagttgatccataaacaactcctacaacatagatgagaatttctctctatagtctaatcggccatgattttacatacattccttatgttttcattcttcatgcttgtgactcacctgctgtcggtgaaatggaaaccagggtacccatttatctggcaaaaggatcattatcaaataaatagcatgctcagaatatctttaaaaataaaaaggtaaccctagagtgacgtagctaggggcccactctggtgggtcccgggcccacctaagttttcatatatgggattctccctagctgaggaggaatactgcgtgtatgactcaaatctctgagcataaaagtagcttgggacctggcttgggtcccaagcataccccaaatgcgtcttaagaatatagcctatggtctgcctcggacctggccctgtcctagg

SEQ ID NO: 55088 - DNA, 1501 bp, Oryza sativa
gatggcgcgcgcgcgcgaacgcgttgccggcgacggcgcaaaggcgacgcgaaggcggcggcgctaagcggcggctaggaaggagagggaggggaatagaggggagaggaagcctcaccgagggtggccggcgcggaggaagacgacggcgaacggcgacggcaagccacgggaggacgacggcaaccggcggacgggcttcggggtgccctaaggaaggaggagagagagattagagagagggagatgaaccacggcggccggcatccacggccgaaggcggcggtagaggtagaactcaccggagcgcgaggggatgcgaattccggcgatgaatcccgacggaggaagggcggacggggtggagttcgtccttgcgaacccgacggcggcgacggcgcggtgcggcggcgagcctagcggcggctagcggcggccggagcggcgggaaaggcggtggcgggtgggtgcacggcgtgggagcgatggggagcacgagggagttcggcgaaatggggaaaaagagagagggggcgacggcggagcttaaataggagaggggagtctcgaacgtggccggtaggggcgagattccgccggccaacgtgggggagtgggagaggagagagagaggcaggattcgaaaatcgaatcccggccatctcgggcgcgggcgcgggcgggagagagaggggagtgggcgcgggaggtgcggcgcatgcgcgggcgtgaccgacgtggcccggaggaggcggaggcgtgggcgcggcggcggttgcgggcgcggcggcgcgggcgcgaggtaggagatgggcccgacaggtggggcccacctgtcggcgtcccgggtaggaggagggaggcggccggcctagctgggccttggccttcggccggcccagcggaggggagaggaggaaggagaatgggccggcggcccactcgaaaagaaaagggggaaaaagaaaaagaaaaaggaagaaaaggattttccctggaattaaaatattgtttgctcaattttaattggttaaaattatttctagggctctgaaaattccactaaaaatcctgttagtgactaaaaattatttctagggctctgaaaattccactaaaaattccacatgccagattcgattattatttgtattactttcttagggttttctcttgatttgcaccggcattttcttagggtcatttataaattaaattttaggcttgggaggagaactacagggtgtgacatcgcatgagggagtgttggaatataaagtgaattgtccaccttttctcatcagcttaagcttttgggttgaacaatatggtatcaaagtgtatctctactacttaaaaagtgaaaacatttctgtcgtccgtaataacgatgaaaaaattaaaacaaaaaaaaaggaaagtccgattcaatttgctttcatcgtccatgaaaatttttgtccataaatccgattgaaatccaatcggacaatccaaacaa

SEQ ID NO: 55089 - DNA, 1501 bp, Oryza sativa
gcaatgaattacattcttaccatcaagaataaatttttgcgtcaccctgagaagttccatgcattcatacacaccatgattgatttctccaggggcaggtgagtaataggcattaacatagggtggttgcttacaaaatcatgactggatagattggagcaagaaattctcatgtgttactagttgtatgtggataacaagttttattgaaactttggttatgcaggattaacactcatactgttattgaacgtgtgaagatcctttttgatgggtatcctgatctactccttgcattcaacaagttcttgccaagaggcataaatgcaatatgatgaagaattttgtctaaatatgtttcctcgtttaaggctcaagctcactagctataataaatctttgataactttatgagttggtttactcatctattttaattgaataatttagcaatgctacatttgttcttatcgtacttgtctaagtacctaagtgccgactatattttggagtgctgttattcttattttatctatgccatctatttggtggagatagagattctaagtagctagtgagtatccatttggtgaaaaatctagagaagctaaggcatcatttgatgagattctctaattggctacttcctcggttatcgtgaacacactaactaaactactacgatgatttttttccaaacattttctgtatagaagtttattttaaaaaaataaaacaatttgtcatgtttacaatagttggtacttaattaatcatgttctagttatctatcgtgttttccatgccgtagagtagctcagatagacaacctatttgagtgctgcctatgttatccagcctctgctactattttattttctcgattctataaacactaagtctgaactatttagggagctcgagatttcgggagtagctatagctacaggaagctcccaaacttgtccttgctctcttactaatatttgtctcacgttgcatttaacgctcgcatggtttgtttgttcaatgtaggagctatcaccattgatcatgtttgtaccacactagtcgtacttaattacttgatttttttctctcctaactgtttttttgactttctaatggtcttgaatcgattcttgttgctttggcaccctaatgtgttgtccatagcaatactactattccggatgaactatgttgtaatgaaatagaaccatggaaaattggcagaccatgttgttctgttaaatgctgtagacagattgccatcacttgaccaatgttgcatcgaaagtgttgaagatgctaggttgtgtaaaaaatagtacatatattttaactatttgccactcttacaagtggcaattaaggattcgccattagactgacatcatagatacatgaggtgtgcaaatgtgatgacatgagcttttttttttttgctgctaccattgcaccttatctaataaggtaaatttgaaatatgatggtgttt

SEQ ID NO: 55090 - DNA, 1501 bp, Oryza sativa; identical to SEQ ID NO: 55020

SEQ ID NO: 55091 - DNA, 1501 bp, Oryza sativa
taaggaccaaggtgagctcggggcccgaaacaaggccgggcctgaggcaaacctcagtttacacctttatgctttgtatgtcttggcactcatcatcctcgagtagtgcgtgactcatgcgaactaaggtgagcccggggcccaagagtaggccgggcccgaagcataccttagcttgttctcttaagatataaatcttgcagatttctacgccccttttgccgaggaccgtagaacctacaaggactaaggtgagactgggacctaggacagggccaggtccgaggcagaccataggctatattcttaagacgcatttggggtatgcttgggacccaagccaggtcccaagctacttttatgctcagagatttgagtcatacacgcagtattcctcctcagctagggagaatcccatatatgaaaacttaggtgggcccgggacccaccagagtgggcccctagctacgtcactctagggttacctttttatttttaaagatattctgagcatgctatttatttgataatgatccttttgccagataaatgggtaccctggtttccatttcaccgacagcaggtgagtcacaagcatgaagaatgaaaacataaggaatgtatgtaaaatcatggccgattagactatagagagaaattctcatctatgttgtaggagttgtttatggatcaactagtaaataaatatcgtcaattgctcggttatacaggattttcatttaatttacagtgtggttcactatgcgagcatcttttttatgggttaccagagtatctcattgctttcaatacattcttgccaagttgcattatcaaaatttggtgaatgataagaatttggtcagaacatctttgttcgctcaagggtctggcttgctagcgacaaatttatatgcaataggcttttgcactgatttgtgtatcaaccactgtgttgatttgtgtatcaaccattgttatcaaactgcctgaaaaacactggatatttagtcattcagtaatgctggatttgtgtttgcagtattcatttggagtaccaaagtcctaacaatatatgatagtgatattatttttattcaatctacatgttccatggttgcatctgatcatagttgcctaatatgtgttagatttaattgggtaattgatccaattaaatcaaataaattccaaggctcactatgctagaaatttatgtgtattcattctcttatgggatatcaatgggatgaaaagttttgagaattaatccatttgattaatgaattggtaaccaatatcaattactcctaattgatggttggttgatggttgtgtagtggaggatagttgatgacaattagttactctattcatcttcctattccatgactcttttactcttcatctttcatttctcctataaaatgagaatgggagaagagacacacacgtttcatccacttccaatgttgttgctgctacggtaatcccatcctga

SEQ ID NO: 55092 - DNA, 1501 bp, Oryza sativa
gatggcgcgcgcgcgcgaacgcgttgccggcgacggcgcaaaggcgacgcgaaggcggcggcgctaagcggcggctaggaaggagagggaggggaatagaggggagaggaagcctcaccgagggtggccggcgcggaggaagacgacggcgaacggcgacggcaagccacgggaggacgacggcaaccggcggacgggcttcggggtgccctaaggaaggaggagagagagattagagagagggagatgaaccacggcggccggcatccacggccgaaggcggcggtagaggtagaactcaccggagcgcgaggggatgcgaattccggcgatgaatcccgacggaggaagggcggacggggtggagttcgtccttgcgaacccgacggcggcgacggcgcggtgcggcggcgagcctagcggcggctagcggcggccggagcggcgggaaaggcggtggcgggtgggtgcacggcgtgggagcgatggggagcacgagggagttcggcgaaatggggaaaaagagagagggggcgacggcggagcttaaataggagaggggagtctcgaacgtggccggtaggggcgagattccgccggccaacgtgggggagtgggagaggagagagagaggcaggattcgaaaatcgaatcccggccatctcgggcgcgggcgcgggcgggagagagaggggagtgggcgcggaaggtgcggcgcatgcgcgggcgtgaccgacgtggcccggaggaggcggaggcgtgggcgcggcggcggttgcgggcgcggcggcgcgggcgcgaggtaggagatgggcccgacaggtggggcccacctgtcggcgtcccgggtaggaggagggaggcggccggcctagctgggccttggccttcggccggcccagcggaggggagaggaggaaggagaatgggccggcggcccactcgaaaagaaaagggggaaaaagaaaaagaaaaaggaagaaaaggattttccctggaattaaaatattgtttgctcaattttaattggttaaaattatttctagggctctgaaaattccactaaaaatcctgttagtgactaaaaattatttctagggctctgaaaattccactaaaaattccacatgccagattcgattattatttgtattactttcttagggttttctcttgatttgcaccggcattttcttagggtcatttataaattaaattttaggcttgggaggagaactacagggtgtgacatcgcatgagggagtgttggaatataaagtgaattgtccaccttttctcatcagcttaagcttttgggttgaacaatatggtatcaaagtgtatctctactacttaaaaagtgaaaacatttctgtcgtccgtaataacgatgaaaaaattaaaacaaaaaaaaaggaaagtccgattcaatttgctttcatcgtccatgaaaatttttgtccataaatccgattgaaatccaatcggacaatccaaacaa

SEQ ID NO: 55093 - DNA, 1501 bp, Oryza sativa
agctcaatgaggtctatgtgtgacttaccttaagacccatttaaacattatacactgctcatgtccttataagtatataaacgagacgaggaatataagaggctatttgaattggatgtgactaggtagagcacggcagtgcgttagtcctaatcggaaaccattctatccaatatataaatcctcctttagcctatggtacatatctttttttaacctttttaatgacttatatattttaaatcacatattatttttaagatttatttacatcattgtactctactcaaaatatgtgacaaaatgagatccatgttgaatatattctaacattttattaatttaaaaataatttatttgaattgtaaaagttacttagctatgcaatagaagcaactctctataacattagaagaaattacattctgattgagttgaagtaagaaactatgtggagtaaatccacaagcaaagtgtagagaagattttcaagtaaatacatttataaaagtaaaaccaataaagtttgaaagtaatttgcataaatcataaaagtaacttaacttaaaatggaagtaagtcgttacaacattagaagtaaattcgttatagggataaaaacatgagtctatctagaaattaagtttaaccaacataaaatataaaattggctaaaaacagtaataaaagtaatcagctcaaagaattatgaatgtataagaagtaatttaatcaaatccaaaagtaatttatatatatgataaaagtaacttacatatataataaaagtaatttacaaatataaatatttttatcataaaaatattcatgtaagatcttgttacaaagatttaattataacgaacacaatggtacaatcagattatggatcagataagtaatttaagaaaacttttataagaaggaaaaaaagatatgtatgacataataacaaagaagatatgcatgtctatagatgtatagtagtacttatctgatgtatgtgacatcttctatctctacttattataaaaattgaagatgttttagccaatactttggtacgtcatccgtgtataagtcagtttttaaccgtattggaaaatacatttcattttcttttggaaatgcagatccgtatttgagtcggatttcaagttgttcacttttagaaatacataaggtcgtataagaaatctttcaaaacaacttgtatgctaacttacatgatttcctaaaaaatatatatatccaagcgaattctgatagtgtatttcacagtaaataataataagattaaaataacttttacccgttataatgcatggatattttttctagttaagactaaatagagaggcatttcgatttagattttaccatttgaattggagcacaggagtataaaccacacgctttcccttcttgcacgacaagcacatgtcaacgaagaggaaacgaaacggacacaactacccttgccttcattgccagaacacgt

SEQ ID NO: 55094 - DNA, 1501 bp, Oryza sativa
atctgcgtatgaatgagctacaagtttcagctgacttctcccccgttctaagctcataatctgggaaagaatcaacccccctctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcgttcttgtccaccgcgtgtaatcttggcaacgtgcatgtttgcccttcttcacacaacatcttgcctgtaatggttaagatgaagcctggcatatatcgaccgggtctaacgtgtcatctctaagagataacacgcttaacgccggcttgagacgagtgactagaggctttcgtcttgacgggatggggcatggcgtgtgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgcctttgttcctcttgccttcgctgcctgagctctaactctttctctaccacgccctactttcgccacacgcgctcgttcccaatcatctcttcctccaccgcca

SEQ ID NO: 55095 - DNA, 1501 bp, Oryza sativa
aatggagtcatggattggctttcctggtgctaacatattttcatcagttcctcatctctttgcagctgttgtacaattggtggcgctgtacatgggaaaaaagggtaagaaatctgtttacccggttttttgtctgacctcttacttgtagaggcagtatcagatgttgcaatgattttgacaactatttattgggaagggaaaaatccttctcattgatacatctgcatgttgctcgcccacatggtgattcatcaccctagtgcagttctgcatataatcaaacttgtaactgcatgctttgttgttgcacagtggtagttaatgagaaaatgttgtctgtttctctaaattgctattatctcgtttgctctttttaatggactgtcataatcataacttgtgagctcatggggttatagaaagagtgcatctgatgtgtagaaaacaacggaaactaaaaggggtaaaaaaggtcaaagatgtataaatctttccaggaagtttgaatgatcaggaatatatcacaaatttcgggagtaaatttcaaaatgtgtaacccatacacgagataattgtgacccacccatatggacttatttatggaggttacatgccccgctcgttttttccccataaaaacactctgcactcggagtaatcaacggtcaacagtaagatatgattttatcgaggaaatagagtagagttgaagtgcccactttgttatattatgggcatgtttggtacagctcaactcctaagtttagctctaggagttaggtctggagtggagttgtggagctgtctaagcccagctccacaactctagttcattttgtgagagaactccacccagctccacttctagttttggtggagctgaaactgtttagctgagctccagctccactcccggtggagctggagctggagctgtgccaaacaggccctataactcactttaatcttgtccaagattaaatttatagaaaaacattgcaatatttttaacataaaataaagatactataaaaacatattcaatgataataaatttaatgaaacaaattgggtgttgtggaatagtacatttttctaaaaaaaagtttgactgagggcaaagtcactttaactttgcgtcaatcctactcatgtttgattaagtttatataaaaaattaataacatttttaacataaaataaaaaaacatacttgatgacaaatttaatgaaactaatttgatgttgtgcatattagtacatttttctacaaatttgtttaacttaggataaactcagtaatataaaatagagggaatagaaaaaaaaaagctctccagcagcaattagcatgcactttgctccattattcttatacttgtataacatatgattagagtgtgatggtcttatcgtaatcatgattgataaatactggtattgcacatggaatctgcactattcataatagaacaatatcttagtgttcaaagaagta

SEQ ID NO: 55096 - DNA, 1501 bp, Oryza sativa
gtggtaaaatttaatatgtcagaccgtatcatcgtgcaaaagatcttatatttcttacacgagggaataacttcgcatagattgtgcagaataaacacattaataaatatttagctatcacaatgagtgtctagtagacgttacataggccaccgtccatgtttagcaatatgagtaaactgcaaatggtaagattagataagactatccaccatacttcatttcaataatatataacaaaactgtacatatgtttaggataagccttatatttggatactattaatcattggattacttttgcctatttatttcagttgtgctgtctatataaccatcgtaaaacaaagaagaagcacaagccacagcttcatacaaagcaatcacacaaatgggcaagcagatgccgaactgtagccgtggacttctgcttctgttgttggcccttctaggctgttttagcattcctggccacgtgtatggtaatctactatctaatattgaatctcaatggtgaatccaaggtttattttgatttcacaattattcaattcttctgtggtaatcacgatgtattaaagaaacatatctttcagagtaaaatttgtgattccaattttcttctggacatccatcttcacatatccatgtattgcatatggtttttctgtatctttcatgctttcctagtaaaatattttttatttttcaggtaaaaatctggattacaccaggagtgcatccatgaatgaaggacgcaacaatgtcaatataaatggtttggtacccgtaccaggcaacattttctccccatcgaaggtctgctgtagaaatgtatgctaccctagcttgcaagcctgtgaggcaaattgcaaaccaattgcttgatcggcttatcaagcctgtaatactaaagaaatgataataatattgtccgttgttcaccaatcaagagaatgatcaatctcctcatagatgaacatggtttgtccttttgtttaggggaaaagactgtcttattgatacataactggagatggccacaggagaatcacgagaataagcgcaagaaatagtatcgtgtagtcaatatggcatgtatgcaggtttgatcgtagtactcgtttacagaaaaaagtaggcactctttttgcaagtgcggtccgctagattaattttatttttgaggctaaatcgtatataccattgcatgtcaccaaacgaagccttgaatcaatgggcatccttttcaacttgggtcaatgtggcaggccaaattgggaccttctgtagtgtataatcattttttactatgtgcatctccttcgttttttctccttcgttcttaagcacaataatattatcacaagcaatctttcccgcgtgaattatcacaggatttatttagttgtactcctttcaagaaatcctgatattgtaaccttaagaacgaaactgcctgataatgaagtgaacaggcacgagctcttgtgattgttcc

SEQ ID NO: 55097 - DNA, 375 bp, Oryza sativa
agatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgtcgaagctccagaagactgttggatccgtcagcgcagcaaaggaagcagtgaagccaga

SEQ ID NO: 55098 - DNA, 231 bp, Oryza sativa
gagccgtcttcccttctgtttttgtttgctgtatctgagggagaagatgtgatggtagattgtgtgagaattaggggtttctctctaagggtaggttctagatttgcaggatgagttgggcgtaaatctcaagtgtgaggtttttggtggcgaaatttcaactatagatctataaattttggatggggttcctcgagaggtttttggcctgtatatagctagctctagcga

SEQ ID NO: 55099 - DNA, 1501 bp, Oryza sativa
ggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagtatgttacatgcgtcatcctttaaagggtgtcgaaggcatattttttggcctaggcctaatatgtctacagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggttgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttcgaaatttctttattcacagcattcaagcttctttatagttgttttgctatgtgaactttcaaagatgttgtcaactttaggttgtacgcatcatattttgccaagcagtcggtatatcacttggatcatattattcagggattcacaccgcatatgctatatattggtatcaagtcacttggttgactataattatcaaaaaccactcggttaattggataatttattccttgactatatgtttagtttgttcagctaatcacatagttgggggctacacctattaggtgcatctattcgatgcacctgactttatttttcagccctccacagtcttcagatttggtaaaagtactcgagagaccatggcgaagatgattgaagcactcggctttagagtaatctagttcgagagaacattatattttcgactgtgaaggtctcaggggctactgtggagattatgggtaccccatacccacacggcatggttatccgactagtaataggggataacatatatgtatggaatatgtaacagatcatgacttgggtattacgtttccctgtatattatggaacgacctaaaatcctggtttgataagattgtaaagtagatttaggaaatcggtaccttattggttaaggtttctatcttgtaatcctgctcccaccctatataaggtgggcaggaggccctctagggggca

SEQ ID NO: 55100 - DNA, 1501 bp, Oryza sativa
tataaatattggcttatctggatacatatggttattcaacaaccaagcctactcagctgcatacatggacatcatcatataggtggttgatagctacagatagatagtcgacagttaattaagtaaactaacagtagatcactaagctaagtgataaaacgtcaccctacatgctcagttggaggcaaggttaaatccctcatcaataattagatcggtcatctcggcgtcatccagaaagataccctcagctttggagacggcgactctcatctccaggttgttgtcgacgacggcgtagccgcccttgccatggcggacgcgccgtatgatcgcctggcactccgcgagcttgtcctcgcgcttcttgttgtacctgtccatctcccgcacgctcttcctgagcaacttctccgcctccgacgggttcgggtcgccgccgccgccgccgtccttgaggaggtcggcgacgtggggcagctccctccgctccagggagaggatcttgtcgaccagcttcttcgacagcgcgagcttcccgcgcgggaccaggatcgcctcctcgccgtcgaccggcaccagcgtaccgccgcttcgctttgagcctctcgccgccatagctttgtcggcggcgaactgctccacgcaatgggcggcggtgcagggcatcaacgcgatcttctcgccggcatcctccgccgccgccgccgccagcgcgacgacgcaacgcttgaggtaagcccgcctgtcggccatcggtggatggatgatttcgcgggaaatctcgatgattttgcagctaaaaattggggaattcgaaaccctaacgattcgaggatgtgtggggggaagacgaagggtgtggtttatcaaggcggaggcggatcctggccgtccgtttccaaagccgaatccttctttctctgctagtttcatcgcggccgtccgtctccgaagtcgaatccctcctcggaacgggccagatgaggcagcccctacgtgagattatgtgggctgcaaactgggccaggcccaataggggaaccagcaacgaaaagcgaaggaactcgtcacagtcgtctcttctactactactactattttggagaagttgggatggttttcccaaattttcttttgctttttcgatctaaactatcgatgtgtttatttgaactagcaaaatacatgtatgttgttacggaattaaaaatgacatcagcatgatgtagagatgaaatctattttaaattttagagcttaattttacaattaattagaggtttttgctcaccaaaatttccctcaatttattgttaacttgcaaggatgatcatggttgaaagctccagggtctacccgtgactttcattgttctaccatacattttagtttggacgagggatggacggtgggcctacatgtcagaattttggaagttggtggtgggtggtgccatggtggcagattcaacactcgctaccaccactaccttttaaaa

SEQ ID NO: 55101 - DNA, 1501 bp, Oryza sativa
atcgatgtgtttatttgaactagcaaaatacatgtatgttgttacggaattaaaaatgacatcagcatgatgtagagatgaaatctattttaaattttagagcttaattttacaattaattagaggtttttgctcaccaaaatttccctcaatttattgttaacttgcaaggatgatcatggttgaaagctccagggtctacccgtgactttcattgttctaccatacattttagtttggacgagggatggacggtgggcctacatgtcagaattttggaagttggtggtgggtggtgccatggtggcagattcaacactcgctaccaccactaccttttaaaaatgataatagattttgatgcttgaatgggcaacagcagaagcagcagcgggcacatattggggagattcagaaaatgcacctgcgcgatctgatgcatgatgttgagcgctgcaaagcaatgacagtgtaagggttgaattttctctgctgttgcattgcatgtgttggtttctgctttcgtttctcatgttcttgttggttgacagggagtatgaaggcatacatgtggattgctcgaggcaagatgacctcactctacctgcccctgcagcaagccgttgattgaatcactgatgtacaagctgccagatccatgagggaagatgaacagcggagggatggaggaggaagacaatgggcagtttggtccaaaattttagaaagtgtgttgaaagagtaagtacactggtggagaagatgtttttactcccggttcgtaacctgtagacccggtttttcaaccgggactaaagatcagatagtgatctttagtcccgggtgcaaaaaccgggagtaaaaatccatactaaagagactagatccgattgctactttattcttttcttttcttcattgtttttaatatattgattcactctatcctatcccaaaatcccaaatcaatcatccccgaatagtctccaaattctcaaatcgatatctccaaatacatcacaaaatcttaaaaaaattacatcacaacttctacaaaattcatcacatattcacatcacacacaaatctcaaatccaaatcacagattctacaaaaaaaaagaatagaaaaagacgaacagccaccggcgctacgcccgcggccgccggcgtgccgcccgccgccgcgccgcgccggccggccagccctccgcgcctcgccgttgcagagagagatggggaggagggagaagggaggagggagaggaggagaggagggaggagggagaggaagagataagggtgtgactgtgtgaggagaggagttaaagaagaggaggagattgtatccgatccgcgtgcatccactctacttatatcgttcttttttcccggttggtgttaacaaccgaggctataagtagatctttagtcccggttggtaacatcaaccgggagtaaagcttatatcgatcttttttcccggttggtgttaacaaccg

SEQ ID NO: 55102 - DNA, 523 bp, Oryza sativa
cataagttatcccaaaagtgagctaatgtttctaagcagggctaagcaattaaatctaatatctagttgaaccaacatatagagctcaactagtcaagttataataacccaaggtatcaaggaataaggtaatcaagaacaaaagggctataacaaacaataggttaattccacccaatgacattcgaaaataaatgcaatatttgaatagaaacaatagctttaaatgggatcaacatgctcaaagggttgtttgggatctgtgtgacttgccttgctggccttggaactcttcaaactcttctccggcgaaaatggactctccggaaacgacggaatctaagcagaaagaagcaaaatcaccaaaacagcacataaacaagcttgaacagtacatgtggatatttttaacatgtacatctcaattttagaaaaatttagagacttgaaccaagtaaatcggagctaagataaattagttatgaatttttgaagattaaatcggattaaaacacttaaattg

SEQ ID NO: 55103 - DNA, 189 bp, Oryza sativa
tgggacatgttctaattggtcttgtgtttgtgtgctaactaggaagaatgctagcggtatcacctgatatttgtaactaagactgatctactgttgtcaatcaagatttactggaaccgtattttgttcttatgttttcctgctggtaattatttgctttaacgtgcttttgtttctctctaaaacagt

SEQ ID NO: 55104 - DNA, 658 bp, Oryza sativa
taggagccgcaagtagctcggcagcggtggatatggcggtagggagcacagaggcagtagatctgtcaacggggagggcggcggcaattgggagggacgtcggcggtggggacctcagtggcagctgatctggtaatggggagggcggtggcggttgggaggtgcgacagaggtggattcggcggcggggagttccccgggaaggggactcagaaacacagatgacaatgaggagctgtcgggctttgacgacaacgatgatgagctgtgctcagcttcggcaatggagacggcggatgtgattttttggattttcacttttttgtgaaattaatttttgcgtgcgggtgcaccaaccgtaggaaaagtattgatttttacaaacatcttcgggcagacggacagtcttaccgcatgaaaaaataggttttagttgtatgcaaaaatgctttcttttgagtagcgtcacatgcttggttcgttcagtccacgtgctgaatagtgtagttagagcgagagatggaacatccagtattccaatggctccaacgggctgccagcaatgagaataccatcatatttgtaaggatgatgtaattaattaagacactttctgataaaataaaggccaaatagatctgcttggcccagaaatgca

SEQ ID NO: 55105 - DNA, 1501 bp, Oryza sativa
  unsure (1)..(1501): unsure at all n locations
cgcgaaaatattcgtccaccccattttttattctaccctctccctatctctgtctctcccacctcacacttcatctcctggcttcactcctctcctctctctcccggccacattcctctcctcttctcccacttggcggcgacaacggcggcggcggttggcgtaggcagcggtgacggaaggggtgggcgacgcctagcgccggcctactgcatgctctcccgtgcatggcgagcccctccagcggtggaggcgcgggatccggcgggcggcggccgtcgccgcacggatccggcggccggctgcttccccccacggcctcaccctcgacggtagtgtgcgtggccactcccctccctctccatctatctcccctcccctccccttccttccctccctgcgtggtcggagggggagcgccggcagagcgcggatgaggcggcacgacctctcccctccctttcctcttgcttccctcctagatccgatggaggggatgggcatcgacagtggtgtggccagaggggaggctggcgtcggcggcgatggggaggcatgggggcggtgggtccggcgacgccctccgcgcgtgcctccgccgacgccctctacccgcgccgcccgtcgacaccctccgccggaaggaaggaaggaaggaagcggaggggagggagccagagggaaacacgagagacagagttgagggaatgagtggtggggagaggataagatggaagaggagaagataagataggaattagttttttttatgtaggcatgattttttgtatgcggaccacataaggttccgcctgcaaaaatcatattttttttaggcggaccacttaagagatccgcctgngaaatannnnnnnnnnnnnnnnnnnnnnnnnnnnnnnnnnnnnnnttcntaagtggtccgcctagaaaaattgattttcgtaggaggatgatgaaaatccaccttggtttacattttcataagcggatattgttagatttaattgggtaattgatccatttaaatcaattaaatcaaataaattccaaggctcattaagctaggaatttatatgtattcattctcttatgggatatcaatgggatgaagagttttgaaaattaatccatttaatcagtgaattggtaacttatatcaatcactcctaattgatgaatggttgatggttgtgtggtgaaggatggttcatggctagttgctagttgatgacaattagctgctctattcctcttcctattccgttggtaacctacatcaattactcataattgatggttggttgatgattgtgtagtggaggatggttgatgggtaattgatgagaattagttactctattcctcttcctattccataactcttactcttcatcttccattcctcctataaaatgagaacggatttgatctctctaaggagaagtgagacacactttcatccatttccaaggctattgctgctacggtaatcccatcccga

SEQ ID NO: 55106 - DNA, 236 bp, Oryza sativa
cgaccgaatccgcaacaaaatcaaatccaactccaaactcaatccccacacacaccgatcgagattcttccgagatgattgggggatgtgatacctcgaatcgagccccaattcgaggcggaggcggatcggagggggagatctcgaagcgggagggggagtgaggagtgggattttgggggaggaggaggtggggaggaaggaattaatgcggggttagaatgttagatggtgga

SEQ ID NO: 55107 - DNA, 1501 bp, Oryza sativa
ttgccacaatacaattttatttttctaaattgtaactatctttgctgggttggctaaaaatcacattagtcctgtttaaataagaatcaggactaaacaagatctttagccccgattcaaaagcggcacaacactttatgatctttagtcccgatttttgtttatttttagtcccggttcaaaacgtggttaggccgtgtcagcccccccggccccacacacttttagtcccagttgtttataccaactgggacaaaaattgaaaaaaaaaaggtgcagtgacatatgcctcgcacacatcccatccttatctactcatgcccctcctcctccactcctcgtcccctcgatccacaactatcctcgatccactcctcctcttctcgttcccggccctctccgaggcaaccttccccggccctcccctctcctcgatcccctccttcccttcctggccctctccatggtgtgcggagggcgacggcaggtggtggtttgcggcggcgagcggtggtgcgcggcggcgcaccatgagcggcgggaggggagggcagcggctggcggaggggagggttgtggcgggcggatgggagggcaggggctggtgtaggggagggtggcggcgggcggatcgaagggaggtggcaggtgggcggatgggagggaggtggcaggtgggcggagggtggcgggaggcagtagcgctagatttttttatgttattctttcttttttttttagaatttgtctttcattggatctgtaatgtatttcttttagaattcgtgatttttttttgagaatttgtgatgtaaatatatgatttgagatgttgttactttgatttagggatacgtagggagcaactcgatttgggaaaatcaaaatgcaagcagcaaataaacaataaaaaaagaaaaaaaacattggcgctagcatcgttagtcccggattgcaacccgggacgaaaggggttgcaaaccgggactaatgaagggttttcctgcagtgtgtatttccaggttgactcttgtttttattttttactccgaatttcagatgctttgaattgtgtacctactcaaaccctttttttttcctttcttcgattaatctgagaaaattttagactgtgagtgtgaattttttagttagttcattagattaatagatggattttataactctgggccttttggcttgtgtccattgagctagtgagctatatatgagctcaattgctacaaataaattctgtcgggtgcacaaaacaagggaaacacttgtttgttctatttactatttttagtttaattaatttaaaatctcttcctagagcacagagaccatacggtgcatagatgataataatgtaacatcgaagatattggaccagatacccatattatcgtctctaatattatcttgtatcatacttgatacttagtcagacctattatcttatagtattattgtatcaaggttggtaagtattatactt

SEQ ID NO: 55108 - DNA, 575 bp, Oryza sativa
aaacataagatgtaaacatccaaaatttgatcaaaaacttgaaatatgatatttcatattttttatccaaattttgaaaccttttctcctaggggtattttggtcatttcgacaaatttgtacagtactaacggagactaaccggacggcgatggtaaattgtagaagttaagcaaaagtcaatggcatattatagaacatgataaagtcagtggcaaatcgtagacgtgtgacaaagtcagtggtatataatggattctctctaaaattttcctatgaagatctttaaaacaaaggattgaatcatattctaatctccgaaaatcttatagagattttggagaaaatttagtaagagtttcaatatcttaaaaactttcctttgagtctatctctcatccaactcccatgtttttctgaggtctaatcaaacggtattcctatatttgtcctatattttgcaatccactgttttggactcgtatttttattagaattctatggttttcctatttctatgttttttcattcctacgattcaaatgggcatagaagtttaagattcggttctttaa

SEQ ID NO: 55109 - DNA, 639 bp, Oryza sativa
atccttgcgcaggggccatgctaatcttctctgtatcgttccaattttatcggatgtcaccgaagtgacggcctggctgcagcgcgcgcggttataagctgcttatcttttctgttggctttcgatgtggtattaaacttgccccacagcgcgcccacggaaaccatcggatcaccatcccacggacccaagtagcaagctccacccgcgcgagcgtgcatgggccacctgcaccttctggtgcggcccaatgagctaacggcccattggtatacctgtttcggcccacaaacaagtccttgtggaaatgtggagctttcctctgtaactttgaaatcctgaattcttcgatttttttttatccccaatgactctatgagaattggaatctccattcaagtgtccagttctgtgtttgggatggtttttcgccctaagttccgtttattttccattggagcaattgaattattcttctgggatagtgattatcccagttccaggttggttcatcattcatcaaattgacaacacaacaacattctaaaatatattttatcttttattttttttaaagcatgagctgctatttcacttaatcagtaggcatgtaccaagcaatccaaaaggcagtgagta

SEQ ID NO: 55110 - DNA, 1501 bp, Oryza sativa
catcattatgatggtcatttccttagtatattaattatttatagtcgaatggaaccaacgagaaattcgactagaaagcattaagatgtgaagttatatttaacccactttattataattgcgtgtcaattataattttttattccttagttattttctaccaaacggtgatataattgaggaattaattttaagattattcataattatttatgaccaatggtgctttgactatgaaattttaagtttattttgcatatgatcgattaagccaatgtaaattaactttatgcaattggcaatgcttattatttaagatcagttgcaatactgagtaatttatttctagattaatggaaccaacgggaagtttatctagaaagaaagatgatttcattaagattgttatttccttaattatttctgcccaacggtgatgtaattaaggaaacatctaagtatcgtcaatcattattttcattttctttgtcattttggcctttacggtgatatgacttagaattttacttatgccactagtgcattaattcctccgtcactcgtgccttacggtgatatgatcaatgatctctaatttgttactaagcttaattcctttaccatttctgcccaacggtgatatggctaaggactttaatttcatgtcatttactaatagcattatgccctatatcatatctacctgattttggtaatttgatttaggatattaattttcagtaattcattattctctgccatttcataatcttttctaccctatggtgtttgattatgaaaattaagatttatttgtatgtgattaattaagccaatggaaattaattgcattactaatgtttaattaataattaatttttcagcattaggacaacttaaggctattcagcttcgtgatggatcaaattacgttgaatgttgaatggagaaataatgtgcttattaacttagccatgttggattatgacttagccataagagaggatcctccctaggaacctcaactggccgaagaactcaatataattgaggaagaatatgataatctcatgtgggcctacaataagaagttagccaactgggagaagtccaacagaatgtgcttaatttatgtcaagggtgccatctctccagaagttattggaggaatcattgactataatgacattaagatgtatctggcaaacattgaagaaagttttgaatttgcacctgacactcatgccaatatgcttgtaaatgagatgatcactagtcattacaatggcaaaagtggtataaggaagcacatccttgagatgactcatatggcaaatcaactcagatccatggatatgaaaatatctgatggatttttagtgcacatcatcatgagatctcttggtcctaactatgatccattcaaaacaaaatataatactcagaaagaggagtggaccatacaagaattgatcttacactccgtggaagaggaagagcg

SEQ ID NO: 55111 - DNA, 1501 bp, Oryza sativa
atactcataatttgaaaattttgaaaaatttgagtgattttttgcatttgataccatggtgcccgggcaccatggtgccccatatgagtgtcctatatatatatatatatgtatatatatacatatacacatatatgtatacatatacacatatacatatatatacatatatacatatatatacatatatacatatatatacatatatacatatatatatatacatatatatatatatatatatatatatataggctttgacggggaatattgatgatggatactttttacatcgaatattaatgatgtgacttttgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaacgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaa

SEQ ID NO: 55112 - DNA, 1501 bp, Oryza sativa
tgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaaaggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaaga

SEQ ID NO: 55113 - DNA, 1501 bp, Oryza sativa
aggtctacacaggtagtcaacttcttttgtctttatcgttgaaaaatcaattatgagagaagcctgaaccattaaaatggggttgcgggagagcacaaggcattacaatttacaagccttgtgctgctaggtaaaacagcagagtaccccatttttcgtatggctaaggctgagtttaatgagaaggtgaaagagatgatcgggaagatacgcaaaacgaacgatatgagctattagtatatgattaattaagtattaattattttaaatttcaaaaatagattaatatgatttttttaaagcaacttttctatagaaatttttttacaaaaaacataccgtttagtagttcgggaagcgtgcacgtcagaaaacgagagaaatcttctataaaatcagtcttcatcacactctcagtgagaagcctgtttttgacaatttatgactcctgtattgtgtgcagtatatatgtatctttattatgcctatgtatgttggttgattttgtcgacttgtgtcgataagggttaggagaggatctaaaccaccggtttccttatcctaacaagaaacaaactaagagataaattcgttttttgtgtgatcggtacagaaaacagaatcctaaactaattgagataacccccgagcctcaccaatgtcgcctatataaagaaagagaaggaaggagacagacgaccaaactctctctctctctaatctcaaaccctaattaatcgcccgatcgatctaggcactggaaggggttcgtgaggcatctctgcaagaagaagaaagaagaacggcaatggcttctaactcaggtaagtagatcaattatttttccgcataagcaagaggtgattgtttatagactaaagcttaagatcatgtaattagaactccaacattgtggtatcagagcctaatttttagtccactcaatccctcataatcacatcatccctgtgattagaagccatccttataaaaatacaagattgattcggcatgagcaattttgaattagattggattaatttctttaagtattaagcccttttatactggtggtttcggccatcagtaggagaagcaaattattgaagaagctgtttaattcaagttttcgattttgattatccatcagtggagattaagagaagaaaagggattgggataaacatattgaaactcccaatttcctcgcactcagaaccctaagccgaagctaagaaggggataaactagattgaaattcccctaaatttagcaaagggaaattcccaattcccgcactcaaaattcctagaccgaaactaaggtttcggctagtactcagcaaacaagaattaggggataaacaagattgaaactccccacggttaatcatatgggaataaacaagattgaaatttcccgaaatccccataagccggatccaatcggcctaaaatccccaaatgaagaaccctaattctttggggaagaaccctaagtc

SEQ ID NO: 55114 - DNA, 1501 bp, Oryza sativa; identical to SEQ ID NO: 55091

SEQ ID NO: 55115 - DNA, 1501 bp, Oryza sativa
tatgtcagcacacatcctaccaatggatatatacattccttcccttgcccaaccttaacaaataaagggtgagctagtctagtaggtcttcattgagtattaccatcattggagagagagaccatatcaaagggcaggcacaaccatggggttcaaacggtgagtagtcagaccgatcaatccctacgatcccttgttatcctcttcttgttttactctttgttcgtcttagttgtgaaattgagtgaagaattgctgatttagtgtttgaaaatcttttgggttttaatttgcatgatgtaaatccttcttcttagaatggtcatcttgttctctagtctccaccatggtcaccattactttctagccttcatttgctctacgactatctcttgtacgcctttgttgtttgagatacattttgaatttgaggggaatgggagcacattatggtgaagttgaggtttgggaggaaagcggatggcatgagggggaggatggaggagatgaggttggggaggaatggaggcggcgtgagggggaggcggcccggtgtgggatgggggagtaggctgactgtgagagacaaattagggcagaggagagttggtagtagttggactttatgggctaaaggctattgggttggaatagtgtgggctggctagtaccttttcactctttcacgtgtcatatggttataatataaaatttacattacaaattgttattaattgggtatcaatccaagtcgtcgactagatttgttgaggttcatgtcccaggtctagtggcgaatctagtttttgggcttggtttgggctcctgctccacctgtgttaagggcagaccaagcctcaagacacacatgccattgcccgaagcctaggaaacaaagcccattaggtccagcaaactttcaccatataatgggtgagttcggaagcgctgtagctacaggactcaggaagcaagattatgctaggagagctgcagcgctgtggctgtgcagccacagcccagctgaaccgaacagacccaatggtggtcttggcccaaacatgccatgtgccggcccagatctccgcaaaacctaggtccgtccctacctgtaaccatctcgtccctcccaaatcaaagagagaagaaataatcgctggtaggattgaactgagaaaatcataactaaatatgcatggtgttgtgttggcactataccttttaaatttctttcaaatgcatgttatgtaggatttattttgtactaaatatattgaccggtaggttccacatccattaacatcattcttcaactcagcttcccggtgacctttgttcttagtaaaaggctctagttatttttcctgtttttttctttatcaatttgtattctcgagtattaatggtactatatttgatttatcttcttatcattgaaggtccattaagccacaaacttccatgcgtacatcggtgaaggtgcataagttgacgacagaag

SEQ ID NO: 55116 - DNA, 1501 bp, Oryza sativa
aaccaaggttagcctacaaaggacagtgatatatacagaggtggtgtgtataaattattagcttatagtaatctctttattaatcttccccggcaacggcgccaaaaatgcttattggtatttcttaatgatactactagaaatataaattcctagccatgatgctagaaatggacctagtatatatatggtttacagaaagaacctgcaagtgcacggatataccattgtagcatttcacccaggagtattcgaaagtatcttatttatttaatcccaagggaagattgtaagagagaactatgctaataatatatatacatgccacttgcataatcaaagtctaagtaggggttaagatatttatatgggtagagtgacacgaagcaaagcactcatgtatctcatttaatcattcctaaactaagtggaagaagaaatagaaaaacaatcgattcctataattataatatacacccaactttagtctacatctgctagtatacaactatatagccaataccccctaatagtgccctcctagtgcttcgagagaccaccgcggcttgtcgagttccttacgacaacctgtcatggccgtccaaccggggctaaatacgaaggagtaccctccctaggaaagtttcttaggaatatatactatcgtggaggaatacccgtactgagctgtcaccatcagcggcccacctcgactaacccgtaccatatatgcctagataatgatacttaataatctagacaccacgtctacattattaaataatactctacatccctcgagataacatagagcaaccgaataatcgaacattaaacccacaccattgtaccttgctggtaggctaactatacagttgtatcgatacagatataaagtaaaaacaatacttagatgaactgaagtatcgagagcatatgaataagaatatttcatcaattgttaaagtcttacaaaagaaagaaggaaagctattacaaccataccaaaattcctccgaagactccgatgactccgggagctattctattctactccacttaacactagaatactaaactaaagtgtagaagagataattgagcttgcttgagtgtgtgaaggagtggtagaggtgaagcccttttatagctgaagaataacggttgtggcagttggaaaggttagtaataccctccaactgccattgggagtaaatccccaccgtcagatcaaaacccttcatccagcggtgctaagggggcctatggttcggctgaacatgggctggcccaacaggccccctgttcagcaggccatctcctctttggctcctcaatccaaatcagtgagttatgggcctatttgatcatgtcaattctgagtttctggcccatttccccacaagtctaattcttgacagcgtctgattgattgttcgagtgttttgctgccggctctcctccattttgtatctctttatctatagatagatagaatcca

SEQ ID NO: 55117 - DNA, 217 bp, Oryza sativa
tatgggctgcaggggcctgggcagaaatctcaaaaaaatttggaccatttctcgatttgtgcgtgtcatccttgcgcaggggccatgctaatcttctctgtatcgttccaattttatcggatgtcaccgaagtgacgacctagctgcagcgcgcgagtttataagctgctctccttctctgttggctttcgatgtggtactaaactttccccgcagc

SEQ ID NO: 55118 - DNA, 285 bp, Oryza sativa
tggttgaaattaaagatgatgtgactgaaaagttgtgtgtgtataacaggttgatgtgatgaaaaaggactaaagtttggttctaaactttggagctaaacacagcccaaattgcaaaaggtttctgcactctctactcaacctgctttggcagcttgtgttcgcagaacagccggtagttattactggttgttgcgacatgacatgggagcaataaccaacggtcagccagaaaaccgcatctatctatctaccattcattcattcattcattcaaacgtcagg

SEQ ID NO: 55119 - DNA, 483 bp, Oryza sativa
cagcagtaggaaactaagttgatagtacttgtccttatgaatctaagtgattatgtaatgccaacaaaccttagtttctgtagtaacctttttggcccgtatgacagactaagttgcacgcatctcttccatcaaaacagaagtgaacttcagtactccattgctgtctattgctatagtactgagtttacacttcaagcaacttggaatggtaggatgcccaaagtaatggctcatgattacagatgcttctattatgatgagtggattcgagctaaattttgttatgtggtgcttgttattttctttcaaggtcaacatatgtttgattctgtttgcacaaaatccttatttaaacatgggaaaataactgatacatatttcattgatttttagttatggttgttcttcagacaagtacctaacataatattgaattaggtgttcctccatagttcttatttgaatcttcacatgtgcagg

SEQ ID NO: 55120 - DNA, 197 bp, Oryza sativa
cgccgtcgaccggggtgagccgaagaccgttccattcgcttcccccttccctcctctctctcgggtgccgctccgccgcgccggtggtcgccggcggtgaccatcggggcgcgggcgcgttcccctcccgtcggccgtgccggcgaggccgccttcgggcgcgccctcgcggctgccaagtgggcccggccgtcagc

SEQ ID NO: 55121 - DNA, 1099 bp, Oryza sativa
cgccgtcgaccggggtgagccgaagaccgttccattcgcttcccccttccctcctctctctcgggtgccgctccgccgcgccggtggtcgccggcggtgaccatcggggcgcgggcgcgttcccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagatttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatatggagtttattagagtaaaagcctttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgaccatactattattgttattgatattattaccttgttcaccctagaataaacaaaaccccaactagtggacactctatttatggttccactagtatgaatttaggtagatgcttcgctgattaataggacaacattaggtggattttataattttagactttgggaatattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 55122 - DNA, 1157 bp, Oryza sativa
gaaggtgcgacggtgcgggctcgattccgacggggaggagaggcggcgagtggcggaaacggaggaggagagcacggggaacgcttatatagcgccgggagagagagagaacggccggagggggaggaatcggccgcggagatctcggccaccattgaagacgccggcgaaacttgcgggattaactccgaacgaatccgagggagagagagagggaaaagcgggggaatcgggagagggaatcgcggggaatgattcccccctcattatggcgcgcggggacggcgggatgcggcggaatccgcggcggcggcggcgctagggcacgggcgagcggcgggagcggcgggaggaaggcgatgacaggtgggcccgacccgtcagcgagggcggcgggcgggcccgcctgtcagcggcgcgcgcgcggggaggaggccgatgggccgcggggagaggagagagagggagggagagttgggccgagccggcccaagagaggaaggggggaaaagaagacttttagagatttttctttttataaaccttttcaactttgtttatttcttctcaattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagagaatgatttttatttcgggatgaatttatcaggacgtgacagtttgccatagtaaagtgtcactttttatcatgataaaataggatagatgtcggacatctatatgcggagattattggtttacttgacaaggttattggaccttggggcataggttgggttggacatggagatgtcaccccaacagcacaagagtcacatatgatgtgattagcaaggtgttgcttacctgttttgataattgtctagcttggatgccaaagctcactagacactaataaaatgaggatcttaactcactatgttactagagggaattttgtttcacaatacataatgggagtatcttttgttaaattgtttgatgaaaggttaaatgtaaacatggtgctgattttgcatacatatatttctattgtaga

SEQ ID NO: 55123 - DNA, 370 bp, Oryza sativa
gtcaagcactcaagcatacagggaagtagctattaattgactcggatcttcctttagtcagtgcaaaaagaatttatttgctgaaatattgtagttgacagttacagagtttttgctgtgatgtgagcaaactgtttctacctagaattggatggcagacactcaattgcaatgatgccatgtagaacaatcctgatttgcatgttttcccctctttattaagatatttactcagattgctctcgagacaatggcagccatctgtttaacttatgtcatactgaactcaactaaaaactgtgtttgtagagttgtttcttttattccatatgctctaaatgcaatatgtgtatgttttatatgctttagg

SEQ ID NO: 55124 - DNA, 570 bp, Oryza sativa
ttttggggttcttgaatacggctttctgctttcattgccccttttcttgttagtagttttgttcttttttgtgctctgtaaccactgatgtggtctattttgcccttctgtgtagcttcaatttaccttatgccctacttatatgctaatttctctcttatatgcttaataattggcacagctcctgccactgttataagaaaatgttcatgcatgttattatacctgatcaatattgatgataacatgtcaacataaaagaactctgcctgcaaaattttatgctacacaccttttggccccttacatttcagttacaacagaatcacacatctgaattatgtcagctctctgatcatgtagttgtggttgcatcaagtttgatacgaaagaaatcaaccttttctcaatcattggtccactattgatcacaatagcattgacatcagaaacctaatatcgaatggctagcattaacttaagcttgggtttttcaagaaataaaccatgttgccattgtagaatgaaactgcatatacaattcttacagagagacgataaatgaattat

SEQ ID NO: 55125 - DNA, 1501 bp, Oryza sativa
ttaaacggataagaatgaaagtactaacacaaccagaattcttgaatgatgatgtaagttcgcctatttaacaagcctactattcttttataactatatttgttatataactgaactaacctcaaattcaggtcatggatgcatacatcctatgcctccgctataaagagaaaggaatcaggggagatggcaaggccttcctagagatggccatgaaaacaggtctactaaatgtagagggagcgcatgtcgaagcaagcaaacctcgagataaacgatggattagagatatggcacgcgactatctagcatttgacatggtaatacttattcaagctatctatgtaatggctaattcaatttatgactctatctatgtaatggctaattcaatttatgactctatcttagtgttgaacaatgaacatatgcagattttcctcccaattaatattaaagatacacactggtacctagccgttcttaacgccaagcgatgtgaggtgcaaatactagattcgctcgcaaagccaatcagtaaagatcgacctgatctaaggcgtgtggtaagcaatacacttccacttgtataattcaaattggttttgctatgttttaaccgtaccaacgttgcacaaaactttccagctgctagctattgagaggggattacacgggacagagaatcagcacccacagttaaaacacgattggcctgatttcaatattaccgaatgggagtacaacaaagtccaaaacttgccaaagcaaggagacgggtgggtgactcaaactcttccacatgatattcacattattcaattacgcaaacatgttagcctaacgactaaattcttgtagcttctcgtgtggcctgtacacccttaagttcatggagcattggagcggatcttatctcccagaaattcaactacaggcaactacaacaacctctattcatattttgcaccagtgcttcccaatacaaaaaaccatttaaaatgcactccctttgcattatgcagaaggaagtgaaaacatttcgacaggacttagccggaattttgatcaactccgaactgaacaacattaaagatcgtccactgctaccaaccacgacataaatggattatctgtcaaacatttaccacaattaccttactatgctctcttacccttattaaataatttagatactacttgggtatttgatggatcccaaacattgatgcctttttgagataatattcataattcatatttcaatccatttgagaaggagcggtatatgaaaccttacgcttcgggatgactcagcgcagtcagctatcgacgtcaccgacgtgcgtatgctacaatgtcgcacctgaacaccgataaccccttcgccggcatacggatccccttcgcgcatgccaccgtcttgcaaactgaccctgctcccaaccattcaatcaaataatcaatatacaatacaatggattcaagaacaaacaacctt

SEQ ID NO: 55126 - DNA, 1036 bp, Oryza sativa
ggtgttggttaattaaaataaatcacatggtgatccgtgggtgcatggttttgctggtcgcacccatggcagttaaggaccggttcgcgggatgccctggaagaacttatcgtacttaccacaagccagcgtgggcaacggctgggcttgtaacgtagctttcctctagccgacgcatccaggcaagggtgggcgtgatggagtttggatgggccctgcgacggcctatgcggcttccggattcacctaggcacgagaggggactgcccgttgccttgcgaggagtgggggtgaaacctgaggtgtggtgtgcttggttagagggggttatgcgaatggtcctgtcacagcctctttccggtatgtcgtggtggcatgtcggcgcacggaaacgtgttgtggggctgtgtcttgtgggtacagttgtaattaattattacaactgtttaaatctttcaacttctgttcttaaatgctcgctttatgcaaatgaaccactttagctcttctttgatgattccctgcatcatgctctgttcttaaatgctcgctttatgcaaatgaaccactttagctcttctttgatgattccctgcatcatgcctctattccggcatgacttgctgagtacagtgggtagtactcagtcttgctctacttttcccaacccccagagtgcgagtatatgtcggatgaaggtttctccgaggagtaggcttcgtccgtgccgtcgaggatgcctgtggagtggtgttcccgctgcagttctagtcaaggcttagctcctgttgtctttctttctttcccgctgcagttctagtcaaggcttagctcctgttggctttctttctttccgctgcatttatgtaaagacttttatgatgtttgtaagacttggaattctattcgggaatttctgggcgtgacaaggtgtcccgccttcccccaggccgggaccgcttacatctgatagctttcataggtcatagactgccctcacagggcaacacatatcttttctgcacactttgtcctc

SEQ ID NO: 55127 - DNA, 1501 bp, Oryza sativa
cataacatgcatttgaaagaaatttaaaaggtatagtgccaacacaacaccatgcatatttagttatgattttctcagttcaatcctaccagcgattatttcttctctctttgatttgggagggacgagatggttacaggtagggacggacctaggttttgcggagatctgggccggcacatggcatgtttgggccaagaccaccattgggtctgttcggttcagctgggctgtggctgcacagccacagcgctgcagctctcctagcataatcttgcttcctgagtcctgtagctacagcgcttccgaactcacccattatatggtgaaagtttgctggacctaatgggctttgtttcctaggcttcgggcaatggcatgtgtgtcttgaggcttggtctgcccttaacacaggtggagcaggagcccaaaccaagcccaaaaactagattcgccactagacctgggacatgaacctcaacaaatctagtcgacgacttggattgatacccaattaataacaatttgtaatgtaaattttatattataaccatatgacacgtgaaagagtgaaaaggtactagccagcccacactattccaacccaatagcctttagcccataaagtccaactactaccaactctcctctgccctaatttgtctctcacagtcagcctactcccccatcccacaccgggccgcctccccctcacgccgcctccattcctccccaacctcatctcctccatcctccccctcatgccatccgctttcctcccaaacctcaacttcaccataatgtgctcccattcccctcaaattcaaaatgtatctcaaacaacaaaggcgtacaagagatagtcgtagagcaaatgaaggctagaaagtaatggtgaccatggtggagactagagaacaagatgaccattctaagaagaaggatttacatcatgcaaattaaaacccaaaagattttcaaacactaaatcagcaattcttcactcaatttcacaactaagacgaacaaagagtaaaacaagaagaggataacaagggatcgtagggattgatcggtctgactactcaccgtttgaaccccatggttgtgcctgccctttgatatggtctctctctccaatgatggtaatactcaatgaagacctactagactagctcaccctttatttgttaaggttgggcaagggaaggaatgtatatatccattggtaggatgtgtgctgacataggaaattgaagattttgaggggttttctagtctttacacacttagcttagataaatggcattaccaaaaaccggggtagccaaacaaccaagatttgccaaccaacatattttttaaacaactacacaaagttttctataacccgtaatctacacaatcgcaatatgtcccaaaggggtatggatagataagcaatcagagtcatagcccagaactagcacttccaacatagttggaatatttagtagcatgc

SEQ ID NO: 55128 - DNA, 1501 bp, Oryza sativa
acctttcttgtaaagtgatgtcggctgattgttcagtggatgttatagagtgtacctgaatagcacaagtgagaaaaggatgtcaaacatattttgttaaatagagttcgtattaaaaccccataatatatacctcttcagaagtgccttgaaaatcttcattgctacgtgtttctgagtcattgtcctgcgctttttcatcggggatttcattgcaatgtatagttcccgtaatgtcgtcgacaacctatttttagtgaaaaaggtgtattagagattttacagacagttgatatagttagtacatagtattaaaaatgagatagttaccttcccttgtccaaaaaggtaagaaattcttttttttttttgtcccagtactgaattagtggcctttgacgaccagaatgatatattgtcgcagccaatttatctattcgcactttttcccaataccaaatctgcaaagcatttgtacataagataattagtattgctatgaaaatatgttcatgacaattttgtaaagaaactcaattttgaaacgaacctgtaagaggcatacgttcccctcaatgtttgttgtcttctctctaaattttaatatgcctttcagtaactgatttagtgttagactagaccagtttagttccctcatgttgtcaacgtcgtcgacgagattgagatattctgagcgcacatatctttgagttgtaggacatatgaaggatccaattgagaaaagaataaatctttgaatgaagtggtcatcgtagctcaaggagttgattattgcttcccgtaatgcttgtaaagtaattgttgtttggccttccttttttacaggttgaacaattctggtttattgatttttggtgcctcaaatatgtcatctctttttgatggcagtccaagcaaacaatcaacatcatcgagtgtcatcgttacgaaagtaccattaatattgaatgctttcttctccttgtcatagcttcttgcaatctcattgcacaagtttcggtcaatatgtatgttgtcaatctttagcaagttgccaagacctgaaccctcgatagcttccttttgacgtagacttagatggagtattacctcgtacatggcatgtggagagcaaactagagttccctaattaacagaaaagataataagagtttagtccatgtgaaaatttatgcaagtgctcatatatatgattgcacattaccaaacctagagatcaattaatcctgctagaaatcaattagaaatcaaaggaaataattaatcctgctctggcatgttactcgtctgacatgttgaagtgatgtcctccatcactgttctggcagtctatatggccctctctataatttgttcaatgttcattcttatgtgcaggattcagtgaggttgaggagtttgaggggagcaacatgagtgaggtcttcgagggcaacatagtactgtcaggtttgtgccaccttcacccatgaccacatcc

SEQ ID NO: 55129 - DNA, 1501 bp, Oryza sativa
gtcggtacatcagagcgatccattgtccatttcccgtgcctccattctccttaaaatcagcccaacgtctctcgaacttgtcctcatccatattctcataaattaattttcttagctcgtcgagttttggcttacgaaggtgacgactcatattctcctctatatgccaagtacacaatctatggtaagcacccggcattaccttactgatagccttcgccattgctaggtcgccatcggtaatcaatgattttggatgcacttgacgcattgcctccaaaaaagtctcaaggagccaacagtaagagttgacatactcatttgatagaattccgcacccaaaaattgttgtacttatgtggtagttaactcctatgaaaggaatgaaaggaagattgtacttgttcacatggtaagtgctatcgaaaataacaacaccaccaaaagcagcatagtctaaacgtgattcagaatctgcccaaaacacattcctaagacgcccgatatttcaacacatcttcagcatcatgacccttgatattcttcatctcgtaccgtgtaaagaaattataaaggtccttcatcacaaaaccaacctcatctaactcatcatggttattctccataacctccatgatttgaaagggcctaaggccactcatgcgaagctcgaccgcttgggctttcttaaaatcactcatcacatgatgaactcctaaaaaagcaacatggtcaggatttgcaagttcgtgcgtatgttggttatcaaactccttaacaaaccacacccccttctcctcgttccgctcaatctcaagcttagctaagcaaccgcagcgggtcagtgcccgtggctcccttttccgctctgtcctctcaaagtgctttaactccctgtacccttcacatgagcatacgaattgcctccatataatctcaccgtccttccgtttcaagttgtttttcctcacactgaaacccttcccctttgcatagtctaaatagaatttgtaacattcctccttgcttgaaaaaaccacagtacccatcattttatactcttcctgatcctctagaatcacatagctcgaagtctcagacctcacctacggaaaagtaaaaaaaacaaacagatcaagcacccaaatatataagcttacgtcctttatacctcataagtatataaaaaaaagaacaaccatcaactgcataaatacatgccattctaaactattgagcaattactacagttcccccacaatggctgcaaattttgtacgtactataaattgttatactaaaatacattttctgaaaatggttgttcagagataatttttctgttttcatttcagctgtacagtcaaattttgtgttgcacatcatccagtagtttcagtaatctgtttcttttttcagcacctctggagaatgtatgcatttgtgtatttcacaatgacttcggttacatgctcctctctgataattctaccattgttga

SEQ ID NO: 55130 - DNA, 1501 bp, Oryza sativa
gcccgatatttcaacacatcttcagcatcatgacccttgatattcttcatctcgtaccgtgtaaagaaattataaaggtccttcatcacaaaaccaacctcatctaactcatcatggttattctccataacctccatgatttgaaagggcctaaggccactcatgcgaagctcgaccgcttgggctttcttaaaatcactcatcacatgatgaactcctaaaaaagcaacatggtcaggatttgcaagttcgtgcgtatgttggttatcaaactccttaacaaaccacacccccttctcctcgttccgctcaatctcaagcttagctaagcaaccgcagcgggtcagtgcccgtggctcccttttccgctctgtcctctcaaagtgctttaactccctgtacccttcacatgagcatacgaattgcctccatataatctcaccgtccttccgtttcaagttgtttttcctcacactgaaacccttcccctttgcatagtctaaatagaatttgtaacattcctccttgcttgaaaaaaccacagtacccatcattttatactcttcctgatcctctagaatcacatagctcgaagtctcagacctcacctacggaaaagtaaaaaaaacaaacagatcaagcacccaaatatataagcttacgtcctttatacctcataagtatataaaaaaaagaacaaccatcaactgcataaatacatgccattctaaactattgagcaattactacagttcccccacaatggctgcaaattttgtacgtactataaattgttatactaaaatacattttctgaaaatggttgttcagagataatttttctgttttcatttcagctgtacagtcaaattttgtgttgcacatcatccagtagtttcagtaatctgtttcttttttcagcacctctggagaatgtatgcatttgtgtatttcacaatgacttcggttacatgctcctctctgataattctaccattgttgaaacccttataaaaggaagattcgaaacggagccaggtcattgcagcttattaagacctatttgtagtcagatcgttgccacaattcctgaatctgttttgcaggtcatgtggattcctatggacataatcaagttagctgacaaactagcaaaagaagccaagtccaatgttaatgcagcccctgtctatttttgtcaaaatatatcgcatttgtcttatcctaccagaagatgtcatgctaaatcatatctaaatatcaatggtcagttcgccagggcagcaagccatacatgcacagcaaaatcaatttaatattgttcatatttccttcaaaaaaatatttctttcaaaagttattgttcatatttctttcaaaaaaatattgttcgtcagtttcatcgttcatacttacaactcaacatacaaaatcaatttaataaatctcctattcgatttacaagctagtttacacagacattaacaagcaagtatatgca

SEQ ID NO: 55131 - DNA, 1501 bp, Oryza sativa; identical to SEQ ID NO: 43077

SEQ ID NO: 55132 - DNA, 1307 bp, Oryza sativa
taccgtttaacaatttaaaaaacatagtaatgaaaccgatgtaaaatatgtatccactactacataaacgatattttcaaatgacacccccaagcagtttacatgtactagctcataagtacctcctccctccgtcctaaaaaaatatgggactggatgtgacatattctagtataataaatctagataaatgtaggatgtgttatatccaatactagattggttttttatgggacggaggagcacatctgaaaaaaaaaaactggtttaggccagttgatggaccgttgcgacaacttagatatcaacttagaactgagaggccttgtttgttactaaatgagataaagatttcatttcatgttttattagcatgttttttaagaaaatattagcacgtttttcaaactgttaaacggtatatttcatataaaactttatatgcagaaattgatttaaaatatcaaataaattcattttttaaaaaataaataactaaaactcaattaatcatacggcttttttttattttgcatctccgtacttaatgttattcagcacttacgaacgggaccagtaatttgatcgtttagttggatggagtgtttgttgatattctcagtcttaatcgtaattttcacaatcttacgagtgccattactaattactggtattttgttggagtatgaccagaaatcgcgagccgggggaatcaagagaaatttcctaggactgaaaggacaaaacctgtgagactgtgattcgtttcccatgggaattcagctaggaacaatgtttcgtagcagacaccaaaataacaaaataatatgtagtacatatgaagcgagtgtaactcaattaattaacatattaccaagatcaagtttgaaatttaacatgaatacttgtatttacggttaattatgttttcagtgatagataacgtactcattgactgtgagccatctgtggtgatttcgtcaatttcaaaatatgttgtgttagtcttccagaaatacttataggataggtcgtcgacaataagacacccatcgtgacttcgtcaatctcaaaatatgtcggttcaatcttctggagagatgttgatgggtaggatgtgcgtgtgaatttatatggatgagtatacttgtgatgtgggcgttgcgttgttttcgtccatccttatatgtgagaaaactgtgattatactattgtaaaaagagcggatccgttagtatgatataacttgtaaaatcgcacgggtgtacgccataatgtcattttcactatttcttacatttttaagt

SEQ ID NO: 55133 - DNA, 1501 bp, Oryza sativa
ttagtgttcaataaggactttatgtttccttttatctttagaaagtttctttcttgacctacaaggactagtatctaccgatgggcataaatatgtacaccgaggtcattgtaaactatctctcaatcaatactactctcggcgtatcgccaccctcttttctgaggttttacttatcaaccggcggaatttggcacctgacgcggggcagcatcagttcagttcgatctctggcggaggggtaagtcctacgttccgtcggccctgggaatctatcagctacattggtgttgttcaaggctacatcacttcgatctcttgaattgctctggtttggttgatatatttgcctacctgatatctcaattctatctctaattgcattgtgtttagagatgcatcgatttagatgggactgtcttggttaggcccgatctactgtcttagccgatatatctctacaatcacaatgctgttataaatagatttattatatccatcacattagacaaactaaacaaactaaaggtttcactgtttatctaaatcaattggattttatgacatcagacttttagccgatgtatgttttaaccatcggatcagtacttatcctatcatattattattagccgactggtttctattggattatattattattatatcttattatcatcagtcgattgtctttgtatcattatctatgttggacatatagccgattgctcaaaaccctatcgacatcggctagaatcggcatcggctaatgtcggctatcggctggaattactccatcggcttgttagccgatcggctgttttatctgctgtttacataccttgtcagttgcaggatcaaactgactgactgttaggtaattcttacagtcacagatagaaatccgcaagcgcatggatataccgatgtagcacttccccctacggagtattcgaaagggtatcgaatccaagggaacgtgtgtgatcagatcttcctctggttcatctaaggacaccaagcaaaggataggcaaggatagagaggatttactagtgagaaacaatgtctagggaaagcttaagtttaatcctaatgcaatacttcgggcactggtaacctgctgttcccagatgtcgctctactacgtacccggacagggaggacttaagtgatctcgagggctgtcaccacctctacacctacctcaaacataccgtgggatacacagcaattactgtataataattacctaaacaccacgtctaagcaattaatatctactttagtgtttacaactcaccaaagcaatcactatattttagttgattatagtgaacaataatcctgtatgctatttaggaactaaacaagagataattctcacaagataaatttaaattactcagggagaatattatattgaaatcagagtaataaacagaattaaagaaatgagagaagattaccgacaactccggaattcttctaacttcttcta

SEQ ID NO: 55134 - DNA, 153 bp, Oryza sativa
gaagtgcccgaccgcgcgcctcgggccgactaggggagagcgaagacggtagtggcgatgggaatggcgaaagatggaggatggtggagcgaggtggcttctatagccatggcgaatggcgacgcggtggcttcgaggggatggaaggaggca

SEQ ID NO: 55135 - DNA, 1501 bp, Oryza sativa
gagcaaatgcagtacctgttaagcctagcgctagtcagaagcaaccataatactcttgtatcagtaatcatatacttatgttttatagttgttccccgtcaatcatgtaataacagagaaacatgagattatgaaggagtttgataagtttatgaaggatccatgttaagatcgcaagtgcggtgagttgtgtacactttgttgctgattagggagacccagggtctcatctccgtaagctcataatctattatgaatcaaataacctcgcgattgatggcgaagaaaatcaagtgatcaaccaaagagacatttgtttggactaagagtttcagatgtgtcttcttcggatcaaaggcatgcacccgttgtggagaaattggacacgttgctagcatgtgtctcacactctgcactccctatgaagaagaccatccaccaggggagtgtcccactcgcaaggtgacatgttttctgtgcgaaggagcaaaccgtgggcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcattaaccattctctgcaccgacagcctcagcaaggaattgtcgtcgatggaaaaagttgtgtctctccccgacctactccaggccaagcaaagggcaatcaacctccggagggcgataccaagcagaagaccgtcatccgcttcaaacagcaatcagaaggaagcttctcctgtgaatgatagcaatatgcagtcctatcacataatcacagaaccaatcaaggatgatgcagtcactagaacaatgccagctatatctctccagaatcaaaatgagcagccatgtttgtggttttcagttcgctacttatcatggtgtaatcgaaagtttgcagcaatcatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgggattcttttggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccgcaggtagaagtacttctatggggacaaggatggaaacttttgtgacatgaccaagaagtcaagaagtaaaacctgaacagtggaatctaaagctcggttcaaccttgggctttgtatcagatgct

SEQ ID NO: 55136 - DNA, 204 bp, Oryza sativa
ctgcggtcagcaaaccagtgatgcggctccatgaaatgaaagattatagtgtgtacaagtcaaaattcggtgctatcatgcttccaaaagagggagcttcaccaagcatggaagagtttacttgagctgtaagtacaattgaacactcattatctagaaaagaagtaccattgaacacacaataataatatagtatgctttctt

SEQ ID NO: 55137 - DNA, 1501 bp, Oryza sativa
cttgtttccctaatgaagcgcatggaactccctcttattttgtgctacagtcccatcgggaacctatgccttcctgaagctacggcaaaattccgcccaagtgacatatgtcacagctgagcgggtgaccatgtagttgtcccaccaagcagaagcgggaccttgaagtttgtacgtggcaaagacaaccttctcctagtcgttccaccggaggaggttcatcttcttctcaatggcatgaagccagtcattggcttccattgggttgatggtgctggagaaagtgggtggcctgacatggagaaactaaagtagtttggactaatgtggtggtggtggaccaaactgctgattcagctgctgcagtgcctgatggtgcatcatctgctattgcatatattggtgttgtttttgcatctgctgcatatcattgtatgatatgcgtctaattggccaacacctgagcgattgttgaattctctagcggtggaggtggaccattgctagttgcaccactggtattggctcctccagtctattcctcactgctgctaccatcacctgttgcatggtcgccattccttgtgttcaccatctgaatggggatggacagaaaaagggggaaaggaaagaatatagactgctaaaaaacctaagctttattacattataatttaagtgcaattgtctaatctgaattaaaacaactacaaagaaaacaattcaactcctaattaaggtagtcataccgcaaccactgttgacggtcgttgtcgatcagtttcgaccatcaatattaccaaattaagagagaactagtgatgcttgcaatgcatatgtttgttagaataataatattccactagtattaggtatattaatcctttgtagagaatgacactaaagtggaggagaatcggcatcaacatagacgataaatcaatcggacaatgtcgagaaccagacttatgtatgaatgggaaaagaactcagaattgacacgatgaattaggccaaaattcacaagtctacgaagtgaagcaatagaggaattcgccaggcgaagatgggctggtttgggccagcccatggttcggccgaaccagggagttcgggcgaacccccatctccactgttgaggccagggtttggcatggacgtccaagattgcaccccaatgacggttggagggtacttcggacaattcctcttccacaaccgtcataaccacctctagataaaggcttcactctcttaacttcaacacacacctcaagcaatagctctctcatttctcttaagtttagtttagtagtacctagctggtggaatagaaatagaataggagtcaggattccgtaagccttcggaagagttcgggtatggctctagtagcttttctcttctcttttgtatgctttgtacttttattagaatactcttctatatatatttatggtattgaaatattctccgagtatatgagtacctactttatatt

SEQ ID NO: 55138 - DNA, 1489 bp, Oryza sativa
acccgctatacgctatttattaccttgttcgttacatttgcaacaagccaaaattcgatcgattttcatctctaactaagcttgtggcattaatttggttagctatatgttggcaaagtctatgctttaatttgtaggttggttgatctcagcactaatcgattcttaaaggcttccagaatgtatatttttttaaggactccgatatggacatactattatcgttgatgccaatggacatcaatatcaaggtgtcttgtcctatacaggacgtttgatactacctcggtcccattctaagtgtagccatggtttaccgcgtctaactttaaccatccgtcttatttataattttttaaaaaaaatttaaaaacataagtcacaagtaaagtattattcatgttttatcatctcataacaacaaaatactaattataaaaaaaatatttaaataagacgaacaatcaaagttgaacgtgaaaacttatggttgcacttaaaatgggatggaggaaaatgggatagaggaagtacttgatacggagtagggctttaacttaaaagaattttaaaacacttaatactaatataaattaggtaacccctaacatctctttatttgtctacaaatataagggattttgagattcgggaaaaaataaaagtaaaaaagatattacctcagtcaccatttaatccatcaatatgtcggtgcttttccttttttttctcttctaaaatatgtcaaaaaattcaatagacatttacttcaatcaaaaaatatttatattttgatcagagaggggaatagaatactatagtgtaccggcctacaagccagaaacctgaactgcttttttatttttaaaaaataagttagttactagaaaatataaatatagttgatataggcatatctaacttgtttatttagagtaaatttcataaaactattaatactttgactaaactatcacaacactagaaatttaagattgtgtacttaaaattataattatagatttaacactaaatttatcataaaactacatatttaggttaagtatcataaaactatgtagcgcccgttccgtcgtggcgcctagcgggaaaactatctcttaaaaaccctatttgcgaaatccgtttctttgcttgttgtctagtgtccgtaccatctcagatctcaaatccctgatctatcgtcgagttcaatcccgaatccaaatccttcccaaatcaaatccctccgcaaaagtctttttcgcctccctcgggttcgatgggccgaatccctctcggcccatcttcccctccctccccggctctctctctctctctctctctccctctcccccgctctgcccgtgcgctgcgcacgcatgcgcgtgagccgcgccgagccgagcgccctccgccctcgctgccgtttcccgccaacgccgcccaaatcgccgcgccgcctgttgcttcctgcgcgcgcgcgcca

SEQ ID NO: 55139 - DNA, 1501 bp, Oryza sativa
aggagcctcacgctccgtcactgttgtttttgcaattgattttatttgaacccttttctgaaacaactaagggagtgcttctcaaacgacacgggtgagacagtgcgtctcgtccggtcggagtatgtgcaatgtatcagtcttttgaattgattaagattggctcccggccaacagctttcaaacgaccacccaggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacccacacgacattactaacccggatcatccagttcgtgcagaacggccacgactagagaccttaaggctttcatgacaaggcatttcgaaagccgacacaggttcgccatatgccaacgagaggggtcccagaccaacaccagattaggtcccagaccatactgtgccaggaagcccaggggtcctccccgacaccaccctggcgaatccacatgtcgcttagcatcatggctctcccgataagctagttactcagccaggggtgtcccattccacccatgtggttgtacttgtcttatgttcggatgaaattccaaggaaacggtccttaagtgcaagagcgggaaaccgtacacccggtatgttccccggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcgactaggtgggtacaagggagcatggtataataattacaatgggagggtcaaatgcaacaaattaggtaggtctgccaatctgccttgcagacgggacaagcagattaagtgcgatcctatcaatgcataatatttttcaagcaacgtaattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcgacctgagagaaaggggcggctcggccgagcttaatgggccggccggcccaagaaggcggcccaaggcacgcg

SEQ ID NO: 55140 - DNA, 1501 bp, Oryza sativa
tacctacctccacttctgtcggaagcaagcgcgacgtgggaacatggctgtctgctgacaacatgaccagtgtcagaccggtcacaaatcggtcattcttgtccaccacgtgtcagtttagcaatctgcatgttcgcccttcttcatacaatatcttgcttgtaatggttaggatgaagcctggcatatatctgaccggggccaacgtgccatcttcaggagctaacacgccggctccggctagggacgagtgctcggaggctctcatcctgacgggatggggcgaggcgtgcgtcagaccgcctgtcgccacctaacccacgatctgatcggtctgtgaccagtcacagaccggatagacgagcacgctgcactgcgtggcgtgacgcgctcgtctaaaccgcaataaatacggttaggtgagccccgctgtgctcacctaacccatacacgcggcgcaaaacccacaaggggtcggggcgcctcagccctcggggccgaaacgggagtggtccgacccctcggggagacaaagaggggggcggccatatcaccctcgggcccgacccccccgagggggtcaggccacgtgggtgattgctcctgcccaagcctcaagtcatagtactcccggtcccatgtcaccgacaaacagtctttcttgaagcctgcattaaacacttatttcccatggcttgctgagtacttccgtactcacccttgctctatataaataatccccccagttgctgaagaagatgaagcggatcccactgacgaggagttcttccaggagcaagccggctacgatgagttttaggatttcggcctagttcccaagtcgcgcctgtgatgtttggtccaagtctggcttccgttccccttttgtaatgcagttgtgagctcgggttctgtccgcagcccaacatgactgtactcctactctataataaagagacctctgttgctgtgatattctgtcttcctgtgataccagcactgttttcctgggactggtatcggttaacaggttaatttggagcgtcacgagctagttccgctcgggactagttcggggcgtgacaaactacaatttaataataaagttatcagaaaactacatattatatggtttaaatccatagtactaatgttatatttaagttataaacacccaagtgttgagattaaattggcgctaaaactatagttttatgatattttgtttaccaaacctataattttctgataactttattactaaacttgtataataaatctatagttctttgatagatttcgtacaaaatctgtagttttgtgacaatcttaaatatgtagcttttatagtttgatcaaaaatatttgtggttctttgaaatttacttttaattttaagaccaactaagcatttgtctcaagagtgtattgcttgccaagctatatgcatgcgtgtgcgtactttattttagtggccacaccatatgtaacttttcaataa

SEQ ID NO: 55141 - DNA, 212 bp, Oryza sativa
aatttgtttgcaaatttcgcacaaatacaacagtgatcttttttctctaaaaattgtcaacagcacaagaacgtacagatgaaatatatcttagcaatcttatactcacaaattaatttgtaattttgcctactttttcaacgcagctggagattcatttgtttgtaccaaccaataccttgcaggggtttgggggttttggcagaatcttg

SEQ ID NO: 55142 - DNA, 1501 bp, Oryza sativa
gattcgaaaccgtgccaaagaggatatccagatatccaaaatccacactggatatttcttcttctttatttttttttctaaaaaaggggctatgccgcatgatgtatttgcagagaaatccatgtagtttctaattatcgttctttttttattctccggagttggctattcccaattcgtaatggattgtgatgccctaagatttaatcagaaccggttaaacgggtggcgtgaaaattcaatttttgaaccatcctatggacaaacgatctgagacagtagatacatagagttctttgagctatgcgaaatacagcaattggtgtccgttaatttgaaatcgtggcggttaaataattttagtctgttggattaccattctccgatcaataggatatagttaaactttttcttcgaacttccaacttttccatcacatcaaaactttcctacacacgcaaactttcaacttttcgaacactctgttccaatttcaaccaaactttcaattttggtatgaactaaacacaccattaattagaattttggtattaatctaatataaattaggtgtcatgatcgaagcgacgtttgcagtatcgtcgctatctttatagaacggctctagtttcatataaatcagataagcggtttaggatagtgctgctaaccaggttcaaactggcacaacgtttcttctttttaaatccacaaccaatagataccgacttagagtttttactcaacatcaaagttttagataattttctgtaaatgctctaaatgtatttattttctatactttgttaaagtagtttcaggattataactagaacagtgaggtcatgtttttcgtaaagtttagctttttagattttaattgactaattagtgactaaagattaccttttagatttgtagttatccaattttgagtgttattttttgttatttagatttagagtgtttcggtaccgccagtcagacatcgggttatcaatgatgttaaggcacgacgaacttgtttgtcgtgtgatgaatggagataactggtatgtttaattcacttgccgtctaattattcatatgaatgcttattttactactattgattgttccaaaccgccgagggatttcgtttgcaccggttttgacagtttagagaccggttgcatctggttttggggttcaaggatgaaaatcggattcggtgtaaacttaagggacctcagatgaacttattctttcctgaattggcctcaattccggtctgtccacgtgcttaggcctggatagaatcccagcccgtttacaatgggccttgttcgttttgggtggggtcgggctgggttgcggcccaataccggtggatcagcccggcttggattaaaccccggcccaccaaaaaaattgcgttcggttaagcccggcaaggattggatccaggcctaccccggcctttccccctcattctgggcctcaaagtgcacgagacggcgca

SEQ ID NO: 55143 - DNA, 808 bp, Oryza sativa
  unsure (1)..(808): unsure at all n locations
tacacaaactgacaatttaatatacagattcatcaaagtaactaaaacgataaatacttacttatgaggcacttagtcctcatcatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagttgagntaaaattttanaattccaanggaaaaaattttttttttttaaaaaaatttttcccaaaaaaaaaaccccaaaactgaacagcacacccatgctgcccaggcccaaccattctgaacaaccatacccggctgaacagatctaactccaaaccgggaagctaaccaaatattaccagttattaccatcaatacttattgtgagaggtgtgggactaatcacgaaaaacattgctcaactcgcccataaccgcgggcacggctattcgaatagttttactccggccagaggtgtaccactgtacccacaagacacagtctcaacatcatgtctaccatgcgtcgtgatactggaaagtacccgaatagaggctgtgacaataccctctgcataacacaactcaccacagtgcaccattcctggatcataatcacccccttataaaacaaggca

SEQ ID NO: 55144 - DNA, 1501 bp, Oryza sativa
agatctaactccaaaccgggaagctaaccaaatattaccagttattaccatcaatacttattgtgagaggtgtgggactaatcacgaaaaacattgctcaactcgcccataaccgcgggcacggctattcgaatagttttactccggccagaggtgtaccactgtacccacaagacacagtctcaacatcatgtctaccatgcgtcgtgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaaccatgttatacaaaaggtaaagccgttgcccacgctggcttgtggttggcacggttaatgtttcacaataatagctcgcgaaccggtccttaattgtcatgagcacgactctcaaaaccatgtgctcacaacccaccattatcaagttttagttggcaggtaattaattaaccaatcacgattgaccatcgtgaactatcattaagccatcattaaataatgagtcataagttatcccaatagtgtactaatgtttctaagcatggctaagcaatcatatctaatatctagctgaaccaatatataaagctcaactagtcaagttataataacccaaggtatcaagaaataaagtaatcaatgcaaacaggccataacaaaagaataggttaattccacccaatgacattcgaaaataaatgcacagttgaaataaatagagaatttaaatataggatcaacatgctcaaaggaattgtgtttgggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtatattataattttagatgaattatgagacttgaacggcctcattctgatttcatatgaatttattatgaattttacaagattaaatctatttaaagcccatttaaaaagaattaaataaatttaattcaatttatggacaattttattatgtagatctttattttatacaacttttgcaacttgaaccacattaaactgagttaagatgaattagttatgaatttttaaagattaaatcggattaaaacacttatatggattttaattgaattatgacgcaataatgaattatttttgaaaaggaaaagaaggattattgcgtcagcggctagggtttgcggtggaccgggtgcacggcggcggctcacggaaacgaacggccgagatcaaccctatccaaaacggacggccgagatcgatcgggtccacggcggctcacgggagagggcgacgatgacgtcagcga

SEQ ID NO: 55145 - DNA, 458 bp, Oryza sativa
atgggccgcacgaacaatatgcacgagacgttcgtagtctaccattttataccgaaaataaaaacgaaacgagacgtattcgcccacagtaactgcctgacgatgggcctcttacgtcgtgtaagcaaccgcaacgttcgtcccccaaaactacacccacagtccctgaccaatggactccacccatccgggaaccatccgggcccaccatgtcagtgactgcctacgacacccccctcggagaaaaaatccctcgcacacggatcgcctccggcgaggagaactagttgctttcttccacctcgtctcctcccccccctcccctctctctgaacccgtcgccctcgcctccccgtggaccgccccccgagacgccccccctccgccgcgccgcccaccggagcgggcgcgcatcggacccccctcctagcccgcggagttcaccgtcagccgggcca

SEQ ID NO: 55146 - DNA, 245 bp, Oryza sativa
cgttggtaagcccctcgcgccagatattgaggatgacccaagcatattgattagctacacgcctccacgtgataagctgtaaagaaaaataaatgaggaaaaataattttagataaagctattatacttttgctttttgcaatgtaatagaaaagaatgaaaaagcgcatagattaatttaaaattaagtttaaaatttaaattttacctataacttaatccattgaaactcggttgtcactaga

SEQ ID NO: 55147 - DNA, 203 bp, Oryza sativa
agcatcacaaagtagataaagaaacctagagtctaaacaatcaagtaacaatcacttttcaggatggtagatgccttaaccaatctaatgtagtaggaagatttagctgatactggcaagaaccctaaaacgagaaccagccgatagaggtaaatctagatactaagactagattagctaagacatatgatagcagatgacca

SEQ ID NO: 55148 - DNA, 1501 bp, Oryza sativa
taaaagtctaagtcactaaaaacatttttagtcccggttagtgttaacaaccagtactaaaaatacatctttattactggttctaaaagttcaagtccctagaaacatttttagttaccgttggtattaccaaccggtactaaagacgtctctagggttagttaaaaaagacaacatctctattcaagtcggatgcacttgggatggtgacacgtatgagggctgaggagatcttgagtttgaatcctgcattccacattttttttgaatcttgcattccacatttttttaacttagtatactttcaaccggtactaaagatgtcagggttgttataaccgggattaatggggatttctaaccggtgtaaaagatgagttcttgaatgggtgttttttgaaatctcttatatgtgtctatcacattaagtctttttttcttcgtacattatacatgggtttgtcttatggtaaagaactagaattttctcaattcatgatctttggtgaaactggaaaatgctagggtttttaatctctagtgtttatggtgttgagatgaagggagtgagagcagtattgttgccttcgttttatttatggttttaaatttttacattttttttcttaataaaaaaatataggtaaaccttttatatgcatgtccttatctttactgattaaaaagtgtaaacaccacaaaataatctacgattaagcactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagtttttttttcaaatgacatggatggatacatgccccgtatcaaagtcatacaactcaatcagatctacacacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgt

SEQ ID NO: 55149 - DNA, 1501 bp, Oryza sativa
tatctgtgacgtgtgttagttaaagacccgtcagagatgagtggtctcttttgtgatggttcataatactacacccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgcttaatcgtagattattttgtggtgtttacactttttaatcagtaaagataaggacatgcatataaaaggtttacctatatttttttattaagaaaaaaaatgtaaaaatttaaaaccataaataaaacgaaggcaacaatactgctctcactcccttcatctcaacaccataaacactagagattaaaaaccctagcattttccagtttcaccaaagatcatgaattgagaaaattctagttctttaccataagacaaacccatgtataatgtacgaagaaaaaaagacttaatgtgatagacacatataagagatttcaaaaaacacccattcaagaactcatcttttacaccggttagaaatccccattaatcccggttataacaaccctgacatctttagtaccggttgaaagtatactaagttaaaaaaatgtggaatgcaagattcaaaaaaaatgtggaatgcaggattcaaactcaagatctcctcagccctcatacgtgtcaccatcccaagtgcatccgacttgaatagagatgttgtcttttttaactaaccctagagacgtctttagtaccggttggtaataccaacggtaactaaaaatgtttctagggacttgaacttttagaaccagtaataaagatgtatttttagtactggttgttaacactaaccgggactaaaaatgtttttagtgacttagacttttagaaccagtactaaaacatctttagtaccggttcttaatctagccaaaatatttatgattttgggtaccacgacgaaacatttgcttatgagaagacattggcagagaactcatcttttataccggttggaaatcaccattaatcccgggtataacaaccatgacatctatataataccggctgaaagcataccaagtcaaaaaaaaaatatgtgaaatgtgggattcgaactcaagatctcttacctcatccctcaagcgcattatcatcccaccttctacatacgtttgacttgaacagagatactttctttttgaactagcccgggagacatctttagtactggttggtaataccaaccaggatttaaaaatatttctagggacttggaccggtactaaagatgtatttttaggactggttagtgttactaaaagtgtttctagggacttggatagtgtttctagggacttggattttcagaaccggtactaaagcatctttagtaccggttcttaatctagctaagatatttgtgattttaggtaccacga

SEQ ID NO: 55150 - DNA, 1501 bp, Oryza sativa
aatttatatattacttgtgataatcatattttaagcaggggttaagataatcaaagggtagagtgacacacaagcattaactactcatcctcataatatatcatctaagctaagtggaaagaaaagagaaaggaaatctattcctatacgtctaatatatatagtatacatacattctagttaactgatatactagctaataccctttatccgatgccctcctggtacttcaagaaggcacccctgactgccgagttccttacgacagcccgtcatgaccatacaaccggggctaaatacggaggaataccctccccaggaaattaacttaggattatatataggcgcggaggaatacccgtattgagctgtcgccatcagcggcccacctctcatccgcaatatataaccccaaataatgatatcccgtaatctagacaccacgtctaaactacccgatactactctaatatcatcgtcatgaccactctaatatcatcgtcatgacctagagtaattgcataagcaaacactatatccgcaccaaagcatctcctagataagctagccgtatatttagtataataagaacataatataaagtaggtactcatatactcggagaatatttcaataccataaatatatatagaagagtattctaataaaagtacaaagcatacaaaagagaagagaaaagctactagagccatacccgaactcttccgaaggcttacggaatcctgactcctattctatttctattccaccagctaggtactactaaactaaacttaagagaaatgagagagctattgcttgaggtgtgtgttgaagttaagagagtgaagcctttatctagaggtggttatgacggttgtggaagaggaattgtccgaagtaccctccaaccgtcattggggtgcaatcttggacgtccatgccaaaccctggcctcaacagtggagatgggggttcgcccgaactccctggttcggccgaaccatgggctggcccaaaccagcccatcttcgcctggcgaattcctctattgcttcacttcgtagacttgtgaattttggcctaattcatcgtgtcaattctgagttcttttcccattcatacataagtctggttctcgacattgtccgattgatttatcgtctatgttgatgccgattctcctccactttagtgtcattctctacaaaggattaatatacctaatactagtggaatattattattctaacaaacatatgcattgcaagcatcactagttctctcttaatttggtaatattgatggtcgaaactgatcgacaacgaccgtcaacagtggttgcggtatgactaccttaattaggagttgaattgttttctttgtagttgttttaattcagattagacaattgcacttaaattataatgtaataaagcttaggttttttagcagtctatattctttcctttccccctttttctgtccatccccattcaga

SEQ ID NO: 55151 - DNA, 561 bp, Oryza sativa
taaagacactaatgcaactaaacaataaattaatgcatagactagttgcatggaaaatgatgcgcaacattgcccccatcgaatatagacacgacctaatgcataacccccaataaattcccgactgactgtcgaataaactccaactaaaatttttctaaagccctagactgagctaattttttttttaaaaaaaaatccgatccgaaagaacgaccaagatttttcccgcaaaccaaagaggcaaaactccaaatttttccaaaacaaaatccaagtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacctacagatccacgtcttacaaaaatagaaaagattacaaatgcagcggaaaagataaaagcgagctaaaccggaaagcttgacttcagc

SEQ ID NO: 55152 - DNA, 153 bp, Oryza sativa
ccctccctcgcccataaaagcactctcccgagccccctctttcgttttccctcattcgccgcgctctcccgtgcttcctatcgtcgccgcgccgctcgccccttacgccgccgcctaccgccgtctccggccgcgcgccaccgccgctaaagc

SEQ ID NO: 55153 - DNA, 1501 bp, Oryza sativa
ataccacagcagatggccacaccttgcccttcttctatgatgacaccaatctaggatcctgttctagagccgcaagtccaggaatttttagctcggttgaatagaattgccaaaacagaatctccaagtcacccctacctttatccaatgaagggtatactggacaagtttgacttgctctgtaaagcaaagggtatcatgcaaactttgatccacgacaagcctattcctgctgctttaaagatatccaacttttcggcattggtcctgccaagaaagtccatctatggttccactccttaagtgggccagcatgaatctaaatgggctctgcaaccttttgagtctattttaccccctcaagaaaggatgattgaagatgtcattccaatcagtgtgatgccccctactagcccaaccactgtggctagtcccatcagtatggcacctgtggccctgctccccccaaggcacctgtaaagaagtgagatgggaagaccattctctacagtccctacagaagacaaagctcaagacttctgcaaggaaatgcaaccaaggatttgcagatggacccaagaatggggattaggaagccaaggggaaagtctgctaaaaagctaaaagaatttgcaggtattgcaaaactctttattgatagcagtttgcacgagtctgatttcaatgaaacttcttatagtgatatgaactctgactcctctccctctgattgttcactttcggtcatacaaaagatgggggtggacatgtgcggcctctctcctaaggaggtggctgaatctagcctggggggtgaaagaaggcagaagatccccaggctaaacatggaagataattgatgaagcaatattttgttctgttggcaggcctatgttttacagttatcatgttacaagggtctgtaatctgtatgctgtcaaagttgctttaccagaattttatcctgtcagcatgtcaacactggtatgtttgtcttttggattggtcctggttagctatgctagccttggtatttttgccccattctcaatggtgtgtaaatgactagtaattttaaatcctggaatgttttatgctggaacattagaggaatgaatgctgagaataagctcctgtctttaagatagaaaattgataagagtgattgccgggttttgtgtcttcaagaaacgaaaaaagagaactttgacctttctgagatcaaaaaatttgctcccaagcgctttgactcttttgctttttccccctccatgggtgcttcagggggaattttaattgtctgggcttcaaggacctttagtgggattctcaaagaagttaaccctttctctgtgacagtagaattaacttctacatttacttcacaagtttggtccttgactagcatgtatggcccatgcaatgggcctgaaagaccagactttgtgggctggttaaaaaacatccagatcgatgctcaacagaactggctctttctagg

SEQ ID NO: 55154 - DNA, 1501 bp, Oryza sativa
cataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagttaaagcatcttttataatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccattacagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaatattagtaagtcattagttatcccgaatgtgtactaatgtttctaagcagggctaagcaattatatctaatatctagttgaaccaatataaataaagctcaactagtcaaattgtaataacccaaggtatcaaggaatagagtaatcaatgcgaacaggccataacaaaggaacaggttcacaccacccggtgacattcgaaaataaatgcacagttgaaataaatagagaatttaaatataggatcaacatgctcaaaggattgtgtttaggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcacgggcggcggttcacgcgaacggacggccgagatctaaccgatccaagatggacggccgagatcgatcgggtccacggcggttcacggcggacgaccctga

SEQ ID NO: 55155 - DNA, 1501 bp, Oryza sativa
atggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgtaatggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctttaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattcgaacagaccacaaaggagtaggagcgatccttaagatgagagatagcgagattggcaggagatcagccaatggccgccctaagggccaaagccaccgaagaagaagtgagatgaaagctagcacggggaagatccacaactaatcggaaaggtgttgaactgaatttcgaagaaaaatggaccggcgaacggaagcgacgccaggcctcctcacgaatagcatcgccgggagagattccatcctcccggtggtgccggcgtcaccatggacgagatcaccggagatcgcccatagtcgcacaccgagaaaaccggagcctagcccagtcccctgaaaatgtagttccgacacaagttgaagacatggtgcatgacgatggttctgttgaggacaaaatcgacctagaggaaatgttacgtcatgcagaacccgaggtgctgatgggatcggctagagggttaaataactttgaagctttacaaaaggcagcaaaggaagttttgtacaatgagtcgaagg

SEQ ID NO: 55156 - DNA, 1501 bp, Oryza sativa
gaatccgttgcatattgtggatgtcccgggtaagtttgtgaatgatttcctctcctccgaaagggaacgaggtaagttagtgaagttcttgtgctgagattctagaggctttccaagtagagcaacccacacttgtggtggatttctagaagtaggttgagttggatcttggtggtcactcaattctagaaacttgcctaggggtgtttggggttgaaggctgtggatttcctctggggtttttgcacaagtgaggcaaggggttaatcgagacccagctctttggagctcctcaacggagagtaggatcgcaagatccgaactttgggaaaaaatcgctcttgtctctttctgtgatatttctgtggatgattctgtgatatatcctcttcttagaatacctgtgcaccatcttgtgaagattggcttagtctcctgtttttaaatttgaatttcatctctgttctgttacccggaagttcatgtcttagaacaccggaagttccgggcctgggaggccggaagttccggagttccttaccaggaagttctgggtctgtttgaattttaccgatgcgatttgtttttaagttttcagggacagcctattcaccccccccccccctctaggcttcatcagcgcgttcatttctgttttaataattaacttttttttgcatatgtctttcttgaattatggggtggttcttatttttttggtatatgtaaacagaacctgaacatcagatttaatgagagattcaaccaagaagctgaaattttttacaactgatgtgcattgctaaaccagttttctgttgcataaagagtcctgaaacttcttgttgcaaactgaagtgatgtttaacaattttccattggagctttcactggtttcttcagaactgaaatcttgttttctcatcagcttctcttgcatctttctgcaaggtttctttcatgtagggaaaggaaatgtgattttagttacctgactgctgccgcaatctgcgaagcatctacaagcgatgccatcggttcaggcagctggcacggcaatgccggttccccttgcctccatatccaactcctcttgttccatttacacctcccgatggtatggattacaacttggcactgcaagaacacagctacttttttgagttttttttccctgatgttggttggtcacctagaaatgttggcctaagtgttatttgatatttctcacgaccattcaaaaaattgaatctttcccaagatgtacatgccatagtgttcgccatagtgttattgttcctggttcagaggttgcagtttattctgctcatagaaatcctgaaagtttagagaactccctgttgagaaaatggaagtttttttactgctgagttttgttgtcttaaaagaaattaatgcatggtagattcttttgttgtctgaaaatgaaaatgttagctgctgaaatgtgacattcagtcagtctccgaactctgaagag

SEQ ID NO: 55157 - DNA, 1501 bp, Oryza sativa
cgggttctatagtctggaacctccggaccagtggcagtgaagacgtgccaacggcacaagtggatgggatcgatgctgcgggcactttagagcatattgatcaggctcaagtccccccagtgcaccatccaaggatacatcacactgtccaaagagatcatcccgccgacaacatacttggtgacataagaaaaggggtaactactcgctctcatgtcgcaagtttttgtcaacacttctcatttgtctcttctttggaaccaactacggtggaagatgcgcttgtttatccggattgggtgatggccatgcaagaggagttaaataacttcactcgcaaccaagtatggactttggtggagagacccaagcaaaatgtcatcggcaccaagtggatctttcgcaacaagcaagatgaatatggggtggttgtaaggaacaaagcccggttagttgcgcaagggttcacccaagtcgagggtctcgattttggtgaaaccttcgcacctgttgctcgctttgagtcaattagaattcttttagcctatgccgctcaccatgatttcaggttattccaaatggatgtcaagagtgcctttctcaatggacctatctcagagttggtctatgtggagcaaccaccggggttcgaggatctaaagttgccaaaccatgtgtacgagctccacaaggcgctctacgggctcaagcaagcccctagagcttggtatgaatgtctccgagattttcttttgaagaatggttttgaaattggaaaggcagatactactctcttcactaaaaaatttaagagtgatttattcatatgccaaatttatgtcgatgacataatatttggttctactaatgcctctttttgtgaagaatttagtagtatcatgactaaaaggttcgagatgtctttgatgggcgagttgaccttcttcctcgggctacaagtgaagcaagcacaagagggcaccttcatctctcaaaccaactacgtgaaagacatactcaagaagtttgggagtgagctcaatatcttagactcttgtaacattaggtgatgggtggttggctaattcatagccaaacatgtatcactaaaatgtaaatttaaaaaaatatataaaaaaaattgagcttttgtgtcttgagatcacttcttgtgtagaagatggtcttgataccaagaataaagctcaaacattccctctcttatccaaaaacccttttgtgaaaatttgcaaaaatttttgtgtgtttttattgcgaaaatttggtttttatcctcttcttatgatgtatattgaccattgttatgtaatgttgattgttggctggtcatatgcatcataagtctctatatgtccataggtttctatttctaatctattcctttgaattctcatctattcctttgaacttgggcctgactgccttctgttctgtcaggccggaagttccagtcatcccagtccagaacttccgggggtcg

SEQ ID NO: 55158 - DNA, 1501 bp, Oryza sativa
ggatttgtccaacaccatattatttctacaaagttatagagtccaacatatagcaaatgccccataaatttgttagttttttcatcaattcctacaagccaattctccaatatctctcttaaacttgtgttgtctaatttttgtccctcaacttcgaaactagatgacggcaacaataaacttacaaaactagacaaaatatgttcctaattggtttttttttaaaaaaagttcctaattggtattgagaatgattttgtggtgtagcgatcatatcactacctaggtgaaaccctgtgcattgcagcgggagtttactatgataacaataagtaaaaaacaatgtgtaagataacgtaaacaacataagtttacataagttgatatgatttaaatttaaatagtatatagaatgatgattcaaatttaaaagtaagatgatgtggctttatgagagaacaagagaaggaagataatttatgcatatatccaagggctaaaacaattgatgtggtatggcttaatgagagaaaagagaaataatatttaaccaagtgaggataaactatatagatatatagaatattaaaaaaatgatggagagatatattgaaatattatgtaaattatgtggaatgatttaacatgcttacattttatatctctaaaatttaataaactataaagttatagataatatagagtgcttgcataatacttaaatgtaataattgttagtgaatgatgatatggcatctttgcatgttaggcttttatagagttatagataatacagcatgcttgcatgatgtttaaatgtaataattgttagtggataatgatgtggcatctttgcatgttaagcttttataaaattatagataatatagcatatgcttgcctatgttacccagtaacccagatacggcgatacggggatacgcgtatatatatattaatatatatatatatatatattaaaaaatacaaaaaaaattgaagagtaaactagacaattagcagagcagagcatgccaacaccaagcgaccaaccatcagattccattatgggctctatcttcaattgagtcaaaggaattaaacccactctcagacaatgaaaaatctgcaaactgttgtttgatccttcttaagtcatcctcagagaaataccttctaaaacatttatttctcatttctaaaatctctgcatccatatgagagccttggctagttggaacatcctccgaccaagtttcacaataatacctacacattgtaaaaaaaaaatcaagctgctagcaactattacaagatatggaaaaaaaacaaaatgaattagaactttattggggtttagtgagtgtgccaagcaatgcaggggagtactattttttgcccatcgagagtgtaagatctcattcacatgaaagaaaaaggaagaatgctcatcgagttctttcccttcacgatagagctgcgcctggcagagccgacagcg

SEQ ID NO: 55159 - DNA, 1501 bp, Oryza sativa
attgatcacttaccaatcaaggctagctagcaggtttagtttccaaggatatgtttcctttcaatgttccctgtgccaacctcaacacttcacccatcttctattgtacacaaggtccaacaagagttttgcaccaaattacatctgtagttagtctaacatattccatgtatttgcattattttatcaatggaaggatttgtccatacacagagaataactcgatcagtttcttttatctcacaagcatacttcgttcttgtatatgcaaactagctaaggattcataccaacccagtccagcatcagcgaaccaaacatgtggagattgatctacactttgtacatgatcatgttgctgtcggatctgtttgtgtgttcatgtcccgacgatgtcacattatacggatatcttcaccaagggtttgtctagtaccatcttcttagagttccgttccagtctcaatgttcggacacccgccgggccttctatccggtgcagtcccaccgagccaagggtcttacaacaatcgcaccgaactaccatctctaatccaccactggaacttctctttaatagaatgactggggtgagagggttagtatcttttgtattttggcatgcttcatctcttgctatctagccaatatctctcccgattctgtttctacataaataagttggttgagtggttaggaaaggacgtgcttatatatgtactctgcacactgagatcaatatattgcattgagtctatcttgctctcaagtctccttttcttccctgcaaaggatcccacagacccctagttctctctcccaccctagccaccaagcacaagctgcattatgggtcaacggcaacatcaagctatttcttgtgtagagaaagccctaggtgaactcctcgtaccacaagtttcaagcattcaatttttaatttcgtttaaacggttttccaatatagggtttcgaatttaacaattcagttgaaagcaattgataaacaggtggtggggttttgaggaaatgtaaatctaaatgcttcaagcttgataaataggtactatcaaaattaattttggtagggcaaaatttggctccaaaccaaacatgccctaaaaatagctatctatctattatatactataagtccattaaacatattataaacgctcctaagccgccacgtggcttttctacaagcgctcctaggccgccgtgtggcattctacaatcctactattgattttcatttaaattggtggatccattattctataccgtcggattagatctatttaaaaattttatgctttctatatccaagataatccgtttactggaaatatttacgtacctacatgcaaatagttacattcgttacgttgcatgaaaatacgctaaaaaaataatgacaaaaaataatatactgttcacccgtgaaaaaacaaaggataggtaccaatgtacgcaagattaaagcctaaagcaaaatata

SEQ ID NO: 55160 - DNA, 1501 bp, Oryza sativa; identical to SEQ ID NO: 55154

SEQ ID NO: 55161 - DNA, 1248 bp, Oryza sativa
catggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctttaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggttgattcctggacgagggttcacacacaagtaagcgtttggaattttggatagaaattccgggcgtgacaagttggtatcagagcatctttgaccctaggttatgccaaatggttacccatagaagccctctgaaaaatattggaaaagtagaactgttctcctccctttctcttttaattaaaccaaactaatggcacatgcacttcataatctcttttaatggttctcattaaaaatttattccagtgttattagtactgtacatctactactgtactaatggctcatttaccagcaaaagttttacaatactgttttatttaatcttgctgcaataaaataaatttagcatgctgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttaga

SEQ ID NO: 55162 - DNA, 1501 bp, Oryza sativa
tttgaccctaggttatgccaaatggttacccatagaagccctctgaaaaatattggaaaagtagaactgttctcctccctttctcttttaattaaaccaaactaatggcacatgcacttcataatctcttttaatggttctcattaaaaatttattccagtgttattagtactgtacatctactactgtactaatggctcatttaccagcaaaagttttacaatactgttttatttaatcttgctgcaataaaataaatttagcatgctgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtctaggagttgcgtacgatgtcctttgtcattggatttgggactgctcctttttatgcccagattcctcatgatcgtcatgaagagaagtgacgagtcaaagtcaccttgaacagtaatagtgaagatatcccctcagtgatgtttgaagctggaggaagaaactatatccatgcatgtcaggaggtggcaaggatcgccataggagagctccgtgatcgctacagtgatcaattggccgacactgagtatcgccaccatcctcgccaacctcagggaagtgaccgtggcagttaccttgagactgaaggaattgagaatgatgctaccacgaagcatttggtggagatgttgtgggctatggatgaaagtcgtgcggagactgtgttagcagctcaagatcgtgaagaccggaatcgtggtaagatttgcaagctagaagacaaggtggatcgtttggagaaggaattagccgcattgaagggagaagcaccgccgcagaaggccaggattcgtctcaccgcaaggaagagagctctatttgtccctcgctatcaactggcgccaaaggttcgtgtggtggagaaagaagttgctccagctcaagcggatcctccggtcatcatcataagtagtgatgaagaagaagaatccaagcgcaacaattctaagattgagtgggtagcaactcaagatgatgaagacgagccttcaatcgacctccgatgcttggaagaactagagtgactagttaagtcgttgtcttagatcgttgtgttagtttgcttgcttaaagtttgcttgtgtgtgtgggtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcc

SEQ ID NO: 55163 - DNA, 1501 bp, Oryza sativa
gacagacttaccaaagtggctcatttcattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcgggacggatatcctaagggaagcggaagaaaaggtaaaggtcattcaagaaagattgcgagtggctcagtctcgacataagagttatgccgacaatcgccgtagagatttgagttttgaagaaggagactatgtgtatcttcgtgtcacgcctcttcgaggggttcatcgttttcacaccaaaggaaaattggcaccgcgttttgtgggaccttataagattgccagtagaagaggagaggttgcttatcagttagaattacctcaatctttggcaggagtccataatgtgttccatgtgtcgcagttgaaaaagtgtttaagggtacctaccgaagaagctaatattgagcagatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctaaaaattcaaattatataaattgttgtttaattggaatttctagaatttattttaaaaaaaagtcttgaaaataagatatagttctaattaataaaatccaatataaaaagtggccagataaaatttcattaaatactttgcttaattctataattcctagatttttctgggatttatttgagctaaggaagtattttaataaatggaattgcatttaagaaataatttaaattgaaaaaggttttaaaaagtcttcttttggctttgggccgaaagtcggcccaaaacctctcttctctctctcctcggcccagccggcccagtccgcagccgcccgcgcgcgcgtgcgcgttcggtcgctgacaggtgggtcccacctgtcaggcccgtcgtcttcctcgggccgaaaccctagcgcgccgccgccgagccgccgccgctgtttccttccaatccggccgtttct

SEQ ID NO: 55164 - DNA, 1501 bp, Oryza sativa
ggtaatcgctatcgctgttgtggcttccacgtggtagcccaatcataaaggaaattttagaaataaatatagggcccacatgtgactttctctctcctcatcttcttcctccactgctgccctctctcataccatcaccagatgcatgttcggtcaccagatccggctggccccaccttgctgcgagggtcaccttgctcagcttcatcatcgacggtgcaacaatgaccaaagcaaaccaatcagaacaaatccaaccaaatcaaaataatctcttctaatgagtgtatcctgggttgcctcgccagatgagctaatctctattcagcagcggttgtggcggtgcctgcctccccctcctccacatgctttgtcgccaactcatccggtagccgcacccatgttgatatacactgcatctgggccacttcttctgttccgctagccgtggtggtggaccaggaggatggagtcattggcaatggtagagatcggtgttcttgtggtggtgctaggcactagcattctggtggggaaagagaagagagggggagggtggacgaagaagatagagagaatcacttacaggtgggtcccacatctttttaatgtattctttaataattagctgccacgtggatgccatgtcagtaatacatttgacggagtaattttgcactggttttaatacttgaggtgtgtgaaatacccgttcttgtgcttgaaggatgcgaaacaaattctacctatagacctattgttgagggagttacattggacgttttacataatgtgaaacttcactgttcatgcctgccaatggttcgatcaatcttctagtagtaggttctagcccacctgaactagatgaaaccctagtacaactccatccatgtccactcttatccaaagttgacccaaagccgcgaaagggcctgtagcctagtggttacaagagcctccgtagcaccttaggtcttgggttcgactctccatgggagcggattttccaggatttaacggcatttgtgctttcagtggtaggcgacgtacccgtcaacagcgaggcgcctatggtgacttcgtcaatctctaggatttgccggcccagtcttcgaagatgctcataggggtagggtttgcgtgcgtgtgttcataggggtgagtgtgctttatactgtgaaattctaaaaaaaaaagttgacccaaagcctagccagatcactcagccttatagctagccaaaacaggcgaggcctggcccatcatggaatgggcccatgacgatgaggcccaaattggcagtgtcatgctagccgttccaaagtcggagcccaggctatgcacagtaaggagccaagcagtgtggagccgtcacaaccttgttttaggcacgtgggctaagaaaggcatgttagctcgtataaggcttggacgattgctgaaaaacaattaaacgaaatcatggagatggctatgattagggttttgtttgctgccg

SEQ ID NO: 55165 - DNA, 1501 bp, Oryza sativa
ggtcttttctttttttttttttcttgtggatcccggaaatgctgttatattctcaaacttctttttacaaccatcatggcacacagttagtcttatcatactagtatcatcattttaattagcttttatcctcctgcttcaaaccattgtttatcctcttatgccatctttttatcctcctgctttaaaccatctttttttgttaaactttctacatcaatgttttttcattttgtagagatcccaatagatgatgagcagtggaacgatggtttgctggcaaccatccgtgaaaaggtacttaatcagagcaccttaatgtactcatctctcttgtgacaagagacgtattatctgtttggtgcattttgagttttgtatgaatttgcttgtctcgtagaccaggtccatatggaggctgataggaaggccatggctaaccaagcaaatgttccagcagatcctcaattccagtcaaggactacatatagagtaaaaaacaaggtaaaacaggtagcattattctcagagtagtgatttgttcatgctatattgccctttgtgttgcgttacttcaccatttggtcctccaaatgctttctatgtaaagttagattagtagtggtagattaatgtcgtctgggctgagtgtgtttgtgatgatttttcattccgggttctgcacttagagtaggtaaaacatccgcacttgtgatcaccacaagttctagcaatcacacaccatttgaggtgccttttaccagatcgtgtattgccgtgcagtccttaggaatcaataaaaagtaatttatgtaggtactaggtccacattatgttaatgtttcctcagatgaaatttatcttcatgacatgaatgaaggcttgccatgctatttttcagcaatacacctattctgttctatttttcttaatttgatttttatcctgccacatcaaaactaaatttcttccctttgataggttatctattgtttggatggtgcgagaattggtatacagtatgagacttattttgctggtaactcatttttcattctcagtttttatttttatttttttaactgtaccatgttatatgcagatttagtgttttacaaggctggagagcacatttactttgcatcaaactgttttaatctctttgttttggcattttggaaactctgatatagttatacggaaaactggtacataaagcatatgtcatatctctaaccacattatttgctgttctaaataaacatgttattttgcaggagaaccttgtgaaatttatcattgtgttttggaaagcaagtcattccttgaaaagatgactgtgattgagcacaccttacctttctttctgccaatacgagaagtagaaagtgaatttctatcatctaatgctattgtatgttttctaactgaacttgctttttatatgccaattatttgcacgtctttgtacttacatggagctttttcttacagaaattta

SEQ ID NO: 55166 - DNA, 693 bp, Oryza sativa
atctgtgaagtgtaggagaggataagggatagggattatatactacgtattaaattttagtctcggttggtaatactaactgggactaaagatcaatataatttttagtcccggttagtattatcaaccgggactataaagatgatctttactcccggttggtgtcaccaaccgggactaaagatcctcggccccctgacagactactgacacgggatgaaccgagagtaaagatgatttttagtcccggttgatgttaccaaccgggactaaagatcataaaatatcaagtgtggtggtgaagtagtgtataatataactccacttagctgggtttgagtccataattatgactaaacactggtggagaaaccatctttcgtcggtcagccgaattccacaatagtcccggatgcaataaaaaccggggctaaagatgatctttagtccctgttaaaaagggtaatgggcatatttgatctttagtcccggttcaaatgctgtcaggtcctgtcaggccccccgggatctttagtcccggttggtacaaccgggactaaagatcatacctttagtcccggttggtagatctcagggatctttagccccagttggtaacacaaaccgggactaaagtcccacccctatatatatgtcttcttcctcctccagctgcccgagcaagcttcaaaa

SEQ ID NO: 55167 - DNA, 1501 bp, Oryza sativa
aacaatttcttgaaccattataaatatttggttaacgattgggatgtataatctctaattgtttttaactactactgaatcaattttctcttttcacagactatgaatgattatattatatattgggataattaaaaaaatgcaaaaaagaaaatacgcaccggtatgatttgcttattgttgtttgtgatgcctagctagttcatctcgtcatatcaccatgttggagccacgactaagggcgttgagcaaggacttcttgattcgtgcactgatattgtcgtcctgccataccttgctagatctaggaccctagagcttgtagtggctagatccagcaagcaccgagcatggagtggtcagatctgaaagtctttgttttccagtctacaccagagcaagaagcagaggatgaggcctcaatccgatctctgatgtcgccatcatattggcccatccaaggatttaccatgcatcaccgtaccatggagggggtgccagtggactctctgtctctcaatgcctaactggtttgaagttattcaggataccaaaggagggagcgaaggggatggtgatggatgagcgtcctgtgtgagcctagatctagaaaggggaaaggggaaaaggggcagaggtaaatagtgggagatatggtagatctagctaggacctcaactgaggaagagaaaagtcacctcagaaacctgtggggtgggagaaaagaggtggggtgtcgtaatataggagcggttggagctagagcacgttgatcttgctagtttgatctataatggtttaacacaaagaaccgttaaagattagcatatatttgcttagttctcactcaccatgtatgtactaaggtcggtcatcatctgcaagggagaataatattgatttagtgaatatgtactaaatctcgttataagaattaatactaatgtgtaggatatgctctttacaattttataattggtataagagcctagctagttcaatatctttaacctgatagatactagtgtcaaatcctaatggactataggtgtctgcggcctgcggagccatacacccaaggcaccgttggagtatggtgaaggggtggtgaacggttgagaaataaatatgtgaagatggagattgatgaatagtttcatgttgattgtagaaagggatggacctattttagagttggaaaggccctttacgatctaacatgatgttgtataatgatcagagttcagttgtgcgtttgtttcagaaaatgttcgggaggctatgcgtaaggaaataaccgtggaacttgtcagatcctgtttcagaagcagctcatattttgtgtatccatataatgtacacaagccttgatcggtgaatgtatctttgcttctttttttttactcaaaatctggcatatctactgcaactggttatttggccacggcctgagcatgtaaatacgtagtccaagagccagagcttgtgtatatgccaatgt

SEQ ID NO: 55168 - DNA, 551 bp, Oryza sativa
gtttgggctggctaggccaagaccacacaatcaagcccaacaatacaatgatagctaaatccaatagtattaaggactgagaagtctaacactggtggccggataaaccccgcgctaggggtgtgcgagatcacgtcgatctcgcagccggcatcgcgtgaccagcagcagctcacgctggacagttgcatgacgtatgcatgcatggcagcatgtatttggccagtggcgcacaacctctctatgggagcgcgcagtgccgcgcaactggcctgcaggatcgatgggtactatgggatagtgtcagtcatcggtcccgcgttttgatgttgcgctaaatagtcagtccaccgtttccattgcgcgggacgcgcatatttttacaattcttctaaaaacatgtatatagtcacaaaaacttcaaaaacaatgtatattttcaatttttttttctagggtaagccctttataattctaaattggtatgagagtctgactagtttaacatagttggcccaatggacattaaagtatgaaggtatgatgaacca

SEQ ID NO: 55169 - DNA, 1501 bp, Oryza sativa
gaaattggtactggacaaactgttcgaggtagcaagcacccggagtgtaagtgattactgggactgggatttcagcaagtaccgtggcatgtggttgcagtggtggctgcaggaggggagaatccaagctgacatagctcaaggaatactaactgatggcataaccgacactgacttgtattttccaatgacagtcattgtttggcacatcgcgacggagatgtgctggttcgccgacgaggatgactattccccatgcagggccccgagcatggagctgtcaaggtatgtcatgtacctcgttgcaaaacgggatgtgatgagtggcagcaatggacactttgagcttggcaaggcacgccgccaggtgaagcgcatccttgaaggacggggtatcagtgatgagagggggctcctgaagtatgcacgacaggcaaccggccaggtgaccgaaccatgcttcggtcgtggccgggcaatctctgagcaccttctcaaaataagcaacagagctctgcgctgggagctaatctccatgctgtggatcgagatgttgtgctatcttggacccaattgcggggctcagttccatgccaagcatttgagcactggtggtgagtttgtcacgcatgtcaggatcctactggttgttcttggcattccttttctcaggtctgacatgaaaccagggaaattctgagaaagaaactaatgattgcgcctgcagctttgtttcgagaaaacccctttgtatgtgtgtcactatgtatttatgttagcttgggctgtttgttccagtcgtatgtatctttgcataaacctaagtttcagaaaatgcctgattttctattatctaaagtatttacttggttctgttgatttgttgtttgttgtaagttcaaatcttgtgttccttatgctaaagctgctttcctcctgtctgatacgtcttagaaggtacgaatgattactctggcagtagaaaattttcactgcaaaattttagttatatctatagataatttttcgagttatggaaattaatttgtattctgtatcatctaggagtctctctctctctctctctgtgtagtgctatgtttaacttctcatggttgatctatttagagtttggaggatgttgaaacagatatgcaaacctcatacctgcaaactgtattcgattttcctgattctgtagattaacaaagaaatatgactgaatggagcatggctcactgttcttcgcctttttatatttaactaatccctctacttctccaaatagagggagggaagagacaagagtcgatcgtatgccaaaacattgactcttggcacgaaatgcgagagaaaacatacacagagccatcgtttggcttattcgtggaataagcgaaacgacatatttacaaacgaaaagtaatttgtgaataaaacttttatatacgtgtccttaatgatctaaaagcaaaggctgaaaaataaacttcgatgaaaa

SEQ ID NO: 55170 - DNA, 1501 bp, Oryza sativa
cgtactgaactgatgttgatgcatggttctagcagaacaatttgtctgtttagtttttgttttactcaggaccttttgaatgcattacttcgttaatgaattggagggcttgtcctgctataaaaaaggtggcatgatgacataattagttcgttaggagttagttaattacaaactaatcagctatacttagttcttctcttttgctactcaatgcaggttgataaatactacctctgtttcaggttataagatgttttgactttggtcaaagttaaactgcttcaagtttgactaaattgaagaaaaaataataatatttttgacctaaaataaatttattatgaaaatatatttaattattgatttaatgaaactaatttgataatataaatattattatatttgtatataaacttagtcaaacttaaatagtagttaaaacatcttataacctcaaatggagcgagtagttagatttagagtcagcctcctcaggtctgaccatgaggctcctggtcagattgaccacatgctaccagctggatcagtcttaagctaccagtcgacactcaagcacttgggagtactgagtaccccattatgtgggatcttgtccatggctgcttcacccatggtggattttgagagatccactggacgcctggtgaaaatggagatggttttggctacggttttacctggtgcagataaggtttgagagcggaaggggaggaaagtgcaacagtgctgcaaacagaactctcaaataaatcttgtaagtggattttataagccacaaatgatgcttcgtgtttgagaaagaacatagaaattttcaacaaaagtttagttgttttctctttgtgatgtctgttttttttacctcaatccaaataaaaaaaattataacattgtcatagtcaaagtttcaaaagttcaaaaaaaataaaataaaaggacatatttgtgactagagggagttctatttgttcaataaaatattagtcttgtttgtgctctagcaaacaaaaatcacctatgtgtttgatgaaaacaacaataaattcacaagttgaaggtagatagtatctacatctatctacacatcctacaagaaaaccaggaatatcatgtgaattttcttgattcttcataccatgagtggttcagaatttcagaaccaaacagcccaattatttcttcgaagacaaatttcttcaagtagccacatttcctgcgatgctaaagaaggacgagataacaaaattaaactttaataatatctttgcactgggttcacatcctctgctataatagcactaccattacaggcactgacgtgtggagcaataggaagttggaacccgcatactagttactatgatggtagtgacgttatggtagacgatcctcacccccaccgaacatcggtgtttggatcattggatgacaaatggtctatccaatgattacccattgcagagcaccatctgtcatg

SEQ ID NO: 55171 - DNA, 1501 bp, Oryza sativa
gttttcgtttggtactgatatttgcatttgaggaggagtccacattataggtggcatcgcacacagagatttgataaagttgttcccgtccaacggcgagaccaacctctttattatcatgcataattatacatctattgtttccaaaagtacaatagtaaccaccgttatctaaacgtgaaactgaaactaagtttcttttcatagagggtacataaagaacatcatgtagctgaagtttgaagccagtatgaagtgtgagagtgaagtctccaatagcctcaacttcagtttcaactccattagcaactctaattcttctttcccctcttcttagggtcctcctcatagcgaatccctgcaaggaatttgcaacatgaattgtcgctcctgagtcaatccaccaagaattggtggcataatcaatattcagggattcatcaacaaaagaaataacatcagtacctttcttactgagccatctcataaacccaatacagtctttttggcggtgtccactctttccacaaaagtagcacccatccttttctttttccttttcttctgtatagggatttcctccagatttattctgctgggattgactcgaagattgccctttttctttaaactgaataggcttaggcttcaaatactccttcttaaatttcttatactttttcttctcagagtgtttaaatagatttgcatgatcaactctttctgccttaagcctttcctcttcttgtacacacatggctattaattcatcaatgccccacttgatcttcattgcattataattgattgtaaatggagaaaactcctgaggcagagatgacataatgaaatggacaagaaaaccttcagagatttccatttccattgatttaagcttagaagccatatgacattttttcataatatgttccctcagatttccagaaaaatcatatctttcattaaccaatcttttaataagagtggtggcataaaccttagaagagcctttaaactgctcctcaattttagcaagatattctctagctgtctgagtatctggaactgctactcttattgcgtcaataatggagcttttgataatcataaggcatttacggtttgaaatatcccattttgcctttacttcatcatatatcctttttagggtctcataattctcattttccggtctaggttcaactggaggatcattatggagggcataatcaatatccaacatagctagagtaatttccagcttttctttccatgaagcataattacttccattaagttgttcaatatttcccattattccggaaatttgtgaggcataagatgctgcataagagagaatcaacagctaaataagtatcttcttttattgatcaaatccaaaacagctttggccagagaaggaaatgaacaataaaattttgtgaataagtatttattaatcagctttggccagaataataaatacaaaccacactttatt

SEQ ID NO: 55172 - DNA, 1501 bp, Oryza sativa
atgcattgaaatattagtgtcctagaaatgctttatatttgtatataaaatttgtcgtagaaatacttatttcgggaatgacgcagtagcaagagatgtaaatggaggaatgttgtaattgattgacattacaaagtagacgaagaaattaaataggatatgactatgttggttaagatgagagagtagatgtagaaatagctatagtttatgataaattttgaatgttaaaacacctatattttagaacggagacaataataacactaagtgctcctaagtgtaaggtgtgcgtttgtagggactgttttaaaataaaatggtacatagtgtatgctacttagttgttgtgtgttgctccaataccaagcaatcaaaagtagtatacattatagatataaacttgcatataaattcaatacaaatttacggtaagacatcatattttttcctttatttagtcaggacattaattaagcaaacatatatatagtgttaaaaagactttttttaacggtagtgttaaatagactaaccacatgagttctctgctttttgaggtctttagtctggaagcatccggattggtccaatgtgtttccactgtcatagatgagcatgatgatccaactgtgtattttcatttaccagttcatccaacggtccatacattgtagatgatatggctcatcctcctttcagaaagcttgttgctttcatatatttagattttactcagggccttttaaatgcttgaattcttttctttaattaatggagggcttgtcctgatcttaaaattaataggcataatgaaacatttaattaatcagctcaattagtccgagagatggtgcccctttcttttgacaaaattaatagggattgttctttatatattctttttttaaaaaaatatgacttgttcctttagttacaagataaaacaaaaacatcaagagatataagggatcggctaaaattttaagggcatacaaagaattttctctataaaattagttggtgatttagtatgaaatctaaaacatcaataatattgtctagggagagtattatcagctctgcctgaaaaaaaaatcaacaaaaaaagttccgaatgatatattggtagtcctgaaaggaaaaagtcacgctaggaaggaaaatggttagagcaagtttaatagcatagtcaactactagctccaaaaatcatatatagtcaatttaatagttaattcatataatagttatatactacactattaatacgtggtctcacctatcatacacactgcgtcttggagtttgtgctacagctagctacaaatctctagcccgctgctcttctctttcctcttttatcttcttaaaatatgtttatagctggtttatagtgtgttattgtactgctcttaggctgtgtttagttcagcgcaaagtttggattttggttgaaattagagatgatgtgactgaaaagttgtgtgtatatgacagg

SEQ ID NO: 55173 - DNA, 166 bp, Oryza sativa
ctctagactttgggaatattctcatcacctggacactatggaatggttggattattgtggaattggattcacacctccccctctattcaaaatcctcaaaatggatttaggctgggctcggggcgcttggttttgatagtagcgcctcggccatataaggaccggt

SEQ ID NO: 55174 - DNA, 1501 bp, Oryza sativa
atacatagatattgagtatactagtagctttttttttaaaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggataagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaatta

SEQ ID NO: 55175 - DNA, 1501 bp, Oryza sativa
aaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattat

SEQ ID NO: 55176 - DNA, 1501 bp, Oryza sativa
  unsure (1)..(1501): unsure at all n locations
acaattaaatgttatttggaacctcagaatcagtaatccacagttgtttggaaacacagtaaagtttcaaactatggatctatcaaatacacatgccattttgccaaagcacatgaaatctgttggatgacataaaatggataaaagacactagctggtcagtctgcttcatcaggatactagtttaccatgacaaaaccatccggctagaaaatcagatagcaacatttaacatgaaacaactaacatgttatttgaaacatcggaactagcaatctagctgcaatggtttgaaactggagtggattttgatccctggagtggatatcccctcgttgcttgcatatcactcaaatagttatgacnatgctctaactaaataaatagatgtattaacatgttatatataactctacaaacatgcaagttcaaattcaacttctacatctcgtaacgaagaaaaacaaatttgattgtgaatatacgttaactagctatagtttaatttgtttttttcgttacgagatatagaagttgaatttgaatttgcatgttgttgagtgatatatcacatgttaatacatcttctctaatttttttttaaatttttttcgtaaccatttgagtgacatgcaaataacgaggggacatctcctcgagatatcaaaattgtttcataacaatgtagtaaaactaaacatgcttacatggatattgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggttgggtgtgccagtcaggccggcgtgtattggcgcggtcagaccggcgcagcccgcggtctgaccggccgacgctgtgtcggtttcggtttcgggttgtttctttggatatccgtgattgttttatggttatggcttctagatggatattatacgtatgtaatactgttgtttgctactaatgagtcaagttggagatagcttggtttcggaatatggtttctttgtttgtttcatgtgtaagtgactcgatgcctcgagagagtatttgcggtgatggactgggagttggcttggtggtaagacgatgtccgtggtggtcaaacatcatgtaggatactaaggctagagttgatgcacgtggttgatggagatttcatatggcatacgatggaggtattgtgtgcgtatgggatgcggagtcgaatttggaaggagtccaaattttgtaaggagtgatgt

SEQ ID NO: 55177 - DNA, 1501 bp, Oryza sativa
ttcctcttcccaatcggttcaaagttctggacttctccaaattttcaggacaagatgatgtgtcgacttatgagcacattagccgattcctagctcaatgtggtgaagcatcggcggtagacgctctgaaagttaggttattccggttatctctgtctagatcggcttttacttggttttcctccttgccatatggttcgatcaacagttgggccgatttggagaagcaattccacaactatttctacagtggggttcatgagctgaacttatctgacttgacgacgattaagcagcggcatgatgaacctgtgcacgagtatattcagagattcagggagatgaggaacaaatgcttcagcttgagtttaactgatgcccagttagccgatttggcctttcacggtatgattgctccaattagggagaagttctcatctgaagactttgatagcttgtcacatctgatacagaaagtaaccctgcatgagcataggtctgcggaagttaggaagagctctaagagagttaatcatgtttgtccgtacatgtatggatgatgaggatgatcctgaaatagctgcagccgaatgggtaaggagtaaaaaggtcgtaccatgccaatgggtgaaatgttctggaaaagaggagaagtataattttgatattactaaagctgacaagatcttcgatctgctactccgagaaaagcaaattcaacttcctgctggtcatacaatcccatcggctgaggagttaggcaaaaagaggtattgcaaatggcataattctaggtctcattctactaatgattgcaaggtttttagacaacagattcaggtggccattgaggggggcaagattaggtttgatgattccaaaaagccgatgaaggtcgatggtaatccttttcctgttaatatggtgcatacagctagccaaacaaccgatagggcccgcgcaaggggttttcaggtgaattcggctaagattatcaacaaatattagaggaagtatgacaagcagcaggagaagcattatgaagaatacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgatgatgttgcagccgatgaggcaaagaggttggcaaaagggaagagtgttgtgacgg

SEQ ID NO: 55178 - DNA, 1501 bp, Oryza sativa
atacatagatattgagtatactagtagctttttttttttaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggttaagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaatta

SEQ ID NO: 55179 - DNA, 993 bp, Oryza sativa
gcgaccataggggcgcgggcgcgccgcctcccgtcggctgtgccggcgtggccgccttcgggcgtgccccgcggctgccgtgtggggcccggctgtcagccgcccgcgcccttaggtgcggctgacgcgtgggacccacggcgccggccggtgcgagcccgggtgcgcctggtccaccgtgggccgtggggctgccgcgtgggccccaccaccgtggacccggtccgcgcgcccctcccctcggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaatgccttttcttttctgttggtcgtgtagacgctgcagcttcggaagatccgctcttcgtggaggttgaagccggcgtttgggaaagcgagcaaggcaagtcacatcatccttgaacatattgaatcccagtttataaaattatgttgctttaaattattgcattatcgctttatttaaattcccgcgttatcactgttttatctagccatgcctatttagctttgttatgaccttattattgttattgttattatttccttgttcaccctagaataaacaaaaccccaactagtggacactctactcatggtaccactagtatgattttaggtagatgcttcgctatttaattaggtaacattaggtggttttacaactctagactttgggatattctcatcacctggacactatggaattgttggattattgtggaattggattcacaccgctccttctattcaaaatccccaaaatggttttaggctgggctcggggtgcatggttttgatagtagcacctcggccatataaggaccggt

SEQ ID NO: 55180 - DNA, 472 bp, Oryza sativa
ctctaaataaaaattcatggttattttattttattttacattgggaagcaaaagatcacaattgttttttttggtatgagtttattttattctgttttgtacctttgtaaaagattcaacaaaagccgtagcgaaaacagttccaaggttgaagaaacagaacatcgaattaacagacaaacaagaaagctggaattgatgtggtagacagtaccaactgccaaccaatatagattgcaatacccgagctgttgtgtctacgacccaattaagcaatgtctattagacggccggggcgccatcaatctgcatcatcacgctgctgtaaacctcgatcccaaaagtgtagacccgaccacgttgggcgccgttggccaagctccatcacccatccactgtgcagaacatggatgatacatttcatgcatatatcatcagcgagacgtacgaaagctcctggcacgtggcgaca

SEQ ID NO: 55181 - DNA, 1501 bp, Oryza sativa
atccctcatgagtacttctgagagactgggcgcacatattttgagattgacaaagtcaccacgagcgcttcactgtcgacgggtacgtcgtctaccactgaaagaatttatcaatctaggacttgaacccgagtgggcaagttccaccacaagaaacctaaccagttgagctacgttcacttcgtaataatattggatattaaaacaccataatttttaagctatattcctggaatactcctatgttttttaaaccggtggaaccattatttctaagaaaaacaagtgtgtatttatggtacatcacatttttaaaatattattgtgcaattatattttatcattatagtattcaggttaggttgcatagaacctcttacccactctacatgaaatgttcatagatggaccgtctctcaaactacatcaatcatattaggctatataaaatttagtggattcatgtcccacccaattcatcctctaataaaccatgataatatatatacattaataaaacattacttttactttacacttacttttatttccgttgacatgttttctaaagaaaattagtctaccatcttttcaaatgacgaagaagattataaataattgcttatagatatcacttaaatataagcatagagcaattttgacaaattgaaagctgatttcaaacaggagtttgccttgcatatgcatagagcaaaggaagctggcatctcgctttggcaatcatggctagataattttcattagttttcccttgtaattatttgtaatctttgtaaattcacccatttattatattttaatatatattgcaataggagcctctcctgttgtttcatgtcaaaaaaatatcacttaaatatgatataatataaagctaatatgttaaaaaatataaaaacaactaatgccgacgaaaacaacggagaaatcgtggccggttaatattttgctcctataagtacgtgtctcgaacttaacgtacgacgcatgcccgcgcatttgcgcggactaccttcctaattaatataaaaggagctaaagtaacttataataatataaaacagaggtagtatatacttggtacccactagttataaagttgctacgatgattagccacatcaccgcaattacctgggaccattagatcttaaatcaacggaaaaagtacaccgaaggtccctcaacttgtcagcgagatacaaaatcatcctcgaaccacgaaaccagatatgcggggtcccttaactatacaaaaccagtcacccgagatctctcggcggttttaacgccggatttctcctacgtgacgaatgagtcagcgtggaacccacgtagaacccacgccacctcatctctccctctagtttcccctcttctccctttctctccctctcacttttctcagccggcgacagccggcgacaggcggcgctgtgggggaggaggccaccggggggaggggagaggaggaggtccgg

SEQ ID NO: 55182 - DNA, 1501 bp, Oryza sativa
ccgaaggatctattgtgaccggttttaattagttaagggacgccggatatctggttttgcaattgagggacgattttgtaactcgacgacaagttgagggaccttcggtgtactttttcctttcaggagtgcacaaggccaccatctagaccaatcaggcccaactaaacggcctccgctttcacccatcggcccattattgttaaagtcccgcatgttcaaataatctattgtgcccatgaaagccatctgaagagcagttacgcaaaaaaaaaaaaaaaatcatgcatcatcactaatggtgaagatcagaggccatacttaattctccacccaaacctctttcaattcaccgttattgtcttttggaaaaagtccaaatacccttctaaactttcgatggaagtttgtctagcactctaaacattaaaaccggacatccaacctcttaaactttaccataccatccatatataacccctaagatgttttggatgacggttttgtatattttgaaagcttaaatgggtaattttaaataactaatataacatatttgcatatcatcagttataagtcatcaatttcttcttacacagtgatatcatactattattacgttggtatttgtttgtaaatgagagccaataaggaaaaaaaagaaagatttaagtcaaaattttaatatatatgtccaaagtgaatgacatgtgagcgaactcatccaacttatatacgaattagatgcaaaccattatgcaaaaccatcttaggaggttatataaatggtattgtaaagtttagggggttgaatatccagtttcaaaattcagggtgctagatggacttccatccatagcttagggggttatgtggactttttccttctcttttatcccagctgaggccacacgctaactccatgtgtcgttgtactaattaaattcaaatagcccacaatatatgcgagcaccttgtttaatgttgtttgaatttttattacgaatgtttatgtgtggataatatttttttaaaaaaatgacttcatttaatttagacatgcatgattttgatccatccacataattataagcatattgtataaaagcaaaactagaagtagcattggattattgataactggctatattggagtcaattttcttaacaatgtcatcatatctactattaaaagcatcttctaacgtatcatcaaatttatagatataagactaatagatatatctatacaacgatcaattgattttttaatagcatagggtagatcgggtggatcggaggttatcttgtgtgaaactatgacatgaggtagcaggatatctctttttggagatgtcttgattgatcttggcatagtgtgcaagcgttgtcttcttcaacgccaccatttgctcttcaaagtcttgccgctcctcctcggtcaagtcctccttggtgagattgttatcgatcacgttcttgcttatcatggttgatgcag

SEQ ID NO: 55183 - DNA, 483 bp, Oryza sativa
tatatatatatatatatatacatacatatatacatacatacatatacatacatacatatatatatacatacatatatatatatatatatagtaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcct

SEQ ID NO: 55184 - DNA, 780 bp, Oryza sativa
tatatatatatatatatatacatacatatatacatacatacatatacatacatacatatatatatacatacatatatatatatatatatagtaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatgtatatatatatatatatatatatatatatatatatatatgtggggatcattttacgatagggtcccaggctcccagctgcgaccgtctgctcagtaggtcccgcggtcccgccacgcgccactcgtcttgaccgcgcgctcggctgccgggccagcgcgccgaaccgccaatcaagcaggaggcgcggcgcgggcctttggctgcctccctttcccaagccgaaacgcacgattcgcgcccgcgcgcgcgcgcgtgccccctgtgcgtgttggtttcagg

SEQ ID NO: 55185 - DNA, 1501 bp, Oryza sativa
actttttattaggcataaattgacccaattaaacggtagacccaaaaatgcaagcccacccagcgcaaagctcgcgagcaattttttaatacgtaaaagacttacatatctttgcaataagacgagtaaagttgccaattacaactgaacagaaaaaaaaaaagaggaagtaggggaagggactgagtgcactctatctaatcagatgggctgacctaggactatagtggctacataagtagctagctgccgaaccacaacctttgtcaaaggctaaagagatgcttcctttgtcatcgtcttcgcaatatcgatcctgttccattgtcgttggttgaaaactcagtcattgtgttctttctagagatagagcaggcttcaaaagttacgatagtatcgaaccctcttctctattctttaggtatcttcttccggctgtcacataatccagctaagcgtgaaaggatgattcgctcaccggtaggcagttcgtgcgcccaaactcacacgagctaaagctcaagctcgctctagggcacgtgtcgtgtccagcgatacagggattagcggcgctgaaaatgaaaacaagcatcattagtgggatacgactacaaattgaacgcccggttttccaaaaaaaaaatttggtgttgtttcacctttttatacgaaaatatttcacaacattttaaatgatgaaacataaccaaatcacacttgaaacattccactacaacatatggtacattaattttgaattttttttaggtttgaattattgaaacataaacaaaaccgtgtgcatcaaagatgaaaatatggcatactatcaacatttgatccaaacacaaagaaacatcataagtacactagctaaaacataaaaaaaaatgaaataaaatatatccggtttggactgtatcttcttccctccgacgaacacaggattgccaagggttgtcggctcagtgctctcctccgttcttcgctggagatccacgccgagaaggtacaacgcccttctgctcctctgaggcgagcagccgtcgtttccctaggccctcaccaccctgtcatcgtttgctattgggagctcgctatgccatcgtcatcacttgggcaaaacggaaaccgcgccatctccagatccatacacgggatgccataaattttgacaatttaaccctttgtaaaaacttattacaagaataaatcgtgttaaaaacttattttaaaaatgaaccgcgacctcagtgccatcggaagtggcgctgagatccaacatctcagcgccactaattttagcgctaacctccgtccgaggtgtcataaattagccacatcatcatgggtcagcgccactctcattggcgctgaccttttcaaagcctaaaaggctctattggtgatgcctacctgaaatatactactagtgcagtggttagctctattggtttttagcactaggtcttgggttcgaagccttaagctagcaaatttt

SEQ ID NO: 55186 - DNA, 1501 bp, Oryza sativa
aaattgtcaaaatttatggcatcccgtgtatggatctggagatggcgcggtttccgttttgcccaagtgatgacgatggcatagcgagctcccaatagcaaacgatgacagggtggtgagggcctagggaaacgacggctgctcgcctcagaggagcagaagggcgttgtaccttctcggcgtggatctccagcgaagaacggaggagagcactgagccgacaacccttggcaatcctgtgttcgtcggagggaagaagatacagtccaaaccggatatattttatttcatttttttttatgttttagctagtgtacttatgatgtttctttgtgtttggatcaaatgttgatagtatgccatattttcatctttgatgcacacggttttgtttatgtttcaataattcaaacctaaaaaaaattcaaaattaatgtaccatatgttgtagtggaatgtttcaagtgtgatttggttatgtttcatcatttaaaatgttgtgaaatattttcgtataaaaaggtgaaacaacaccaaattttttttttggaaaaccgggcgttcaatttgtagtcgtatcccactaatgatgcttgttttcattttcagcgccgctaatccctgtatcgctggacacgacacgtgccctagagcgagcttgagctttagctcgtgtgagtttgggcgcacgaactgcctaccggtgagcgaatcatcctttcacgcttagctggattatgtgacagccggaagaagatacctaaagaatagagaagagggttcgatactatcgtaacttttgaagcctgctctatctctagaaagaacacaatgactgagttttcaaccaacgacaatggaacaggatcgatattgcgaagacgatgacaaaggaagcatctctttagcctttgacaaaggttgtggttcggcagctagctacttatgtagccactatagtcctaggtcagcccatctgattagatagagtgcactcagtcccttcccctacttcctctttttttttttctgttcagttgtaattggcaactttactcgtcttattgcaaagatatgtaagtcttttacgtattaaaaaattgctcgcgagctttgcgctgggtgggcttgcatttttgggtctaccgtttaattgggtcaatttatgcctaataaaaagtttaaagaacactgtttcttctttgattaaattttacattagactatttttttcacataagtttcaagtagagattttatacatttattcagttcatccgtttgaaggaggcatctatctttatacgccatcactctctactctctattactccgaattactattgagtatattgatctagacatctagccacaatcaggcaaggccatcagcccattacgacacagaaaaatatcttgatatctgcccacgtcagctataaaaaagtatcgagagttcttccaaaaaaaagaagaagaggcggctaaaagtatccaagca

SEQ ID NO: 55187 - DNA, 1121 bp, Oryza sativa
gcccaaacgctctcgccgtccacgcacgcgcagccaaggaggacgactcggcgagccgcgcgagggtggcgccgccgccgtggacgggttgctcggcgcggtacgtccccgtgccgagcaagaagacggggaggtacaccgccgtcatggccaagcacgcggcgaacccgagtgcggctcacgctgtcctcgacgtagctgagcgcgctgttggagatggcgtagccgcaggaattgaagaagtggtaccagttgaagtaggagctccgcgacgcgcgcgcgccggggtcgctcggcggcgcgaactggtcggcgccgaaggcctccgagcacgggttgtggaagccctgcgccagcgcaaggaggtagagcgcggcgtggaagaaggcgaggcgggcggttgatggcggcgccgccgccgcctccgccggcggggagcaggcggtggctgcgtcatggcagctcaccgggtgtgggtgcgttgctcgcgtcactgatgagatcgtcagcatccccaagctctgtaatttttcttaaggatcaaaggttaaatgtaaagcaacatcgaagaaagagaatgtgtttgctccctcaaatcatttctattcggattccctgtaatatgatatatatcacattcgacacttgctagcaagatcatagatgagcttcgtttgtgggaaatggcaggtgccaagggagtgaagtatattatgttaagagattaggcttttgttttttagggagtgcaggcaggaagagttcctccgggaacgcccccactgtcttctgttatgtacagtttctctcacttcttctataatataaaaccagctcgctgggttcttttaatatatatatatgtatatatatatatatatatatatatatatatatatatatatatatatatatatatatatatatatatgtatgtatgtatatatatatatatgtgtgtatatatatatatgtatgtgtgtatatatatatatgtatgtgtgtatatatatatatatgtatgtatatatatatatatatatgtatgtatatatatgtatgtatgtatgtatatatatatatatatatgtatatatatatgtatatatatgtatatagga

SEQ ID NO: 55188 - DNA, 1501 bp, Oryza sativa
ccaggtgcccgacgagctccgcagcgtcggcgtggcagcgtgcatgagcgtcgtcggcgtggggagctacgcgagtggcatgctcgtgtcggcgacgaggagtaggggagagagctggttctccgacaatctcaaccgtgctcaccttgactacttctactggcttttggccggaattagtgctttagatgtgctggtgttcttgtattttgcaaagggttatgtctacactaagaacaaagtcttatcagttgatatttaattgtagatggatcttttcgtctcaatggcacatcccgcgcgcgctaataaatgtcaaatgttatagaaatgatggatgaatttaggttgaaatattgtctggaaatgatgtgaggaatgataatttagcttgtttatatatatatgctgagttgcataatgtaatttcatattataagactttttagcattgcccatattcatatagatgttaatgaatctagacatgagagcgtggaaaatactagaaaatcttaaaatatgaaacagagagagtaataaattatagatatgttactatgcttgcatattaacctttagtgtttagcgggttgatgtgacatacttgtattagtttttaggattactaataattgctatatgttaatctttagatacttgatgagttcaaatgctaaagttgatgttataagaatagcaatgaaaaaaatacaagcagttataatctaatcatgaaatgcaactttagtttatgtttaacaatatctggaataataatatacagtttttatagaaagtggtattgtcggatcatattcagaagaacttccaatttaatcatgggaccgacttatttcaggcgtggcagttaattctgaattttaaattaatctgggttttttttttctcgtattctatttttcgctttgtcttttggaatggtaagagtagaagtacaaaagttttaacactacagtaaattttccctttgttcattctgttttcagcttataattaagctgcaagcctgcaaccatactggtgaatttttcatcaaacaaaaccataatggtgcatttcaagcgtgtcccattcaatggaaaattggccatcaaagttcatttttttaaaaacctcatcaaagtttaatttagagaaccgtacaagtaaggaaatgcatcaacatcgtagattgtgatttgtggtggcccagtttttactttttagtacgaagctggtaaccccgatgaacttatctctttctataatcactctgtactctatattatcttgattttctgatcccgacatctagccattaatggcgaggacacaattgcacacacgactcgctgcaaagcaataggtgcacgaaaatatcttgctaattccacacgtcagctaggacaagtgagcatcgctttttgtcaaaaaaatatatagatatatataggtatccaagcatttgtccacatcaaagcattagagagggagtgcc

SEQ ID NO: 55189 - DNA, 767 bp, Oryza sativa
attcctgcagcccgtcctcagtcctcacagttcattcattaatattcaggcagatggttagcatttggcatcgcattatagtcaggcctccttttcaatggaaggattttacatgaattttgaagaattcatgtgttccaaagagccattctttcctagagtcgggtcaggtcatcaagtgtttgaagtttaccaaaaaaaagagagtaccaaatcaacaagaaacactttttccttgtaacgaacatctcatcatcatcatcagctgacaagttcactaagcccacaaagcaaagcactgggcttgggcctaactaatactcggcccaaaattttactaatcttagcctgcgaccggcccgagccagcccgcccgaccactattcgtagcctcgtcgtagtcaacaccttgacgcgtcggacaaatcaaatcgtctctgtacatataaaaaaacaaaaaaaaaacaaaactctttttcaccccccaaaaattaccccagtttaccagggtcgaaaccgcaaaaccgcctctctctctctctctctctctccctatcttcgtcctcgaacaagatattttcagaccggaaaaggcatatacccccctcccctccccgcccgcgtggcctacccccttcgttagggtttcgcgccctcttccctctctcccttcccctcggccgtcggcccggctcctcgcggcggcggcggcggcggctcgctttctagggttagggttagggttccggcggcggaggaggaggaga

SEQ ID NO: 55190 - DNA, 471 bp, Oryza sativa
tcctgcagccctggtaataacaaataagtaaactctgcagactgttgaagctactgacctgaaaccaccacctgtgcgatgggatgaagacagtggtaggaggcctcatgataataacaacaggaggccttatgaaaacagcaacaggtacactatctaccttttgtgttattttgtcaatccttgcaacgtcattgaaaatcctaaccttctggtgaaattgtttaggcaaaacccagctggagcaatatctggccgccaacttggggaagctgcccaccgacttgtggtgaacagcttgaatgctcggagtggcggacaatacaataccccatcgatgccatatcaaaccataatgaatggcatgccttatccaaatgggattccaccaaggatggagcagcctgctcctggctggcatgttcctggtgatctaccaaatggtcaggtaccaccagcttatgcatcatc

SEQ ID NO: 55191 - DNA, 282 bp, Oryza sativa
cacagcgcagcttcgcggagacaacgtgagaaagaaagaaacgagacgaacgcgaggtggtggaggtggacgccatggccgccgccggcagcagcagcaggttcgccgtcacgtgcggcctcctcagccagtacatgcgggagcgccagcagccgcagccgccggtgacggttcttgaggcggtggcggaggaggaggaggaggaggacgcgcggactatgcagctcttccccccgcgcgccgccgccgccgacggcgtcgcgacgccgtcggcggggacgg

SEQ ID NO: 55192 - DNA, 1501 bp, Oryza sativa
ccacccgctctcttcaaccatccaccgcgccacgcgtatacgtacccatggtcatgcgatcccctgttctctcgcgcccgcgcgcccctcgcgaatccccatgtttcccccacaacgtcgcgctcgcgccaccaccactcgtgctacttatatccgtactcccacccaccccggcctaatgcgtcgcgtgctcagagtcatcacgtaccgaggccgggtagatcgatatatcaatggcagtgtcggatcatcattgcggcggcggcggccggagctggcggttcgcggtggcgtgcggcgtgctcagccggtgcgtcaaggccgaggcggcggcggcggccaacggtcgccaccgccaccaccccacgatgctcctcatgccgggagccgacgtcgagccggacgtgagggaggaggcggcggcggcggcgcagctgaagatcatgtacggcgggcggatgctggtgttcgacgacttcttccccgcggggggcgcggtcgtcgagctggtgcgcgccgcggcgcgcgccgggcaggacgtacgacgcgcgggcgcggcacggcggcgagtcggcgacagccgtgggctcgacgctggcctgccggtggtgaggaaggtgtcgctacagcgattcgtggagaagaggcgtcgcatgcggttcggggcgacggcgccgaacctactcgccattcgccgccaatgctgccggcaaggacgccgggatcaggccgcactgacgacgccgcgttccactgaattcgagctcccttccttttctttcgtgtgaccaagattcgtttggcttttgattcgaatcgtacgattcaaggccaatttactggcttgtctagaagtatatatggcttagattgcaataatttaggattgagattggtgaaatcgtcttgttatgttgtcttggaataatacttttgtttttttttaccttgggaagaatagttttgttggcatttcaaattaccaacgaggagtaaaactaaaccatgcaattttctacgcaaaatttgatacagaccatagaattaaatcgtcggagttgatacagcgctctagttcttcccacaagggtgaaaaagcctgaagaggggccatctccattggaccttcgtccatagggattaaaacggtaggaaaaatgcttaaaccatttctgttaccatttttttttctcggaaatgatattggaacgcaagagttagaaacgatgacaatatcgatccaaccggaacatcagaaaatattgatttagagttacttgtccttcgcccctttcacggggttatatatttatactcataggtccattttcataagggactcatggagataatcttagaaatcttcggtatagtactggggcaagtctgaatagaactctatggcctttgtatttgtcgacgtttgagatcgtgactacggtatttggatggtatggggatcgttggtactagggtatatgcgagattgaggtaaaagaga

SEQ ID NO: 55193 - DNA, 1501 bp, Oryza sativa
ggagtaccaacaaaaagaatgacatttacatatatatttttgagaatgaatcagacatataattaatgtgttatatattataaaacgaacaaagcaatatataataaaattttatattcagatgatttgtactggccgctccacgctatggatgctatggctagtccacatatcagcggttctgcttcgggtttccttgcctcctcaatttggtgcaacccagtaacccacgtttgtctaggacaatattttgtgaaaactccctgacatttttgtttctctctcttttagggtagtgtggttcttctagtatgcttacattttacttgattggtaatctgatcacattctatttgcattttacataaatacaaggtttgtttatacagatatgcatgagtattgtgttatatagcccaagatttatctatcgacctcttctacggtcttctccaattaatttttagcgtaagcatgcacgtgtgggtgttctcatttatcacatatatagttttattttgtcttctaatttttgccaccatgttacttataaccacttgtcagggttatggatactacatacctaatagtaattgactaaatctcggcaggattcaccacataccatgtcttatacggaaactgacctcgagggagttccggataaggaaagacaaccagagttctacatggaaacgacaaggactactcggattgtatccatattggtttccctagttctgcttggacaaggggacacctatgggtataaatacaagcccccctaagaggacagggggacacccaccatgagaggatcaacacccaacacaattgacatagaagccgacatacgccaagacatgccgccggatatcgacttcagggataagcatggctagtaccatacggtgtctccggatactgtcaggagagacgaaagcgctatctctgatctcgccgggcacggattcgaggaggaaagctaccctgttgtcgactacgagtcagatcgtcagaccgccatgtcgacaacagttagataggctaccccaaatattgtactggtgtgattatcatgaataagatcaacgaccggcttcggccaacaggatgtagggttattacctgacaattcaggggcccgaacctgtataaaaatccctgtctccgtctcttttacctcagtctcgcgtataccctagcaccgatgatccccataccatgcaaataccagaattgcgacatcaaacgtcgacagtggcgcgccaggtagggggacttggtgctcaaggttctactactatgtcatccagcttcgtcgacaacaacgtcaacaccaacctcaaccagggatttcctgcttcgacaatgctggtgtggactcaagtcggcgaaatcgtcttcccggtttacaccacgatgccgatctcagccggttcatcaatgaccggaaacgagaacgcagtggttacaacccaggacgactccatgtcgaagg

SEQ ID NO: 55194 - DNA, 1501 bp, Oryza sativa
cgaggaaggcgtcgctgcagcgtttcctccagaagaggaagcacaggtgagaacatcactacaaacatcaaattcgttccgaatatttagaattcaaacaaaaattcgacgaatccataactaaatctttctcccaagtagagcagagcagttttctgactgaatttttattatcttgtctgttaatttaacccctagtaatttcttaaatcattggattttaacatgcgtgcatatcaatttgcaggatcacgacaacgagcgaaccatacaagaaggcggcggtggcgtcgccggcgccggagaaaagcttcgccgtcgcgccggtgaaagatgagccggcgacatggctcgggctctgaagatttatctgcccggtttagaggaggagaatatcacaaagggagaaaaaaaattaagtactgactaaattgttgttttccatgatttaagttcgtctctgtttgagatttctttggcccaaacccaaagagttctttcactgatttaagtgattatttcctccactagagcatatacagtgttctgaaaaataatggtagatttatccatttttgttgatgtacaagtacaactgtctccatttctatgcatagtatgtaattaataattattactcaaaagactggaaagactgttgtcatgtgtactggcttttatatgttgttagtacaccttttctctgctttctgattaaacatgtagtagtaggaaacgatctttgaatttctgcgcattcctggtcaaatttgcatactctccctctagtttagtccatgttccagagcacatgtttcaacatttttcatgtattgcagaggtcaaaacaacctctttttttttgcaaattttatacaccgtactcttaaattattttttttgaccaaaactacatacccttaattgaatgatgcatgggaagagttagaatggttatattgtgcttatattgggtgtactgatatctagagcctatttagagagcttaaaattctgagaaatgctggtcggtagccggtttctgaaaatatgggaaagctgggtttcctgccttctcacttctatttcattttctaactacatagcttcttagaatatgtaaaatagctgtacttttttgaaagagctagaagctccaccaaacaaacccttaatctaagagaaaacatgtcgttattgacttgttgttcgtatcatttaacttttttttaaaaaaagaatgtatttgaagatttttagattggatacctaaagatcatataagcagatcaatctcaaaaattattgtaataattatgaatttatttttggattttaaatactttacctatttaatcagaattacgtgaataccgtatccgtgtccaaaacgtcatgttttttttctcgtcgggagcggtgtggttataattggttaacaaattggcgtggttaacatagtagtagtacagcgacatgttggaaaaagtaaagaaaaaaa

SEQ ID NO: 55195 - DNA, 1501 bp, Oryza sativa
taaaacacttgacaatttaattttgtcctaaaccaaccaatcctgactttaaccatcaatgtttttttaaaatctatgtagtttaacatgccaattttatgttacgaaagtatctctcactatgcatctcacaacaaaagttttctaatgttaaactatataaaattttatggataaagaaagctgttcgatttgttttaaaaaaatctaaaacagatcgaatacaattaactgtcccaaatttcaaaacttgcatcaacattcggatggaaatcttatatttttttttcgattacatggtagacgcacatgcatacacaccactgcacacgcaacaccatattcatacctccataaatacgatccctagaaaatatgctctaaaacggaaatcaatggtacatcctagtcccctaaaacctctttgcattttaaaattacgaggccctggttgtaggtccacttcatcatggaccaacatctcgaggcagcttgattaataagctatcacagcctccttggaccacttctggctaattaattttgttattttccatgttttgtgtcacatgtaactatggggtctatggaaggaagagttgaaatggctctagccatagtctttttgttattgacttcttgtgctttaggagtactattatagtaacatggtactactactagtagaattcattcacgtgcttaaaagcggatacgaggttgcagttcattattggtcaaaactcaaaaagttcatggtaatatagatattttaattctttaagtactctgttccaacttggaagatggattggtcactgtcttctttcaaatctgaaagagaagttacccaacagccggtcggatgcacatgcgcatcgatacaattcaagaaacagattggactactccatgttctcctttacaggaatgtttgattattccaaattactactccctccgtccaaaaaaaaaaaaactcaatttctgggtttctgtgtctaacgtttgactgtttgtcttatttgaaaaaaatatgaaaaaatttaaaaaggtaagccatgcataaagtattattcatgttttatcatccaacaataatgaaaatactattcataaaaaaaatcatataagacggacggtcaaacattggatacgaaaaccgaataattcggtctttttgatagagggagtacatgccaagatgatcaccggtccttcgtaatatcatccacccaccatgaaaaagagaccaaatttaacatagagatgtttgaattccatcatcgttctttcagtatttttttttctgtacatttcaactctttccaatgaaattatatgatccctagcatatgtactactactaaaactactactactacttgtgacagataggaataatcgtgcactgtacaaatgctgcaagcataagcatcctcacggcctcgttaattatgggattaaagctgacgtgtactgatcagagcgcgagcgcgag

SEQ ID NO: 55196 - DNA, 1501 bp, Oryza sativa
ggcacaagatgcagtttgttatgtaaaactaactgaaaatagtacatggttaagtttctcataatcttgtttgcgaggactgcagtattaaaatagtatctgtaaactctagcattggccaaaaacccagtcagatgagacaatagtattgcattgatcaactatggtacgaaaaaccaactacatttcagattcattagttttaagtagggacttgactcttcactatgagaactttctactcaagaaacatatccccctcggcaattcagatcaccaaatgcaatacccagcatctgctaaaatcattcttaaagttaagagtttggagaattaactcagcatattagagatgttactaagtagaactcaaaagtttggagacttaagtcagcacatagagagatgttactaaatcagtagaaggaactcaaattaatgaacagatcctcacttcagtctatgttatgctactaatcaaatcagcggactcttaaaatagccatgtaaaggaacttaaatataaaggttcctgaaaagagacatctaaatgcaataactgagtatccactgtgaatcaatggactgatataaatgctagaaacaaatatacatcacctatgtgattaattagctaccaaactaccatgagagccttcaatatttgtatttttctcttagatgcccctcgtattctagtatagctaaggcgttgacaaatatcgatctacctaccgtacagtatttaaaaaaaaaagatcatcatggttaacgcatgtttagggatatttccacaggtatttcaaatggttttcctgctgagcaggctacagagaccatattgtttaatttgcacattgcagcactcaactgacttggtgttggtaagtttatttggtaggcaaaagaattggactggggtgcttcagcctaacacagtgcagccttgagatattaagaccagctcatagaaaagcattaaccgttgatgtgcatggagtatttttcctgtatggtttagaaaatgatcagatggagtgctcttttttttggtcaaaatggtaattacatataattaatgaataaaaataaataataggaaggattaactttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaagggaaaactaaatatttaccatttaaacttaaaaagctacttgcacagaggctgtaaaactacaattctcttttattgtaccat

SEQ ID NO: 55197 - DNA, 1501 bp, Oryza sativa
gaagatcacgaggatgatgacgatgacgatgggtcgcttggttccggcgcacaagtacgaggacgtcggccgggttctcgagaatcctgtcgccgtctcccgctgttgtctcggcgccgatctccaccatcgtcgtcattatggcgacgtcctcgaccagtatcgcccggcgcccgctgttcacgatcgtcgtgatcgtggttggatggcggctatcacggtgtcgatcttcactcgaatggcctcctcgttcttcattattgtgacgccgtgaagagacgcgatgtcgggaacggttctcgttatctcgtgtgcgtcgcgcctctcggcagccatttaggtgatcgcggagatcaccggtgccgcgaggtgggggggtggctcgatgaggcgattcccgctgttcagggttttcaccattagcatcaccagttggtggttgttccggacgcgctgcagcagcggcctcttcgaatgcgttaccgaggttggccactgattcccgtagtcgttctatccaacgtgcgagatcgtcgttcagaacgggatcgtagggggtttccctcagtattgcgttgacggctctgatgtgttgggccggagtggtcacttgattctccgcttccgcattggtgcgtgctgacgtgccgacatcgtcgatagccaatacctcccgcggcgcgctcgttgtcgatgatccatagtcttcgaggaggtgcaagaatgatggttcgtggggattaatgtcgattaccccaacaaatcgatctgaaattggcgtcgctccttgttccttgtctttatccctgatggggatgtgtgactgctggaccttaggagatggcgtcttcatagcgctgagaaagaccttgcagcttgagaggtcgtgattctttgtcttgtgaataggacaatagacatcacgagttggagaaatgcgctgaattccacgctctttgcaggcgcgaatttcggcgcggatgttgagaaaaacccagcaggcttgtaaagtgtgtttcctggttttgtgaataggacatcaggaccttgtcgcttcggaagtcatcctcgtcggctcgtggtccttgtcggaacgacaaggtttggccgcattagaatccttctcgagctcggatgtcgtcgatgttccattctccgcttcggcgggaggatccttcgacatggagtcgtcctgggttgtaaccactgcgttctcgtttccggtcattgatgaaccggctgagatcggcatcgtggtgtaaaccgggaagacgatttcgccgacttgagtccacaccagcattgtcgaagcaggaaatccctggttgaggttggtgttgacgttgttgtcgacgaagctggatgacatagtagtagaaccttgagcaccaagtccccctacctggcgcgccactgtcgacgtttgatgtcgcaattctggtatttgcatggtatggggatcatcggtgctagggtatacgcgagactgaggtaaaagaga

SEQ ID NO: 55198 - DNA, 1379 bp, Oryza sativa
cggcccacagtaggcgaccgcttgcgatggtcggggggcatataagcccatagcccgaccggggccatgcatggccggcgttttttctctcctaaacatccacaaattaggggggaaggtttttgacctcaaatctttgattgggttccatataaaaggtgtagagctcgttctccttctttatttgcttctatttttgtcagttttcatcggtggaatacgaagaaacttgcagttttataaatgaaatagtgtaggcacctttttgttttttttatttttttagcaaatacatattgcaatcttttacatgtttttaaaagtaattagcacctacattgaaacgttgggtttgcctctattaagtttattttcatttggatgaaaggacgaatattttcattttttagaaatggatagacagtattctattaatgcttaaaattgctgtggggctgtttaaatagtccgaacaactcgtgtagatagattccactacaagcagtataaccagttgaggtacactcacttagcctctcgaagagttctgtttgcatacattttcaaattaggaacaaaattagctcttcaatttaggtcttccttttaacgtcagaattacatagaaattaacttcacaacgataaagctaatttccagtggaaaatgcgctcattcttgacagaagtgacatttatgcaataaaaaatgcaccgcaattcacctctacccacgtctcatctactcgttcaaatgatttttttttctcacgtggcaccatataatacatgtatgtaaaccaaaccttttaattaaaaaacccgagataaaaatatgtcaattttcaaaatagtgacctagctagctcctaggtagcaactaaacttgaacgaatttgtaccccaaaatataaataaaaaatgccatcttttaattttcattcaaagaaaattatatctccgtcccattataagtgtagttacgatttttcatatctaacatttgaccatccgttttatttgaaaaaaattatgattagtatttttatagttattagatgataaaatatgaataatattttatgtgtgattattttttgtagttttatcataaaatttttaaataaaactgaccatcaaacgttggacacggaaacttacaactgcacttataatgggttggagatagtatagtacagtagtacataaatttgtcaacttgtgatgatcaagtacgtacactcccgccaaagtttaacgtactacctttcttcctcctttataaatataaacccccatcgtcttctccgatgtctcaaacccaatcaaactccaaccaaactcacctacctacccccaacccatccagagctagagcta

SEQ ID NO: 55199 - DNA, 1501 bp, Oryza sativa
agaatatgtatcccctaacccttcactaagaggaacaaaaaaccataactcctgacccctcttcctccttttaagggactatttggtatggctctatcttctatatcccagtttcaaactccaattttagtgaaagctagcttatataggaggtgaagattgtttctaaagtgtttggctaacttggtcagcttccaaaagacctgaaagagaagatagagaggagatggataatcctaccttgtttttctgtttatttaatgtacgattaataattattatttttccttaataattggacgtgtcaatagttgtaaggaggaattaattcataccatccatcccaaatctaatgcccaactagccaaagtggaccccacaatccataggagaatgtatgcctcgtagcaaatactacgctagatatatttgtcccgcacattacatagttcacgaaaacaaaggaacattaggcatgcatactacaaaatactccctccttcctaaatgtttgacaccgttaacttttttaaacatatttgaccgttcgtcttattcaaaaacttttgtaatatgtgtaaaactatatgtatacataaaaatatatttaacaataaatcaaatgatagaaaaagaattaacaattacttaaatttttttgaataagacgaacagtcaaacatttttaaaaaagtcaacggcatcaaatattttgggatggaggtagtatgtgcgatggaatttaaagatgcattaagctcttctatatagctacatgaaaaaagtgggtgctttcttatgtcaatgaatttgaactggttagtactatccaccatatatgaatgtataaaacatgtcatggtgtaatgctaatgatatatattgtcaactagttggtttttgacaattatatttttctaaaaaaagcgattaatttacatttattaaagcaaatgtacacaaagcattttgagatggaatatactaataatcaaatgacatgtgtcgcataaacccttggaccatgtatcagtgagcgagtagtagcgtaggagtactgtgcatctgcgccgcagaaaatctcgatcggaggttgggttgggccgcctttggacacatcggatcgatcggttccaaaccaaagttccaccgtgaaccacgtccacgcacatcccttcccaattcccatggaccggccgcaccacaccacccccgtacaccgtacaccaatccgactcgtccgcccgcgtcggggccccacctgtcagtgacacgtcccccgcgcccaaaccgctcctctctctacataggtgacccgtacaccgagctcatcacctcttctctctctctctctctctctctctctctctaactcccccgacgagagctcgtcgtcggcggcggcggcggtggcggagagacgcgtagggggggaaccctcggtggcggcggcgggcggggtgggaggacgtgaggtgagccccctcggggcgcgcggaga

SEQ ID NO: 55200 - DNA, 562 bp, Oryza sativa
tattttgtgtcgaacataataccctatatgttttatcaaacttaaagaagtttgtctaaaaaaaattaaacacttataatatgaaacataatgagtatatctctatatgatgaaaaacattatatatatatatatatatatatatatatatatatatatatatatatatattgtcggtgacataggatcgagggtatcatgactagagaattgggcagccgcggtcacccacgtggcccgacccccccgagggtgacgtggccacccctccctctgtctccccgaggggtcgggccgctcccgttttggccccgagggctggggtgccccgaccccttgtgattttggcaccacgtgtatgggttaggtgagcacaagcggggctcacctaaccgcatttatcgcgggttggacgagcgcgccacgccacatttaatgcagcatagcgcatgcttatccggtccgtgatcggtcgcagtgtgtgaccggtcacagaccggtcagatcgcgggttagggggcaacaggcggactgacacacgcctcgccccgtcccgtcggaa

SEQ ID NO: 55201 - DNA, 557 bp, Oryza sativa
caaaccccttccgatcgatcccttgctggtaggggtgaaatcgggtcgggttcggggggagctcatccttcccatatcctaacccacattttataatcggaatcgggtcgggcaccgatattatcggatacgaatagaagcacggataatatcgggcataaatacggaacgaatacgtaccaagacggatacgaactctatcggttacgaatatttattcaaatatcaagtcaaagcaacaaccaaatataccacatagacaatagccattcagccatttcctatatgtctattatgaatatattaggggcttatggcatcataatgcctatcagcaaaactgtaccaaagtagtagcaaaagtagacattcattgcttgatagcttcagactcaatgctgtactgatctgaactgtgaagtgaaggctagggtttgtgcttggcactttgtttggtgggccttttggatgtgggctggctgttgcctgttgtgttggcctgttgggcgcttgcttgttgggctgttgtccatctatccgagtaatatacggataga

SEQ ID NO: 55202 - DNA, 468 bp, Oryza sativa
tgacccgggtaggggtaaattcttttaacttggggtcgtattcagctaactgatagcggcgaacgatgtcaagaacgctcaccaccttctcctcccatgtcaactcctgtgcaaaatccaggaacttcttcttcacctttcccacctgctgctgctttttcagagttggctgctgcttctcctccttcccagcagccataccacctccatgctcctccttcttctccatggtgaccttcttggttagttcacccatcttgccaatgctgtcatcgccacagctataaattcagaagagaagcaaaaattgcaatatttagatttgttcttttatgcatcgcataccaagaggaagaggggatcgatcgaggaggcgagcgtaccgtacgtggtgcgagtgcgatctcctcgaaccctagcacgccgcaaccgagaagtcgatcgatcgccgccgctgcggtgaaaggg

SEQ ID NO: 55203 - DNA, 495 bp, Oryza sativa
attacgcgttctattcatagtcaaatttgttatttttgtttctacttgtataagttgaatttgaatttacaagtttgtgaagtgacatatcacatattgatctatcttactaaatttttttgtgactttttaagtgacatgcaaaaataagtggatatccccttaaggaatgaattgagttttcccatatactataagagtattttcttagtaacatgcgcattaatttgttcaccatacgtattagcgattccgtttcttttctcggttactttcaggttttatacaaaatgtacatctcattaaccatacataggtggtgtttgaatctcctaaaaataaagatgaagataaaaattaagtgtttcacgtgaaacgaggtggtaataacgtgtgattaattgagttttaattattacaaacttaaaaaatagattaatctaacattttagagcaactttcatataaaaagtttttgcacgaaacgcaccgttt

SEQ ID NO: 55204 - DNA, 1087 bp, Oryza sativa
cgtgctggcctttgattgcatgagcaacgcactcccatagggcgaattcgagctcggtacccatcaggaggtctttttcttttcttgcttcctttcggcaatgaggacacaacattaacattcttagcaaaagataacaaataagggttattttgcaacacagtatgaccaatacatgcattattataccatagtttacatttgccatttgcaaaatggcaataatatccatcaaaatcctatttttatacacttattaaattacataaaaaacatcttgaatgtaaagggtgaagccaatcggtagctctaggcaaagacttcaacagcttctacttttgctttaacttcattggcaactctaatggatcctttgtttctttgcgtagttcctgccgaacggaatccctttaaacaattacacgcctgaatagttactccagaaataatccaccatgtggatctaaaataacccacataatgagatttatttacaaatgtaataatggtctcacctttctttgccatgatcatttttaggaagtcaggacaatctttcttgtaatgtcatgtcttcttgcaatggaaacactgatggcttttcaacagtgaaatgttgatgctgtggcagatgctgaggctatttcccttttgaggggatggtttgtggctctttttcttgttatctttaacatagttaatagagccaccattggactctttgattctttcctcctcttgcacacaattagcgatgagcttttcaaaattccatttctctagacttatgttgaagttgacaataaagttgtcaaaatgctttggcaatgaggccataaccagatggaccagaaagtcatctgtgatacccaaatccattggcttcaacttggaagccatgttgctcatcctaagaatgtggtctcttacaccacccccatggtacctctctgtcacaagctgctttatcagctgtgtcgcataagtctttgaagaaccagtaaactggctctttattctttcgaggtactcagagacggtgtcacactctgggattgagcccaattctttgttgtgttgcaagatg

SEQ ID NO: 55205 - DNA, 246 bp, Oryza sativa
accatttcaaatatccaggtaccctcctcgtaccattagtttacagtttggttcagtgtttattgtttgatttttgtctacgttatactttaatgtattgatccttttctctttcggagatgactggataaaccatggccctgtggctatttgttggaagtgattgttccagctgatattttactaaagtaatactgtttatctgtgagaacgaacatacctgagatgaatactttgatctgaagg

SEQ ID NO: 55206 - DNA, 218 bp, Oryza sativa
aaagtagaaaaggagaatgggattaccggtgacgaagaggagggtgcagttgagggcgaggagggcgcggatgcggtggaagaggttcttgaggtagaccttgtccttggcgaaggccggcgagcggttggcgctgtacatctggaccagccagcacgacaggtccacgcacaccttcttgttccttcctccaccatttcatttcccaatccattagc

SEQ ID NO: 55207 - DNA, 1501 bp, Oryza sativa
ttttaatagataacaccgttgactttttcttatatgtttgacaattcgtcttattcaaaaaattttatgcaaatgtataagatataatcacacttaaagtactatgagtgataaaacaactcataacaaaataaattataattatgtaaattttttgaataagacaaatggtcatacggcgtcatctattaaaaaacggagggagtagcatgcaatctatgtttagttataagtagagctagcgtggcgaggatgcggtgcatgcagatagccacagccacaccaacgtatggttgccttcctattcagggaatctagatagatacctcatatagatgtatcacaattcgattagcgttcatttggttcaaaggatataatagggtgtggattggtttgggtcaaacttatttttcagtctgttttgtttgagaaacggtgagatgagtaatccctaacaaggaatattcctaagttagagtttaatatataggctctgtttttttctccaacaaaagttggattaaattttggatacttgtggcacgcttttcaaactgctaaatggtgtgtttcgtgtgaaaactttatatatgaaagttgttctaaaatatcagattaatctatttttcaagtttggaataattaaaactcaattaatcacacgttattacaacctcgttttgcgtgaaatatttaatatttatcttcatcttcatcttcagaatattcaaacaccacctatatattcttttttttcttatagtttatacagatagaaattggaagtagtaaaaaaattgtaacttaaaaaagaatgaacatatcgtattgttgtgtcaattttattaaatatatagtgagagaaaaaacaatatttacatactccctccgtttcaaaatatttgacaccgttgactttttagcacatatttgaccgttcgtcttattcaaaaaattttgtgaaatatgtaaaactatatgtgtacatgaaagtatatttaacaatggatcaaatgatatgaaaagaataaataattacttaaattttttgaataagacgaatggttaaacacgtacttaaaaagttaataatgttaaatattttgaaacggagatagtagtaactttagtaagaaatgactggagatgatcgatcgaggacatatatccgctcgagggctctagggggggaaaaatcattgtcaagagatggccgggggggagcgggtgatatgatatatcgagttgatgtggatggcttggctggctagctgtggctgcggctgcggcatctgcgcgcgcggcggcagggcgtccacgtaattgtaaccgccacccaactaactaaactaaactagtgctttcttttcttttctttctttcttgcagttgagttggggtgctacgcactagctactcaagtgcatgagctagctcaaacaatcgatcgatggcgatgaaggcggtgatcaagggcggcgatggcggaggcgggtgc

SEQ ID NO: 55208 - DNA, 336 bp, Oryza sativa
cagggcatgtccatctaaataccaagaccagatttgtctgcaggatcaaccatctgaagattagtggtgttcctagaagactcaagtggcaccaacagatcggaagcatgatatcggaattcaggatttatgtccaagaggcaatagaacggtacgaacggtacgatctccacagttgcacctatagacaaagatatgcgtccgttagctatgttctatcaacaccctatgaacaaactgctgacctagtcattgatgggcggacgagcaagtttatcaaatggctggccaatgatggggatccaaagctcaagatggtatctattgtcggatgtg

SEQ ID NO: 55209 - DNA, 1501 bp, Oryza sativa
ctggagctgtgccaaacaggccctatcttcttactttgaaggtgctgtccgtcggtatcagataatctctatcacgttgatctagttgtatcggaagataacattaatatgttatagaaagaagcaattctcagctatgaattgataggggaatttggcatcaaaagtcagcgagcaaacagctgcttgcttaccatcatgtcgtctgtatatgttaggatttcgagatgtgaagagaggaatatattgacaatgacctggataaatctcggtgcatgccgttgcagccaaactgaaaggaaagggacaatgctgttccatatttatatatgtaaatatttgacgctgttaacttttttaaatatgtttgaccgtttgtcttattaaaaaacttaagtaattattagtttttttcctatcatttgattcattattaaatataattatatttatacatatagttttacatatttcacaaaattttttgaataagtcgaacgatcaaatatgtgcttaaaagtcaatggtgtcaaatatttataaacggaggaagtactaaagacaatattttatgtagagtacttaagattttacctgagagaatgaggccggtctgttcattcgtcccttggttgcatgaatgggacactacaatactgctactctaaattacgtagacactactacacaggagtacgtttgacattttatccggctggacaggataatctagattatcctcctttccagtttccactgttgccgctggggccaatccctccttggactccggccacgatcagctcctcggcatgcacatcctcgtgccctccatctccaaccacgacttgacatgacacatcagcgccgcgctgccacataggatctcgctggaatcatggtaaactgagatcgaaataacacgcttaggagctgtttggaagagtttaatttggagaagccggaaaacctctaattcatttgctaaatttcacatctacatattctcagaatctaaataaaaatctatactgtttaaagaaggttctagtagctagaaattaaactgtagctgccagaagctactcaaacatgccctaaacaagttctaagatcttctatctacattttgagagtacgagggcatgggatggatggacgaacgagtttaaggaaaaaaatattctttatgatacatatataaactctttttcaccgtttaaatcatttcccataaattggaaatagtagttccataaatgtaacagttatgagagtttttctaataataaatttgttaacggcattttcacggaatttaggaggacatacttgtgtttggagggtgtagttgacgagaagttatactgtattagttgaccatggcagaaatacatcatcagtgacaaatactagagacaggtaggatcctataaatcctgcgcggcgagcagagaagagaagagacgagcagcggtgatggccggcgtgggcgtggtag

SEQ ID NO: 55210 - DNA, 154 bp, Oryza sativa
ttttaccaaagaaaataaccgtattttcacacgcagttcttttaccaaagacggctatacaattcaggagacactaaaaaaacggccagcccaaccagctatggttaaatccagtcccttggactctcctcgtccgctccctcccactcccagg

SEQ ID NO: 55211 - DNA, 235 bp, Oryza sativa
attcctgcagccctcaccttttgtactatcacgtcatttcactacttccttaatttttaccaaaaattacataatcccttatattatgggatggaggaagtagtattctatatgttgttcgctggttggtttgtggtatgttagtttgtctaacatatccatgatcggctagaataaatgataaggtttggtttggctgcttgacacccttatgtgtgacatgtgcaggatgcca

SEQ ID NO: 55212 - DNA, 243 bp, Oryza sativa
cgttattaatggctgcaagttctggtccaatagaaaatttggttccaccgctccacgtggacagcgtggtgtttgatcgtattaaaaatttaaaatcgtatctaacatcgaacgcatagtattttcgtatattaatgcagtgagatgcagaagtaagcatgatcaagccggaacattttaccgtcatatttcatcgctccctgtctaagttagctaatttgtttataaaaaaaaatgttgtag

SEQ ID NO: 55213 - DNA, 222 bp, Oryza sativa
attcctgcagcccttcctttcctaccatacctctcaattattcctttcctaccatacccctcaattattagtaagatcgattattagtcccagttagttgctagctacaaggaattgaagcaacaagttgtagcagattgagagagagttgggaagaattacacaagaaatttagagaaatagtactagctagctagcaagaatatagatatataatgtcga

SEQ ID NO: 55214 - DNA, 1501 bp, Oryza sativa
caggttgagggacatgacagatggatatattttatataggcagattaatgtgtgtgcatcaatcttagtatattcttgttacagaggagttagttgtggagtcgattaattgagctggactggatcggagcctcttttgtgttgtctttgtctccaagtgattaattagttgtagcaagtatgtgcacacttgcacatactccatatgtgtactggactggagtcagtcacctatcctttattattccattttggacttaagcggcagactaacacttccacacaaattaaacacaagcatgtgaagatcgatcgatataattaatccatcgagtcattgcatgcatatatattgattggatttaatatgcacacaggggtagggcacaaatctcattcaattcatctatgaaaatttaaccatatttgagaaggcataagaaggtaacatattttttatataaatttaaaatctctaggcactagatatatcaagatatcaatagtgtaaatttaggtatcttgagatatatttttttaagaaccataaaattttaccatttacctatctttaatctgatcaaattactttgtagtactagcaggatcgaggatgggcggcctgtcctaagagtaggtacaatagcagactattaaccagctacaaatatattttaatgagataaaagatgagagagaagagcagtgggctacaggtctgtagccagttgtagcacggactctaagacgcaacatgtgtatgacaggtgggaccatatactaatagtatagtaagcaactattgtataaattggctattagattggctatagatgaattgaagctagtagttggctatactattaaccttgctctaagtgcactactctagtgcttaattagttgtacacaatcccttcaaaaaaaataaaagttgtacatagatataccagggaacaaatcctatgcacataaatttctcgtgtacatcaactaacaaatgttacgaaaagttcttaaaataatagatatttatttctaatagtattacacatatatgcaaagtcttatattaaaattcattatattttaggctaaaaaaagagaaaaatctgacagttttaagggtaaatatctgtcagaattttgttacggctaaaatataatgaatttgaaaataagatttcacacatagatataatactattggaagcatgcgtctaattttttaagaattttctatgacatttgctagttggtgtgtataggatatgtccccgacacatcatatgtctatagtgtgcttagttaaatatatatgcatatatatggtagtgcactcctactacctgcacatatatgtgcctaaaatcctctttctctctctagctacatcgatcggtctcacacgagctaacttattagcttctcatgaactccggacggtccatctgaattctatcttgtctgatcccatccatatcaatacattagctagcca

SEQ ID NO: 55215 - DNA, 216 bp, Oryza sativa
atggcgggattagaagcaaaagaaggtggtgacggtgataccgaccagcgcatgcaatggttcagcgatagtgacccatgcatagaggtggcaaaatgggccgggccaaacgggcggcccggagcacgggcgaacctgtagcaggcacggcccggcacggcctgctacagtaacgggccgtgccggcacggcacgagtagccgtgccgtgcttggg

SEQ ID NO: 55216 - DNA, 261 bp, Oryza sativa
ctgatttttaagacatgaatgcatatgtgatgtacaagcttttttataggtgtaatctacatctgtgctttgctagtccctatgatacaaagtgatatctagtatgattcttagagatcaccgcattaactactttttgttgttaaagggacaatactattttgattatttatgttattgctccccctgccgatctcggtacccacacaagagacgagtgttttacaactcccttaattgctatttgaagttgctcgtaga

SEQ ID NO: 55217 - DNA, 194 bp, Oryza sativa
gcattttaggtattttctaaaagtatccacccctaatggtatattgtagaaaaaattgacaaagtcagtggcgtattataggaaagacaaaatcgatgacaaatcatcgaactaaactgatctcagtgatataaatggatttctatgttttatcgctcatctcttgatctaactgtagttttcttgtatgtagg

SEQ ID NO: 55218 - DNA, 1149 bp, Oryza sativa
gggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacgtgccgcatctcaattaccttcccaaaggtaattgcccaagcatatagcatttgataaatatgagtatgcatgattctagaatagcatttctaagcaattgtcataattgactagggactcatacgtaatcaggggtacaaggattttaagggtaaacaataatcaaggcacggcataatcacaagtaggacgttcatcattgcatgcaattttatttgtaaacaaaacaatttcgcaattaggatcaacatgttcaaggaatagtgataacttgccttgctcaaagtcttgcgggtcttggccttcacttggatccgcaactccctcgggctctatagttgcgtgcaaaattgatttgaattcggttagaattcaaataaaaatccaaataaatccaaatgaaagtcgaacgcgagagttgattctttttttttattaacattactatctgcgaactacggcaaacccaatttcgatttaaactattttgcgggtataattatttcgttgtcaataatttagtctccccgagcattgtatataataggttagaaatttctaccacgagctaaatattggacgaaatcctagaaatgctatacaatttaatttagtctatgattaaatgattaaatataatatacggctaaaatccctagtaattaaatccgaatttctaccgttaattgattacttacagggattacccagaaataatccataattatttacgagaattcatacatttgtttaattattaattacatctaaattaataccgcgaattgatttcttatggagagtactaaaaattatctataatctataggaattcatccaattatattttcattaatcctatatttaaatgctagtatttta

SEQ ID NO: 55219 - DNA, 1501 bp, Oryza sativa
tggggatggaggaggagattggtgcgacgacttacggtgggtaaggaaggcgccactggtgagggaggaagagagggaggcggtgggttgggggatctggagaagaggaggcgatgggtgggtggatgtggagatccggtgggtggtggtggtttttaatgtcgtaaatttgttttagtgtgccgatgtttttcactagcggacctatttagccgcctctggtaaaagtaattatcatttattttacggtgacttaatttatcgtcaaatgatttttaagcatgatttatttttatatttacataacatattgaatcagaagaatggttaagcgtttgtaaaaaaattaatggcaccatatattaaaaaagggagatagtagctcgtgaagcatgctggttggtggcagatcatgctcgatcgcccccatcgtcgcccagcttatattcctcgtccaaactaaagaaacaattaagctccatcggagacggtcattatctatagagtaaagtgcacgggcggtctctaaacttgtgtgggtgtgtcaactaggtcctttaattctcaaaataaatttttgggtccctcaacttgtctcgggtgtcatataggtccaaaagggtttcaacccgctccgtgtgctgacatggcatgccatgttggcgcctacgtgttagtagaacccatatgtcagccacatatagaaaaaaaaggacatattttttctcctatcttttttcatttatttttcaaaaattaaaacatcattttcttctctctttttaaattttatttttttctacatgattgacatgtggatcccactgacacataagagttactgtggcttgccacattatctcatagagtgggttagagcccgtttagacctatatgacacatgacgagtttggggacccaaaaatacattttgagagtttagagatctagatgacaacatatatatatataaacttaggctaataaaatcttgctactaaaaatatcatgcactctttagttttaaatatctaaagagtaattcctttttaggatattgctggcctcggccgcccgatgcagagaaaaaaatcggtagacctcacactactatacgtatgcaatattgtatctagccactagtttattctctttccctctttcacactttaaatattttatctcctaaactacttatccaatctacaatccgatcacaccgttgtattcattgtaattaaatttttactacaaaatattatatgattatattccgataaaagagaaacatgtgtttgaaaccgttaaattaaactcaatattttatatgtgatagcggcacgtttcaacccgtgtttccgatgtgtttcacaaaattgatgcaactacatgcctctattatgtcttctctcttcattccatccatccatgcattcatgtatttaatgatcttaaaaaaattctcctaaattacttattcgatctacgatccgatcccacc

SEQ ID NO: 55220 - DNA, 371 bp, Oryza sativa
aatctacgtttaatactcctaaatagcaagattccggagggctatttaatagcccgaaggatccaaacaagaccaatgagatagtactaagttactttctccgtcttaaaatattaaaagaaaatatgatcggatgggatatttcttaatattatggatctggataggaaatgacgcattcaattctaggtttatatattttgagatggagaaattaaagtattgtatggcagaaacagaaagcgaaaagagcaggacgaggcgtgagcttatggagaggggactgaaaaaacgagaagcaggatgtctatatatcaagtagtaaagcactggttttttagtgttatcgtaaattagtatactttgagaaa

SEQ ID NO: 55221 - DNA, 438 bp, Oryza sativa
ccagcacaaaaaagaataaaattacacgagtactccctccatttttttaatctatctttataacgagtggttaattcatatttaaaagcaataattgctaatgaacaaattttgacaggtgagaacaaattttgtcttgattttaatagatagtttaatccaaaccatcaaatttgtgcgattgatgataattaattactacaacaatgaaaaggtgatccaaatgaaaatactctattttcagattgtttaatgagtgagtaggctaaaaacagaaattccatgccatttttccttgccatcatttgtatctccatgcattggacacttcaccggagcatctctaatagagtggatatttttagttctccaaacatttagggtccctttgaatcgcatgattgaaaaaaacggaggaatagaaaaaaacacaagaca

SEQ ID NO: 55222 - DNA, 377 bp, Oryza sativa
caatagaatttgaattttttttatgttttccctctgtttaaaattcgaaccagagtggtatttttttacagagtgtaaataacagaattgctactgttcatatgaattttatatagatcttccgctgcaaatagttgaaattgatgaaaattagtgtttctaaaattaaatttcgaaccaacgggagaatttaatttttggaaaattaattatgtgctatgatgttgtaattttctaaccaacgttgttaattgcaatattatagttatggttctatgtgttatgtctaattctgcccaacggtgatgtaggcttaatgcacaatattttagtgttaattttgttctcaccgtacatgattatttcaagtggctact

SEQ ID NO: 55223 - DNA, 813 bp, Oryza sativa
attcctgcagcccttggttattattatgtgatgaacaattgggcattagagattattggttttgttatttggaatttatttacgaagtggttttggagatgactggatttcacaggtgaatcgtaggttcattatttcatgtgaccggtcagaccgggcaggtgttgccggtcagaccggtggtgttcgagcggtcggaccggccagcccgcggtctgaccggccgacactgtgtcggtttcggtttcgggttgtttatttgaatatccgagtttatttcatgattatgacttctagatggatactatacgtatgtaatactattgtttgctactaatgagtcaagttggagatagcttggacttggaatatggtttctttgtttgttccatgtgtaggtgactcgatgtctcgggagagtatttgcggtgatggaccgggagtcggcttggggataagacgatgtccgtggtggtcagagatcatgcgggatacttaggctagagttgatgcacgtggttgatggagattccatatggcatatgatggaggtattgtgtgcgtatgggatgcagagttgaatttggaaggaatccaaatttggtacgattggttatgtaaagcttctttcttgtactagagggtttcctaaggtgtttaggactcctagtatgagtttggttcgtggctttagactgcctacctcatgtataaatagaaggggagcgtgaggcttcccggtatcgcttttcagagcaatagagttgagttttgagttagggtttcgagtttagttgaaattttataaggagt

SEQ ID NO: 55224 - DNA, 1501 bp, Oryza sativa
catacataatccgttgaattgaacgacggagtgttgtcccgaacgacgacacctaacactcagtaacacacgacaccacctagaagttgtcgtctttctggctaacatagtcattaatctatgaatatattaacacactcgtcatcgctgatcttatggatcagcgcgcttgggatactctgtcggttgtgacttgtatgttaataatccatcatattgctatctgtatgaagtagatggtaacaaatccgagtcatcggcacctgcaggcgccaccgccgctgcctgcacgtagcgacacccggacgccaccgcatgacgtcttcccctttgtcaacggttgccgaatcaatccagagactttccctcgtcgatccgccatctgaaatgccgactcgacggcctttcgaggccatccacaacgcaattgacggtcgccgcccgtagtgacgccaaggagcacgcccgcctcccctcgccgccagtacgcacggcttgcctcccacgctaccgcacgcggccgggacgagggtcgaagccgccgtgagcacccgccgtcgatagccgtccgccatgccggcctatatgccgagctgagtttcatcgacacgtaacatggagctatgattgtcggacgccggacacggcctgatgccaacgaatgccagtgtcggtgctactagatgttgcatcgccgcttcgcctctgaccatggcaactttccatagacgtccatctctaccgagggctcactagcacgtttgccattggttccatccattgtctccattgaagaatggcaattggatcatacctcacccacttcttgtgggggaaggtcgtaatagcccattaggcgacatatgagatgggctggccaggttttaaagctagccagtataaggaggtgggccaagtagaaattggcctattaaaaggagtcgggcacgaaccgtgattttggtccgaaaatggtattttatttcaaaagtccttggtttccaaggcattatgcggaactcggaaattatgcggaaaagtcctatgagacattagaaactaagggaaatatacattcgccatttatactttgaaccttcatgaattgggtttacgccaaatagagaagaattaaggatttattccttagtcccgtatttctatgtatttgctttaactatttagttagtttcttgaataaccataattaatcctagaaacattgtttttaggcaaaagagcttccatgaacttgtgaaacctttgttttagcaccccttttggaagcataatattttatggtttatttcctggcaattgtttgtttgggataattgattgttctgtgggttagtagttctgtaaattacacatacctttgaatattagaaaatcatgttaattgctaggattgtaataaaaggtgtgtatagaaaaccattctttactattttgtactcgttttgtgcactttatttacaagaagtaaaccggtagaaag

SEQ ID NO: 55225 - DNA, 507 bp, Oryza sativa
ctttatagctattttgctatatcactcatcatattttgccaagcagtcggtatatcacttggatcatattattcggggattcacaccgcatatgctatatattggtatcaagtcacttggttgactataattatcaaaaaccactcggttaattggatgacttattccttgactatatgtttggtttgttcaattaaccacatagtcgggggttacacctattaggtgcatctagtcgatgcatctgactttattttttcagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccct

SEQ ID NO: 55226 - DNA, 1501 bp, Oryza sativa
aggctatgccccacctcaagtccggccgcaagtggtgacccagccctctccgccactagccgcacagccgccggtgtacttcgctgggcagcatcaaccacctggccaagcgacaaaaacggtggcggaaggggcttcggctctgcaggcgcaactccaagcccactacatttcaagtacaaccccatcggctcacccggtggggaatacaagtcaaggtgcgcctaattggttgccaccgattcagcaaggctcgggaccttcgccgtggagtcaaggacagcagttcgacttcggcaacactgctcaggtgccaaccgttcggcagcaagttccaaccccaggcttcggaacaaaccaagcaccaatccaagctgccatgacgtggtcgcagccaatttttgacccatccatggcggctcagcaagtgcctccagttggagccgggcagccgaacgccatggcccaacttcacgcacaagctgcgatttcacccttcgccacaccgtacccgcagcaaggtgcggtaaagagggcgggaggcgaaaaggggctaccgctgagtgggggaatcaagactcgtccaatcccaccccagttcaagttcccacccgtcccgcgctattcaggcgaaactgacccgaaggagttcctctccatctatgagtcagcgatcgaagcggctcatggtgacgaaaataccaaggcgaaggtaatacatctcactctagacggcatcgcccgttcttggtatttcaatttaccagccaatagcatttactcatgggagcaattgcgcgatgttttttgtccttaactttcgaggcacctacgaggagccgaagacgcaacaacacctactcggcatttgccaaaggccgggtgagttgataagggagtacatgcgtcgcttctcgcaagcccggtgccaagttcaagacataactgaggcgtcggtcataaacgccgcatcggctggtctgcttgagggcgaactaacaagaaaaatcaccaacaaggagccgcagacgctcgagcacctactttgcatcattgacggtttcgcaaggggtgagaaggattctaagcgacgacaagctatacaagctgagtacgataaagcctccgtcgccactgcccaagctcaagcgcaagttcaaattgccgaaccacctcccctctctgttcgccagtctcagccggcgatccagggacagccgccaaggcaaggccaagcccgcatgacttggagaaagttcagaacggattgggcgggcaaggctgtgatggctgtcgaagaagtgcaagccctccgcaaggagttcgacgcccagcaagcaagcaaccatcagcagccagcccgcagacttctactgcgcctttcacggacgctcttcgcacaccacagagcaatgccgaaacattaggcaacgtgggaacacgcaagacccaaggccgtagcagggaacaactgtcgaagcaccccgcgaagcagttcaag

SEQ ID NO: 55227 - DNA, 1501 bp, Oryza sativa
gggcctcacacctctgggtgatcctgggcatcgcctccaccccctccggccactgcgccctcctcttcacaaatgtccgccgcctccgctttcgccagctgctccaaaaggcgcgccttagcggcggagcggccatccttctgccaaaattgttttcaccacgcacgaagtgcaggcgaaatgtcttgcgcactgatttcccaatcccccttcgcgtacttggggaactcggcgatgtgctcgcagccgaactgctgcaggaggcccatggtaaaggccgctgacacgcgtgcacagcaatcgccgtatgcggtggcgcagtccgaaaccgaaccaccagcctgttgggtccattcggagaagtcgaaggctgaggcatcttcagaggggacaccccgcaccttcgcgcccatatcggtaagggcaaggcgaagcgtttggcacgctgtccgcgcggactcggtggatttcaccatctcccgcgaaaaccgccgcgactcctctgcagcgcttgcttcggccttgcgaacctcctgccgaagagcctccatcttcggctcggtgaggttataataatctatgagcacggcggtgtgggccttctctttctccagttcggcctttaagcgatcgacttcggccctagcttccttccctttctctagttccgattggagctgcttgttttcggccttcgcctccttaagggtgttggcaagggcctccatctccaaatttttgcggcctagttcgtcatccttggcccgaagacagcttttgaacccatcaagtcgagctcgcacggttcactccgttgagcagtgagccgcgaggatctgggcgcagaatacgagcggcaaagagaacaagtatcaattgtaaaaacaagatagaggaagagtaaagataaaaaggggggaaaaaacgtacccgaacagccaggctttttatagcagagcactcctcgtcgaactcattcagttcggtgaacaagctcggggcgctggcgggcagtacaagattgcttaccccctccacaaaagaaaggaggtccgctcgcatctcgaagtcgccaggggcgaagcggggtaccgagagcgaatattccgaagcggatgtctcagcgaccgctctctttcccttcgcctccatcagcggcgaggcaaccggctgatgcggaggactgccgaatactttcgccgcggccatcacaatcctttccgcagaagccgaagccccagcggtggtactaccgtccactccagtggcgccaagtggaggaatgggggcggccgaaagatccaggctgcgaccagcgggtgaagtcggagtcctgtcggaggactcgtcatcgctaaaaacgcgagcgacatcgacgagccctttctttttagccacctttttgacaagacctcccttcgccgacgcgcccgaagagaacgcaactagggccttcgccacttccaaatccttccgacgaaggggggagctgttcgggtgt

SEQ ID NO: 55228 - DNA, 1501 bp, Oryza sativa
gcgcccgcctcgctggaccgccgatgccgtggcatggcttggtgccccccagccggtgaagcaggagctgctcggcggtcgtcactacccacacgcaccagctcgctagaccaccatcgctgccttcgccatcgttccgctctctcgtcaccggagagaaaggggatcgggagagaaggatttaggagctagggttttgctcctctctcccggtcggcgcttcatccggcgcagggacgatcggagccgtccattagatcggacggttcagatttgccctgtgtcgggccgctgccgccgctgattacgcagcccaatgggccacagaagtgcatcgggccattgccgcgtatgtgggccgcgctcggttgctcggcttgcgagccgtcgaactgactcggctcgagcaaagacgggccggcccaagtttgggccagcttcggaagccctgggccgaaagcaaatttaactaaatcctgtcaattttaatgcttataatgttaagaaatttgtttataagccttcttagccaaataaagttgatgaaaaattattttagcctctaaatgaaattatttcaaaaccagatatcggctttaatggcttcatctcaagtcagagaattaattttcgtaattgaaaggtgattatttatatgctaaaagaataagatcttgaattagaactccaacattgtggtattagagcttaactttagcctactcaattccttattcacatcatccatgtgattagaagccatcggtgccatcttggttcgacatgaacaatttcgagtcaaataagcctaatataatctgtttagcttcttatctttattgcttagtgaagattagctcatattcatgttcaattaaagttaataagattgaattagggttcatgatgcactgcattgaatataagacagtttagctgagtattaagttgtggatgagaagtactcaggaaactaacccaaatggctttgctactatacattccagtgaaaaaagatgagctgtgtacatatgtgtgaagataccttttgtggtttggtgaaaagggtggcatttgtggtgaattgctgtagtggtagtagtactactccctttgtcctattttaactgcaaccataagtttccgcgcctaactttgatcgtctatcttatttatttatttttataattatgagttgataaaacatgaataatactttatacgtaacttatgtttttaatttttttcaaataagacaggcaattaaagttgtgcacggaaaattatggctataattaaaatgagacggagggaatagttgcttgagtttggatcgttggatgaagaaatgaaattgacagcagctggtgttgaattgggatttgtatcatgtgcagttagtactatcactgcaacttagggcatcctcaatgtatgttgcaaaagtaggtagtaaggtgggcccatgtaagatggtaatagtagattgaagatgcaccac

SEQ ID NO: 55229 - DNA, 1501 bp, Oryza sativa
gtaaacaactttacatgtatgccaatgtggcgtcaatgcacttagaactatcaacctacatggttgattgaggcttagtggataataagaatacattcaccaaaaatacttcaaataacaggcaagacaaatatttacattcaatgttagacatacaattcacaattttattccacaaaagattaaagaattactacaggtaaaagaaaggcaatataggtaaggtgagatgacctatataaaaaaaatattctgtaatctaatgctgaagcttctatgcctaaagcaaaagataaagatactctacatgagcttaaccatgttcttcaaattgaacttaatctaaactataatgtaactcgtgtattgtaaaatactatctcaaaagaacgaatgcaagattactgtcattactattcgtctccccttgagttgaacatcaaattcaaatacaccaaattcctttccttccacaaattttgagttcttcatgaacatattaatagtacaagtcatatatgtgcgtgcaaatgcacatgttgacagtaatacaacttcttgtgtatcaattctaacaactaaacatgttgcatctaggccaaaattgcttcaaatacaaatgaccaatttactcaaaataatttgcatacatccataaaaacaatacttcatttgtaaattcatttatacatagaagatggacataacattatcaatcaaattaactatagacactgcataggtacatagtattttgatagataattttggtgcagggcatattggcatatagacttcttgtctatatattcgcaaattcgatgacattgtatctacttggacacaattaatataaattagttgtagcttatcttctctgatagtcatgcactaataaatatctctaagtcaataatatactctcttcatgatgagtgtatacatttattctatacggagaatatataattgtgcgttctgcaaatgtggcgtcaattagacaaagagaagatatatgaataattttattactcatttgcccaataaatgtatttgctacatgcaactacttacatgatgtccttttatgcaactttctaccggtttacttcttgtaaataaagtgcacaaaacgagtacaaaatagtaaagaatggttttctatacacaccttttattacaatcctagcaattaacatgattttctaatattcaaaggtatgtgtaatttacagaactactaacccacagaacaatcaattatcccaaacaaacaattgccaggaaataaaccataaaatattatgcttccaaaaggggtgctaaaacaaaggtttcacaagttcatggaagctcttttgcctaaaaacaatgtttctaggattaattatggttattcaagaaactaactaaatagttaaagcaaatacatagaaatacgggactaaggaataaatccttaattcttctctatttggcgtaaacccaattcatgaaggtt

SEQ ID NO: 55230 - DNA, 1501 bp, Oryza sativa
aagctgaaccacatgaagcaaaaggaaaaaagaactaagaaagtagaaatggtactagttaaagaaaaaagtgattttctagctcatggttctagaacatggacagttaaagaaggaaccaaagtaatgtaggaaaaaataagggagaattgtatttatacccccactttcaatctcaattgtgattttgcccttactttttagggtttgcatatttacccctgtttttttctaaacgaagtcactgtttgcccctactttaaacggtagtttggtggtcccacaatatcaagtgaaagaaatataaatgaaaagggaaaaaatatttaggaaatatgggattcccaatctacccttgagtaaatatgtttggtcagatttgttatcccacaccaaggaatccccaaactctaggggagaaagagcaggtggcggaggcggctccggcgagccggctcgacaacacaagcagcaggcagcagcggcggcttctcagcgtgcctcgacgcgagcagcaagccccagcggccgctcctcggcgcggtgtcacgagaagcaggtaagcgcacctcgatgcaagcagcagggcgcggcggcggcttcacgagcagaaggcagcagtgacatctccccgacgctagcagcaatttgcagtggtgactcgcagcggcgcgagaagcaggccacggtggccggtcgtcgacgcgtgcagagtaagcctcctacttcttcagtcttccagatgctatttgttctctttttcttccaaacatactttcttgtgtgcacatcttgattaatcttaagaacaaacaaactataatattgatgtatgtatcaacatggttttgcagttagagaagcatttggaccggcaaatacggcctggagtggagcacatgagcaggatgtagcagcatcgcgagatgacgagagattagtcaagaaaacgttgtgtacaagttagtgtggagattatgggtaccccatacccggttatctgactggttataggggataacttatatctatgaaatatgtaacggatcatgacttgggtattatgtttccttgtatattatggaacggcctaaaatcctggtttgataatattgtaaagtagatttaggaaaccgataccgtattggttaaggtttctatcttgtaatcctgccccccattctatataaggtgggcaggaggccctctagggggcatgattcacaaccagattgtcagatcaatactacatccggcggattcaaatcctcaaacaggagtagagtattacctctcattgagagggcctgaacctgtctaaatccttgtctccgcatccatccacttttaggtctcgtgcgctacccctttatattgccgaaatcttgtttcgacagttagttccaagtttcatgtataaagggtaaaaacacaattgtttgttcagaagtaagagaaaatctgcaatagaagcaaggatataaatgtcttttggtactcg

SEQ ID NO: 55231 - DNA, 271 bp, Oryza sativa
gaggtattgtgtgcgtatgggatgcggagtcgaatttagaaggagtccaaatttggtatgagtggttacgtaaagtttgtttcttgtactagagggtttcctagggtgattaggacttctagtatgagtttggttcgtggctttaggctgctttcctcgggtataaatagagggggagcgtgaggcttctcggtatcgcttttgagaggaattgagttgatagttgagttagagtttcgagtttagtcgaaatttttgtaaggagtgatgt

SEQ ID NO: 55232 - DNA, 1501 bp, Oryza sativa
caaactgaaagcattttcattttcaggtcggctttccctccatccctcctcttcagtttagtttggttccctttcaaggcttgctaatattatattctcaagtgcacatcttaagctataccaatttcatttctcgacaccacacagccacaaaacatcaattcaacggattgggatcacctgcagtaggaatagcgaccgcaagttaaactactgcatgcgattacagccgttcattttggtgatgaatggaccagatcttccgctacagtactgacgcaagaatattgaatatttcttgttacagtgttctacagtatccggatgcatttgaaccgttagattcggatctaacatgtggcagtggactgcataagggcatccacaatgtaggggagaagtgggtattaggaattaaaatattcttactactaggtaagatacatcgtggaagtagtaaataactactaccaagccataagcttgctacaggttatagcactttgtggtgggtcctacctaatttttaattgtgacatggctcatgtttggggttctttttcagataggtcccaccttattacccactctacacatatatacattgtggtgcatcttcaatctactattaccatcttacatgggcccaccttactacctacttttgcaacatacattgaggatgccctaagttgcagtgatagtactaactgcacatgatacaaatcccaattcaacaccagctgctgtcaatttcatttcttcatccaacgatccaaactcaagcaactattccctccgtctcattttaattatagccataattttccgtgcacaactttaattgcctgtcttatttgaaaaaaattaaaaacataagttacgtataaagtattattcatgttttatcaactcataattataaaaataaataaataagatagacgatcaaagttaggcgcggaaacttatggttgcagttaaaataggacaaagggagtagtactactaccactacagcaattcaccacaaatgccacccttttcaccaaaccacaaaaggtatcttcacacatatgtacacagctcatcttttttcactggaatgtatagtagcaaagccatttgggttagtttcctgagtacttctcatccacaacttaatactcagctaaactgtcttatattcaatgcagtgcatcatgaaccctaattcaatcttattaactttaattgaacatgaatatgagctaatcttcactaagcaataaagataagaagctaaacagattatattaggcttatttgactcgaaattgttcatgtcgaaccaagatggcaccgatggcttctaatcacatggatgatgtgaataaggaattgagtaggctaaagttaagctctaataccacaatgttggagttctaattcaagatcttattcttttagcatataaataatcacctttcaattacgaaaattaattctctgacttgagatg

SEQ ID NO: 55233 - DNA, 1501 bp, Oryza sativa
ttttacagttgtttcttgaatagtagtggcaggctatcagcgaccatggggcaaattttctgccaagatcagtgatataagccgtcgcaacatcaatgcattgctccatatggatgaaaagctaatgaactcattgatgcttgcttctcggtcacatggtgcagtgccaacaaaaactggatgattgtacgcgagaatgattggagttttggatgcatctttcttttttatgtttgtttgtaaaactgaagtgctcaatacggccatgtttttgtagcgcgaaccaaatgccatggccaggtgccaggcgttcatcattgtgatggcgacgagcagcaacacttgccggtgctttggtgtttgatccggactgataggatcagagattaactccctcatcgatgaaattaattaccctttataaatgatggttaggctcttaactaacactttatctgggtctctcattttctttaaaatctgtgcagtgttttttctttgaagagcagcgcaaccattctaacatatactccctccgtcccacaatataagagattttgagtttttgcttgcaattcgtcttattcaaatcctttttgcaaatataaaaaacgaaaagttgtgcttaaagtactgtagataataatgtaagtcacaaataaaataaataataattttaaaaatttttgaataagacgagtagtcaaactttacaagcaaaaactcaaaatcccttatattatgggatggagggagtatattaataacatgcatcatgcaaggtttcggatcagtcatcacattgggcaacaatttaccaccttgaaattaatttcacacttagaacgtcctatctgataggcaactatatatgtgtcttatcctacaaggctatcgtttactacaccaaatactgcatcatggccttctgcatcagcatgcaaaatgcacagcaaacaaactcaagcattattacgtacctagaacctcaagatggtagaatagaagatcgatctaatctgtttttctgttttgagagataatgtttgcaacccactacagaaaactatacattgatttaactctaattataaccaacagcagaagaaatgcgtcaaaaagcatatattgactctacaggtgctgccactcccttataaatcgagtatagcaagcttgtaatgaatcaataaaatttcgctccaagtatttacagtgccggtaagaatttgcttacagtatctatgcttgctccttagtccttagcaatgttatctcacaagtagtataccttggctagtacatatatcttaatgtttcctcaaagataattgatatacctttttatatatatgttaaacttatccgttgtccatgaaagatctatatagcacaagtagtcgatattctgaagacgcataaactttgtgattgcacgaattaattaatctcactgtgaatgcgtaggttgaaaaaaaaagatctccaagatatcaagcaa

SEQ ID NO: 55234 - DNA, 1501 bp, Oryza sativa
atttgaatccgccggatgtagtattgatctgacaatctggttgtgaatcatgccccctagagggcctcctgcccaccttatatagaatggggggcaggattacaagatagaaaccttaaccaatacggtatcggtttcctaaatctactttacaatattatcaaaccaggattttaggccgttccataatatacaaggaaacataatacccaagtcatgatccgttacatatttcatagatataagttatcccctataaccagtcagataaccgggtatggggtacccataatctccacactaacttgtacacaacgttttcttgactaatctctcgtcatctcgcgatgctgctacatcctgctcatgtgctccactccaggccgtatttgccggtccaaatgcttctctaactgcaaaaccatgttgatacatacatcaatattatagtttgtttgttcttaagattaatcaagatgtgcacacaagaaagtatgtttggaagaaaaagagaacaaatagcatctggaagactgaagaagtaggaggcttactctgcacgcgtcgacgaccggccaccgtggcctgcttctcgcgccgctgcgagtcaccactgcaaattgctgctagcgtcggggagatgtcactgctgccttctgctcgtgaagccgccgccgcgccctgctgcttgcatcgaggtgcgcttacctgcttctcgtgacaccgcgccgaggagcggccgctggggcttgctgctcgcgtcgaggcacgctgagaagccgccgctgctgcctgctgcttgtgttgtcgagccggctcgccggagccgcctccgccacctgctctttctcccctagagtttggggattccttggtgtgggataacaaatctgaccaaacatatttactcaagggtagattgggaatcccatatttcctaaatattttttcccttttcatttatatttctttcacttgatattgtgggaccaccaaactaccgtttaaagtaggggcaaacagtgacttcgtttagaaaaaaacaggggtaaatatgcaaaccctaaaaagtaagggcaaaatcacaattgagattgaaagtgggggtataaatacaattctcccttattttttcctacattactttggttccttctttaactgtccatgttctagaaccatgagctagaaaatcacttttttctttaactagtaccatttctactttcttagttcttttttccttttgcttcatgtggttcagcttgcgttctgtctatagcctaccccaacttggttgggcctaaagcctgatgattttattgtactttgtattcttctccaagtaagttatatggggtcagttgtccgcttagcacttgaatcaagctttatcacttggtgagcctggtcgtcaccaaatcagttgacataaatgaaaatttagtgtagttcagtgttatggtggttctggtattacaattctccttcttttgtatgc

SEQ ID NO: 55235 - DNA, 252 bp, Oryza sativa
acaaggcaaacattgcaaacaggctataagactactgaaacagagaacaaaaccatttttaatggattctacacatttttcttgatttactgagacctgaatgggcttaaacggagctcggatgaattagatatgaattttagaagattcactgtgtttattactataacaaaaagtccttaaatcatttattgtgcaataaatcccagggctggcgtcagcacgggagggggaggaggcgcggcgccgaca

SEQ ID NO: 55236 - DNA, 319 bp, Oryza sativa
tattttaatcaaattgcttgttttatatttttgtttgaatttaattacaaactccttgtggtgatccgcctgtcaccatcagcctcgcggatcattgttgacctcctcatcagtgagcctcttttgatacattggacatgacgtggcggggctcggtggcaaagatgaagctgttttctagtccttgtcgaagacatggaacgtctccctctgctcccctcctcttagtccttgtccttcatctaatcatttagtgcgctattaggtccaggaacttgtagaagttgatgatgccacctcgctaataatgtcttgtagc

SEQ ID NO: 55237 - DNA, 195 bp, Oryza sativa
taacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatattgctattctgactacaaatat

SEQ ID NO: 55238 - DNA, 1030 bp, Oryza sativa
ccaacgtgccatcttcaggagctaacacgccggctccggctagggacgagtgctcggagctctcatcctgacgggatggggcgaggcgtgcgtcagaccgcctgtcgccacctaacccacgatctgatcggtctgtgaccagtcacagaccggatagacgagcgcgctgcactgcatggcgtgacgcgctcgtctaaaccacaataaatacggttaggtgagccccgctgggctcacctaacccatacacgcggcgcaaaacccacaaggggtcggggcgcctcagccctcggggccgaaacgggagtggtccgacccctcggggagacaaagaggggggcggccatatcaccctcgggcccgacccccccgagggggtcaggccacgtgggtgattgctcctgcccaagcctcaagtcatagtactcccggtcccatgtcaccgacagtagcccccggcgttatgccagggcgatcgccctcctcgagggaagcggtcgggcgtgacgccacttccaaaagcctggtgacaggtgggaccggtctccacagttgggcagaaacccaacggtcgcaaatcacgcactctggcaacggtaactcgactgtcaataatgaacggcctcttcaaggctgccacattactcgagtagcacgcgaatcgggacgagccggttcgttttgcctggagatatggtgatggcgcttcggtcggtgagcgcaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacagcgttggcaagggtataaagacaccgaggaaaagatttgcttccttcctctcgccattattccccttgtcttcgccgcttgcgccctaactccttctttcctgtgccctaccttcgccacacgcgctcgctctcaaacatctcttctcccggcatca

SEQ ID NO: 55239 - DNA, 260 bp, Oryza sativa
ccaacgtgccatcttcaggagctaacacgccggctccggctagggacgagtgctcggagctctcatcctgacgggatggggcgaggcgtgcgtcagaccgcctgtcgccacctaacccacgatctgatcggtctgtgaccagtcacagaccggatagacgagcgcgctgcactgcatggcgtgacgcgctcgtctaaaccacaataaatacggttaggtgagccccgctgggctcacctaacccatacacgcggcgcaaa

SEQ ID NO: 55240 - DNA, 1501 bp, Oryza sativa
acgtaagacatggaaccaattcaactgaccttagatgctcccgtatatttcgattctagtgtggtcaatgaaaacaagacttagtaaattactccgtacaattatataattacaagaaatcagataattagggaccaatcttaaaaatttcttgtcacattgcctgtgattatgactggtgtagtgtgaaaaatccctttttttcgttaatagtggcattccttggttcccttgaaatagattggcattcagcaactccacgcaaggaccataaacccaactccaaacgatgtctctcacgctgatcgtgttggaaaggtagacactcatgcacgatctctcgcacatattccttccccaatagcgcaagctgtccaattccaccagccctgccggtgctattgggtatcggccactgcatgcctctcactcaacactggcctctcctgcgcccaatttcagctgttgtatatccccgctagcccaactcttgtctcaaatcctgtcgctcatacattatatgatgaaacgcctcctcactatccaatgcaagtgctttaatttgtacaggatcactatttccaatctttcttatagttgcttccacatatcgggttggttttttatgaattggcacatatgtgtcctttcccacacaaccacctgatggctcaaggctaaaacaggcactaatggacatgactatatcaatgttgtttataagtattgatgaggcactcatcactatgggcatgtgtctgaacttttcaaatttaggtcaaagtgaccagtgctgagtctggctatggaccaatgctaataagcaccttatttgtgccgctgctaactaccaattggcactgaccatatttgtaccggttttagatatgagcataactttctcattcaatctcggattagaagaaactttatatgaaaattgtagctctctgtttgatcaactattttgttgttgacaacttattggttcaagttacttaaatgttcaaatccatgatttaaatatcacatataaatggtcaaaagacggaaaatatagccgctactataccgtgtatatcttttttccttcacatttaccactttttttttcatcaagtaacttggccatatattgcaatggttttcttcacttgttacgtgttttttcttcatctagtaacttgtccaaatattgcaacggcatagacccataaaacagaggatgggttgggagtgtaatactctgttggccatgtactgcttggtttttctcgatagggtggtgtttcgttctctgcacgaggctaggaggagtagacagaccactctgtttttaaggggataagtccattttacacccccaaactcctgtctttgtctaaaattcaccctaaattataaaactggctattcaacaccctctaactattaaaaccgttcaatttatccccatattgttgactaggcggtttttgcctacgtggcatggcagtccaat

SEQ ID NO: 55241 - DNA, 1501 bp, Oryza sativa
agtcatgttgggctgcggacagaacccgagctcacaactgcattacaaaaggggaacggaagccagacttggaccaaacatcacaggcgcgacttgggaactaggccgaaatcctaaaactcatcgtagccggcttgctcctggaagaactcctcgtcagtgggatccgcttcatcttcttcagcaactggggggattatttatatagagcaagggtgagtacggaagtactcagcaagccatgggaaataagtgtttaatgcaggcttcaagaaagactgtttgtcggtgacatgggaccgggagtactatgacttgaggcttgggcaggagcaatcacccacgtggcctgaccccctcgggggggtcgggcccgagggtgatatggccgcccccctctttgtctccccgaggggtcggaccactcccgtttcggccccgagggctgaggcgccccgaccccttgtgggttttgcgccgcgtgtatgggttaggtgagcacagcggggctcacctaaccgtatttattgcggtttagacgagcgcgtcacgccacgcagtgcagcgtgctcgtctatccggtctgtgactggtcacagaccgatcagatcgtgggttaggtggcgacaggcggtctgacgcacgcctcgccccatcccgtcaggatgagagcctccgagcactcgtccctagccggagccggcgtgttagctcctgaagatggcacgttggccccggtcagatatatgccaggcttcatcctaaccattacaagcaagatattgtatgaagaagggcgaacatgcagattgctaaactgacacgtggtggacaagaatgaccgatttgtgaccggtctgacactggtcatgttgtcagcagacagccatgttcccacgtcgcgcttgcttccgacagaagtggaggtaggtatgggccgtcccatcagaaggtcattcggatggcaaccatacaaatctccgtccatttatgaagagaagggaagtcaagttggaaaaaaagataggataagtccccacacacaaaagagagatggtgcatgtggtatccccttgagatataaaaggaggaccttgcccacttagagagggggacgactctgggaatactggagcaggagaggaaaaaaggaagaagagggtttctagagtaagggcgctcgggctctcgagctctttgtagcttcttcatacacagatccaccaaaacacaggagtagggtattacgcttctcagcggcccgaacctgtatacatcgcccgtgtcttgtgtgtttccattctcgcgaactttccgtcatcttaggagcttagaacctcacccagggcccccggccgaaccggcaaaggggggcctgcgcggtctcccggtgaggagccccacgctccgtcatctggcgcgccaggtagggggctctgcgtgtgtttttctaagctctcgcattctttcgtgtgcgccaagcttttcctgtttagcccaa

SEQ ID NO: 55242 - DNA, 194 bp, Oryza sativa
attccatggcatggcagaaggccctcctgggctcctgttgatggtcgttaagtaccgattttgaccgtcaactaccaaaataaataatatttcttacacgtatattagtaataaataatgttgttccacttgtattagagaaatattatgcatgtagagattatacactaaagtgaagggaaaatgagccggca

SEQ ID NO: 55243 - DNA, 610 bp, Oryza sativa
aactaaaatgtggaatggttggcctgggttggcttgggacgagctgggacccagggtcgggttgccagttcggtctgaatcatcgtaggccttgggttaaggcaggttcgtgtgggttcacggccttgattaataatattggatagttctaggatcgtgtttacaaagtagctttgagcaactaaacgtctttaaatgctgtttactgcaaccctaaccctttatgttataattccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtctttcgttgtctttgtgtgtgctgggccttcgttgcccgtgtaataattttatatacgcttccgcttgttaaactctgatttgtatcaacttttggtgtaccttgcctcctgggacaaggattaatgcacgcacgtcaggaaagcccgttgggttatttccggtcgtgacagcaggactccctccgccttcagc

SEQ ID NO: 55244 - DNA, 156 bp, Oryza sativa
agctcggtacccgttctgtacctgaggctcttgttgagtctcctgtactggcacattatctgtctaaggctgttgcagctcctcctctggtgtggcaataatttatgttgaatcctgtagaacaggttcctcactttcattcattgttgccacagg

SEQ ID NO: 55245 - DNA, 1501 bp, Oryza sativa
tctctctccctcggattcgctcggatttaatcccgtaatcgtcgccggcgcatctatggaacccgagaactccgcggccggtttccttcctccccggccgccttctctcccttccgacgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgtcatcgtcatcccgaaccgcgccgccgctttcctccactccgaccgccgttctcgtcgtcgtcgttgtcccggggtgagccgaagaccgccgttcgctttcccccttctctccgctctctcgggcgccgctccaccgcgctgatggtcgccggcggtgaccatcggggcgcgggcgcgccgctcccgtcggccgtgccggcgaggccgccttcgggcgcgccctcgcggctgccaggtgggcccggccgtcagccgcccgcgcccgcgggacccacggcgccgaccgccgccagccgcgtgcgcccggtccaccgtggaccgagcggctgacgcgtgggcccccacccccgtggacccggtccgcgcgtcccctccctcggctgacgcaataaatgggattttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgaaaaagccttttcttttccgttggtcgtgtagacgctgcagcttcggaagatccgctcttcgtggaaattgaagccggcgtttgggaaagcgagcaaggcaagtcacatcatccttgagcatattgaatcccagtttacaaaattatttttttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaatagaacaacattaggtggttttataactttagactttgggaaattctcatatcttttggacactatggaattgttggtttatggaagaattggacatacacctctcttcctctttcaaaacccctaaaacctgttttcggtggggtttgggtgcatgccagttgtgggaagtagcaccccggccactataaggattaa

SEQ ID NO: 55246 - DNA, 464 bp, Oryza sativa
tacaacaatagcatggctatgacaataggtaaacaccccatagtaacattataaaacaatgcaatatttgaaggaaaacaatagagcatttgcaatataggatcaacatgttcaagtgacaagcatgacttgccttgctctgctgctagaggaacctcggcgactatttcgaactacaccggagcgtcggaagaaccggaatctagcgacatacaaggcaaacattgcaaacaggctataagactactgaaacagagaacaaaaccatttttaatggattctacacatttttcttgatttactgagacctgaatgggcttaaacggagctcggatgaattagatatgaattttagaagattcactgtgtttattactataacaaaaagtccttaaatcatttattgtgcaataaatcccagggctggcgtcagcacgggagggggaggaggcgcggcgccgaca

SEQ ID NO: 55247 - DNA, 345 bp, Oryza sativa
attcctgcagcccctaccttcaagtttgacacggttagaagtaaatgatgttggattgaccacccttccaaggatatatgaccatcatgttaacaacatggattttgaaagcaaggaaaccaagctaatctcagttatcatcagcaactgctcaaatttaatttctctggaggaaagctttctactgcaggagcaccatatccgaagtcttcgtatcctaaggattgttgattgtgaaaagttgatccgagctcctttgttattttcagaaatggataatcttgcagaatttcatattggtaagtgttaccggttgagagtgagggaaaacgatgataatgtact

SEQ ID NO: 55248 - DNA, 1501 bp, Oryza sativa
ccaccaaaaaccgttttccatagtatagaggtctcaaaaaccattcgaaattttgttcgaatctactttttgtcatgtcgaaacctccaatttttatgatttttttatcgatttttattgaaaacataaaccatgccctgtgttagccattttatgcaatatgttgattttacttgtttctactttaacatagagggtgtttagatctaggggtgtaaaattttggcgtgtcacatcggatattatatagggtgtcgcatggggtgttcggacactaataaaaaactaattacagaatccgtcagtaaaacacgagataaatttattaagcttaattaatccgtcattagcaaatatttactgtagcaccgaattgtcaaattatggagcaattaggtttaaaaaattcgtcttgcaaattagtcgccatatgtacaattagttatttttagcctatatttaatacttcatattggagtttaaacgtttgatgagactaggtgaaaaattttggggtgggagcggattattattgtgaattatccgcttggttatggggtaaggtaaaattgcataatccgatcagacttaattccttggcgggccataccagctagttgtccagcgtagttatgtctcgagctttttcttaaccaaagaatgatgttacttccagctgacagcaaacacacctttcactcgaccttattcgagaactagtttaacttggctgatatagtccactacaaatccatgtgaaaagaaaataggctgaatgacctactcacgtgtgcggagggatcaatttcggtctaacaatattaaggtgggtgagcttttataataaaatatgttatggggttgaatctcaaaataaaggtaatgattaggatggtttatataattttgtcataaataaaatattttaagcaatatcgttttggcggaaatgtatttttcaaagcgtttagcgaacaatctgaaatatttttatttttagaaaaagaacaagtccattgtcgtttcgtggaatttaattaaatttattttaaggattttcagcatatcacatatccgcatagctattttatacgggactacttagaaaaaaccgcaacaaattttttaaacaatttttcactatattatactataactaccatacaactttatgtaagtattaaataaaatacaatttcatactgagttatgtagagatacattgtcattatagttatgtagttataatgtaactataatataattatattttacaagttactagttataccacaaaacttaattatattgttacatataaaagttttctcaaaagtaacttcccattttatatacccaccctctctcacgacaacatcatcacttcattatcacatgacagaccaacatataatgatgattaagaaaaaaaataaaattgttaacagaatacggaaggaaaaaaaataaaaaaaaaaccggcttctccgcctatcgtgcc

SEQ ID NO: 55249 - DNA, 1501 bp, Oryza sativa
catttcttgaaagttttgttaggacactaatcatttcactcccttggattggctggtctacagcatatctttgataggaagttgtaccacatgagttgtaaatggttttagattggcaatagatgaactggcagggcttgtaagcttgtttctttttctgcagctgaacgacaaccaccatttatggacaacagatttcgtaattgccatgtttatgtgaaaccatggtatcagatttgatctttgggttgccatgttacatgaatttcttgtcaggggcttgtggatgttcatatacatcacaggctgaggcactacaccaaaatgaccccataaagacgtttttctctagatgctttgaaacacgtctctgaatatggtatgagatagaaaaaaaaaaagacgcttcgggagacatttttatgaatcgccacaaaatttctatggtaaagatgtctttttcagggatcttaatcaccaaaacagcgttcttgttatccttccgagcagctcaattccgacagtccaaagcccaactgttcgcggttgttcgtgattttgtccttctaattgtcccactatatatccatcccacaatataactgattttgtccttctaattgccccactatatgaggaattttggcatactacttatcatatataagtgactttattctacattctagtatgtgaaaaattcctgaatttgaattgatatatggatgctatgtgaatatgaaaaatgcttgcatgatgtgattattgttttttttctcttttttttgggctaaaaataattcttccatgcaagtgacttaagatgctgcctgcgaaaatacgcggtgctcttagtgcagccgtatgtgaaaacgatttttgtagatagtcaaaggtccgctgcaggtctttagtacaggtggagtatttggccgcctgaaaaacgtgttttggccacgacaaaaattgtttttctaatagtgatagttagtcagccatcaactccaattcaaatttctacatatttttaaccctcaactatccactcacccacaaacatatctcaccccaactatacattatttttttcatgattttatcttgcactagttattttttagaaattaactaagattaagtttacatataagttcctattgtaaaaatgtatttaggtgattgtaaaatttatattgaattgtactatgggtcggttattattgcccgagtttcattttagactaggttatatctaatgttttcactttggttcaggttttcttactttctgttgcacattggactattttttttgtgatttcattagcgagcttaccagcaacataataaaccaatcaatattccatctgaccttgatttcttttactccttgatttagctgcttgacttctaccattttccccttaaaaaaatcaagtgagcttagagcaaatcactgtattgagcttgcaagcgacactgcgacagctacaacaaccag

SEQ ID NO: 55250 - DNA, 293 bp, Oryza sativa
ccatcgtcgccacgggcgaacgcgtggcctgccttgtgtcatccggacgcggggttcaccatcaacggctccacattccacaccgatcttttttgtgatgcccctcgcaggtttcgacgtggtgcttggcactcggtggctcggcacgttgggtcccatcgtgtgggacttcacctcccggtcgatggcgttccagcgagacgggcaacgcttcgcctggaagggcgtggcctcgacctcaacaacgcacctgcgtaccctagccgcggccagtgggacgctcctggatgagc

SEQ ID NO: 55251 - DNA, 1160 bp, Oryza sativa
attcctgcaccccatagttacaatacatttgtgtgcacccttggataattaccactaaatcattcacatgaaaaccattaatgaaaagaaaaaaaaacaggctattcacttgaaaattttcacatactgtttggagtcaggcaggctctgatgtctgagccacctgaaaagccaaaccagatggactgatggaccaacttcatatgacacacacaactggcatactgatccgagttccatataggcaggacagttcacgagcatggctgctcaaaactgttgagctactctgctttgtaaaaaggaagagacagttaagtacaggagcaagcagtctgaggctctgctccacatgagttcactgttcagtgtttaggtcagggggacctggctactaccagtaggagagtactacaaccatctgattgcaacatgattcatgaaaaatgagggaaaaaggaaggggggaaaatggaaaaagaggatagtagtagagggaaactattctaatcccttgagggatgttccctcgtttgcttaaaaatcatttaaacggttatgaaaaattctgaaaaattttgacaatattcatgcaacacatatatacaactctacaaaatcttaagttcagactcaactcacacgtcgagatataaaaaagacaaattcaacgtataaatagtagcgtaatgtttatatctaaatttgtcttttttgtttcttgatgtgtagatcgaatttgaacttgacttttggtggagtaataggtatcattatactctacattgtcaattttttttcataatttttcacaactatttgcattgaatttagaagaaaaagatatacgaggggatatcccctcgagggattagaatcgactccctagtagtagatgatagaatgatccccctacatcatgaaaggtgctactacatccaattaaaaaaaagtggacttttagatccctgatatctgatgattacatagtacaatcaaacttttaatgacttcaaacacaaatattggctagtacctccgtcaaacataatatgaggcatgtccagattcattatgttaggacaagtcacatcctagattgctacattctgatatgaaaagagtagtagcgtagatccgtgacttgagagctcacaaca

SEQ ID NO: 55252 - DNA, 267 bp, Oryza sativa
agaccgtgcaaacaatgtggtatggtatgtggcgccccctttcgaccgatgctcatgccgaaatttacattgttcctgcaaataaagtttattgtctatgtgacaggtattgttttcccgctcttcgcctcctgcggacgcgcgggcaggtgaagcttgcccctaggaagcgaagggttcttgcttcctccgattccgatgacgtgaacgacgtcgaagagtgtgatggcgaggaggaaggggagtaagaagaggaggcgaagccca

SEQ ID NO: 55253 - DNA, 1501 bp, Oryza sativa
acctgcagacgccatcggcagacaggtagtaggcgtgtagaactgcagaattgctgcaacggttgaagctagcggaactgtagaggaggctgccggctgtccacgtgtggacgcctgctttgccgtcgcctgccatggacgagaagaaaattgatctgctaatctcgcggatcgctagggcattaggaacgtcggcatcagcacgtcgctaatcgttagggctggacggatcgatcatcatacgcggaagcagagtaggcctactcttcggcatcttgggaggggcccctgggtttgggggggcccagtgcagccgcactgctcgacccccgtcagggccggccctgagtttcaggttaaaatagaatagaggaaaaagctgccatattgcctacaatattataataaatgtattcttagtatctattatcagcaagatacgtgatgggagtcaccataaaaaggcctaagcgcatatacaacaaatatacttaacagggtaaaataaaaatgcatgttctaattccttagtgaaaatacctttattgtgcttttgcttagtatctagctatttcccacctaaaagcctccagaatacataatggacaaaagaacagtgtcgatttaattctagagaaaaaccaaggacactaaaaaggaacttacagaaataaaacattgaagaaataatgtaaatgtgaagaatataactgataacaccaattatcaacctttttcaaaatgccaaacacaatataactgacaaccaatttacttgatgccagccacacatcaacataatgtccagttgatgccttgatggtgttcatttgtgctacaaattatgtgagaaaaccatctcaaataatcaaatatattaggctaaccagttggtgatgtatccggtaggtacaattcactataaaaagtggttactcattgaatgaatacttgtgcctcttttggtgaatgctactaattgtttttctccatcctgactcgaaattcgtgtataattgataaatatattgatgtccccagagatggaaaaccaacaccttggaagtttctctgaaacttcagatttcagagaacagatcacttgaattgaaacaaaaaaaaaaaggaaaaggaactgcatgctgcactatttaatagatctgcgctcaaattagtaatattgcaatggttgttcaaacatgcaaaaaagtataggaatgtgtcatgttatcgtaagataaaagctgcaacaggcagaaatacaacctctctttgttgacatcagcagcaagacaatttacctgagcttgttgatgatatttgtggggagcccctaatagtgatgtccattgcaggtggtgaagcggtggctgtttggagcaaatatttatagagcatctcaacaaatacatggtgagcattttaacaaacaaacagtaagcacactgttgtacaaaagattgaaagggaagcatggtgcaggtgcaggcagagcattgga

SEQ ID NO: 55254 - DNA, 395 bp, Oryza sativa
aggtcctcatccactagacctcttaaaactactaatcttttttcctcgttttagccattcaagcattaatattccttcgtttctctctgcattaataaagggtatggtagtttttttagcctatatctttataactttctaaaacaacatattttttttggatagagggagtgcggaaatagtactccaccatttagtatcacgggaagtgtgccgatcaatggatttttctattgcttaagcaagtactataagtgtttagagcatgatcaacaatcgctcaatactattccaatcccaaagggtttttaagaaaaaaaaaagatccatcaaaactcctaatcagattaaaaaagtttgggatttcaatcctgtgatttacgttctccataagt

SEQ ID NO: 55255 - DNA, 1501 bp, Oryza sativa
aacgcaggttcacgagttccttgaagcgcccccacgtcggggttccctcatcctcgagcagctgggtgtaccaagtctgcgtgacgtcgtccaggtggtaggacgccatgccgacgcgctcttcggccatggtacggtggtgacggaagtacgcctcgaatttgttgaggaagagcagcggatccgtggtgccgtcgtagcggggaaaatcccacttcttgggccggggaggcaggtcgaggtcgcgcaacccatcagggtggcgagtctcggtgcttgcggccgtcgaggccttgtccttcatggtcgccatatcggccttcagggaggtgagttcggcggacatgttcttgatctccttcaagaggtcggcgatggtgggctcggccatgtcggcggctgggttggctgcggaggcgggtgatgggactggggatggcggcgctggtggtgggctagtggcggcgtctggcgtggaagatgaaggtgcggcggctgctggggctgaggatcgagtggatcgtgataccaggttgtcaagagccttatgatctagggtaggcggccctcgactacggagttcgtaatctccggccgtggtcttccgatgcggaggttattcccctcactgccgatcgggcttgagagcgagaggtaggagagcaggtaattgatcttgcctccctaatcttttcggtttacagggaatatatggccatcggccctaaccaacggaggaaacaaactcctcgattcaaggaactaatcaaagatagcaaataatatcttaacaactaaaaatagctttccaacttcagccacttgcgctgatcgcttcatcctcggttgcatgcgccgtgcccgcgatcaccgcgcgttctgcgtccatgcgtgcgcccgcacgttctgctgcccggcgcacatctctggctcggtgtctcctggtgtaggtcttcccccacatgacactatcttaatttattattagaccatgttctgttagcactattaccacccaaattccatgtttctacatagttagctggaggatttgccttcaaaaattcaactgtttcttgctgcgacactgtattgttagcacaatatgtgaaactcagtcatcaatcctgttcgtgtcaaatgtgttgttttcaaattctgtgaattctagagctctgtatttagaccccagccaatgtgaattctagatctctgttcgaaaagtaggcgaaatctgaaatccaatttctcctgtagtttagtacatgctgtgcacattagcaaactgttatctacagtttcccaaagaattcacctacagtaagcacacatatgcgtttcaatttattttccttcagctgaaaataactgaaatgttatatgtgtttatgttctccttccaatgctctgcctgcacctgcaccatgcttccctttcaatcttttgtacaacagtgtgcttactgtttgtttgttaaaatgctcaccatgtatttgttgag

SEQ ID NO: 55256 - DNA, 1501 bp, Oryza sativa
tctctgcattaataaagggtatggtagtttttttagcctatatctttataactttctaaaacaacatattttttttggatagagggagtgcggaaatagtactccaccatttagtatcacgggaagtgtgccgatcaatggatttttctattgcttaagcaagtactataagtgtttagagcatgatcaacaatcgctcaatactattccaatcccaaagggtttttaagaaaaaaaaaagatccatcaaaactcctaatcagattaaaaaagtttgggatttcaatcctgtgatttacgttctccataagtggagaagacctctcgctcccaatccaccgatcgtgggcaattttcgcacgctatggagatgtccacactgcaccagtcctcacaagctcgtccgtcgccaatcccgactcgtgccgccgttgggcgtcatgtgttggtcatttgccagccatcgatttcataccattgccaacccgtcatgcaagagaatgagagaaggtgtagaggaggaagaaaagagggattaacatgtgggccccacctgtcgggttattatatatgagaaggggagcggttgcccttttttttttgaccgaagagtggttgcccgttggtagttttgtaggtgatcccatcttatattacatagaatcatgtgttacctaatctgttggagtggaggatattttagaatctcaaatcctagttaaaaatctccaaaaggttatttagggaggtgatttattgggtatctcttagtgatgctcttaaatgctaccaaaaatataacataggattaggtaatgagatggagaagtgagtggagagagaatgagttactcctcacgcaaagggtaacatctcaaaaaaaaaagcaaagagggtaagggcacatttgaatcaaatgatttatataggaatttcataggattcaaatcctataggaaatttcataggattgaagctttccaaatcctatgaaattcctatggaaatccacgttgcatgtggattttggaggaaatttagcaagagctccaacctcttggaaaatttcctctaagtctatctctctcatctaattcctacgtttttcctgcgctccaatcaatcgaccattcctatgtttttcctgtgttttgtaatcctctgttttacacttcaatttctgtcagaatcatgtgtttttcctatccctccattttttcaaccctacgattcaaaggggccctaagatagcgtgagagtgaattatcaaaagaaaactattgtggttgtgtgttagccgcaatatattatatattgtagatgaataggcaacacatttcctattaaacttgctcctatataccccttcgttccaaaatataaacatttataggtagtgagtttttttttaaaaaaaaacaaaatagaacgcagccgagatagccgtttgatccatatcggacggtcggaaataatcggttgaccttgtggccacggaaca

SEQ ID NO: 55257 - DNA, 589 bp, Oryza sativa
cattggaagtatttttaacaattcaaagatcatttcagtgattaatttaattgggaaagtaattaaaattcaccttttccttttcgggccgaattaggaaaagtcctctcattctcggcccagtctcctctcagcctgcagcccttttcctctctttcccgaagtctgctttgtgtccctctttcaatcgggccaagaagtagaagcccagccaaaagtctagtttgcatccctgctacagtggcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaaaaatcggagctaatcgttgagtatcttgcccgaatcgaactcgttttcgagtttatctccaaaacggagtttttgatttcccggatcgatttcttgcgggaggagtccgatctcttcaatccaaggaccccctagtcctcctctttcgtttgccccctctcccgagctctctcgtcaaccgtaga

SEQ ID NO: 55258 - DNA, 1501 bp, Oryza sativa
ttatgctgaatggtccacatcgtcaatgacattaagtgatggaagccataatagtattttcaacacaaaataaatgtaataatacatttaatgttagatttagtgaaactaatttggtcttttagatgttattttttttcctatagatttagttaaattttaaaaagtttggttcttaaccaggaggctcaatgtcaatgaaatgcgtctggctgagcaagtctgactttgttgagctgcctgcgctactttgctaatctcgcgctcatttcgtaatctggagattagctttattattatatttgtagagtaatagataataatagtaatctgggtagttgaagtttctattgattttcatagcaatttcctgtctctattggacggggctgatttaaggttacgtgggtgtgcttgagaagaaggggattggggagattgtgaagatacgcaaaacgaggtgagctattagcacatgattaattgagtattaattattttaaacttcagaaatagattaatatgattttttaaaacaactttcttatagaaattttttacaaaaaacacaccgtttagtagttcggaaaacgtgcacgcggaaaatgaaacgatatttctctctttctcctgcgctcgaacgcacccttaaacgggctttaaggtagaaagtacacgtggactgcaagcttctatttagaaactgcaatgctgtgccttctccaaagatcgataaacaagagatatttaaccatttgccatatttagatgtggcaattaattttttatcactagacccatatgtcatagacacatgtggacccacatgtcattgagatatgggtggcaaatagttatttgccaaatctaaaagtggcaaataattaaaagccccgataaacaatgcttcctccgtttcacaatgtaagttattttagtatttttatattcatattgatattgatgttaatgaattcagttaatataaatgtggaaaatgttcgaatgacttacatcgtgaaatggagggagtatatcagtttatatagtcctgatcaatgttggcggttaaggataatacttaaggagggactaatttacttaagtcggtgcaaaaatggtcaacaattttgactggcttgcacaagtataacgtgagctgtgacgtgttggtcctagtcccaagtcggttaacttttgactataaaatgcacatctaacattcatctttcagcactactgtctcgcgagaaaacttctttcattgttttgtaactaagcggtgtcactcctcaaagctacacaagctagctcatcctgaaattctcagacaacctgagctcagctagcgctgagctgagctccatggcgtccaaggaccaaaccgcatcctcgtcggagacgacgacggcggtggcggatgatacctccagccaacaagacgcaccgccccacccgctgcaggtgacttcgccggattcttcgttgccgtcgccgtcgc

SEQ ID NO: 55259 - DNA, 357 bp, Oryza sativa
ggttaggattaaatggaagagggagaatgaatggttaggatttaaagatgggtgaaatcatttcccttttccatttgccaaacattgcccacgtctaagggcctgtgtagttctcaccctaaaattttacaccttatcacatcgaacatttgaacacatgcatgaagtatattaaatataggctaaaaaataattaattgtacagattacgactaatttacgagacgaatctattaagcctcattgctctatgatttgacaatatgatgctatagtaaacatttgctaatcacagattaattaggcttaataaattcgtctcgctgtttactgacggattctataattggttttttt

SEQ ID NO: 55260 - DNA, 221 bp, Oryza sativa
tcgttctggttccctcgctggttctagagacacaatccaaatatgatattgcttgcctttttcaatagccactcccttcctaggggaacaggcgaagggagagtgaaaagaaaaaaaagcacacgaacctacttggagtcgttcacgtgatggctgaagtctgaactctgaagaggatcgatgagccagcgcaccgagcaacatactgtacatatgccata

SEQ ID NO: 55261 - DNA, 320 bp, Oryza sativa
  unsure (1)..(320): unsure at all n locations
gaagacatttgaaatggtagattgtttatgcctaactatattatatataggcagggatattgatccaacaaggccgcattacccaaccatttgtcttcccaaaatctgatttgagatccatccttaattatgaaggacccatatcgaagaaaatcatgtttggccttcataaagctacctagaaatgtgaattcncccagctttcaatagggggcttgtgataaatgctgaaatccaaatattgcgtatcatttcttgccacgtaccatttgttgtaagcaacttatgaagccatttactaactaaaacattattcttta

SEQ ID NO: 55262 - DNA, 1501 bp, Oryza sativa
cccacatctaacgacatttaactaacctaagcaccatgcttatgttaataaataatgtcactaattcccgcaatactcctacctttcggatgaacaagttaaaacttgtgcaactggaagtgcatctagcctcctattttgatggtcaatggcaatcagattagtgaggacaaatgcttacaattgagaaagtctgaaggaacattagccccccatgagatgatgttcgatgcaatattcttatgaatggagttttgatgaaagcggcacaaaatctattggtaaattgtaaattttcatttacttgggtcaataggaaagccatactattaaggggatgctgcataaatgtctaggaataagaaaagtgctcaaaagtctttgttgaagtggttctcttttcttagaattgcgtactggtgtttttcggagttttctaaaaggggcaattttgttttttcccttgctttgatgtccaatattgtttgcccttgttttttattctttcgtttttacccctacttttttttcggtgtgtttagttccacgccaaaattggaagtttaaagactaaaattggaagtttgaaaaaaaaagttggaagtttatgtgtgtagaaaagttttgatgtgatggaaaagttaaaagtttgaagaaaaagttgggaactaaacaatggctttgaaacaaatcaaaccgtttgctcttgttccgttaattcttactaaccttaactgttaaatttgggagtaaaaagacaaataaccctagttaaatatagttaaatccagggtttataaaaccgtgtgattatcaggttatcacatgcagtaatcttctcaatttttaaaaccacagtatatcttgcggtaaccacatggttttcgtggtaatcgccctggcgcagctgggccatcctggacttgaaccaaagaccttgcccgtgaagtaaatcatcgcccctacgatccaaccaattgggagataatcaatagactcattttcgggagcgttctagctttgtcaatcgtaaaatgagccgctccatccttactgtcctggtgaattaattgggtaattaatgagcacactgacgcacaaagtctatagccggtaagccctagctaaatcagatgcttgaccaatcaattactcactggtacggaaaacactataggtgatcattagcatataacgactcaaatattaactaataattttgtaatattaaaatattgatttactttattacggagtacagtttttataaaaagcacttcgtgaaaaagcatggtcaaaataaaaaaaaagagctcaaaataaacagtccgtaaaccgtttggaccgtccgatgagctcgacgagcagacggtccgtcgcccaacggcccccaaccccccgacgattcccagatcacagcaccagcacacctagatctcgatcgaaccggtagccctcccgttaccaccaccctcctcctctctcctccccaccatggcga

SEQ ID NO: 55263 - DNA, 1501 bp, Oryza sativa
actaatttaatctataaatgggttcacggatcgtcccacttgtatccctagatcatatttcggtatttcgtttttggcgtttgtatcggagagtgccgatataccaaaatttttgaaatttcagaaatttcggtccaaaattttaaataaattttgatcaaatttgaacaaaatactaccaaattcaaaaaaaaaatcggccgataggaccaaaatttcgaaaatttctttctgcaattttaaaccttgccagagatacggtaagtcggatcacgacatgagatctctagaactacttatttatttgatttataagtgagttcgcgggttgacctacgtgcttccctacagcggcgggaggagagcaatcgctcaccgcatccgcgtcggcgtcgcgccaccggatagagccggggaattgttggcgtttcttcagttctcacgcacttttacagctcgaaaccgcgcgtccggtattttgtcggcgtctcgttcccgtcacgtcgccgcgatggacccccgatggtgagtgagcccaccacggtcccagagcacacaggtggtgaggaggaggaaggagaaaaggacgaaatcattgggggtttttctgatcagggctcacctacttgtcgtcagttgttggttggatcgaccaatccaattagccaaaccgacaggtgattttacattgtactctatcgtcttgcaatcacttgctcccttttattcacatctgttaagaaaaaaaacacaagtagctgatgagctcgtagtagaacaattaaatgaggaagaggagacgagatccatttgtttaggccacagcaaagaaaaccatgtcgcaacagctaatctctgaaaagagagagagagaggtgagacagagacaaggaagcgaggaatgaggccgtggtgatgatgaagaggacgaaacatttccaaccagacgatgtactctccattcatcttggaaagcaacacgtataactgtaaaggtgtcctcgtactctctgtcatttttctgacaccaggttaggatctgtcactgcatacagtacatctctccggccacgaacctgtgacagtgggacatcaacccaaggacagaagaaatccaattccggtacataaagtttttgttttcttctaccaactaaagacattcttgacgtatgtggctgatctgctagcataactttaggcttttcaacactggaaatccgacgaaaagctggaaaagattgtactagaaaaaagtgaggctttggctaaacaagaactgttctagtaataaacaattcaattcacgtcggttgggctcagattctaattagcgtaagaacattggaaaaacaggaattaaggagcacccgttgcaactaactttgtccataagtactaccaacattctagtaccaaagagggcgttagattaagaacaaaggagcacagttaaacgcaccaaacgtgatgtggactgggcaagaaacagacatgtaga

SEQ ID NO: 55264 - DNA, 1175 bp, Oryza sativa
aaatcttgtttaaatttaaattttagaaaaaaaaggaaaaaaaatccccaaagaattctagaagtagtgcaagagttgtaatgatacctcgtgatataaatttatgaaaatgctaagttaactccatattttggcataactactaggctgtgttgcttcaaaatcatggtttggtgctcttgaacattacattatggacactataagtataatctttgtagtcgtgttgtcgtggacatcataattatttctattgttgtcaaatatgaggttaattgtggttttctattccctgcaattttctctttcttttgaagtcgaagaccctggttacagtggcttatcgcgcgggttatcgcaaactacccatccatagttgtctcccttcttttctctgattgttgtgttcccgtcaaatgatttgaaagactaagcggtctaacctatcatatccggtgacccaaaccgtctaaaactaatcgtcgtcagttggggttggctttgtggtgcaaacccatcccaaaatgctgatgaacatgccaaattgtttttagagaaaactccttctatatgtaacaaagattaattctacctaattaaaaaaaaaccttgagagtaccaaataatatcacaaagacatttttgccttggtcttcccctcttccttttgattccttccatggttcaataagcagtactccctccggtttcattttaattgacgttttggacaatgatacggtctacgagatatatctttaaccttatttttctattataatatatataataaataaatgcatgtttacttttattatagtgctttaaaagacaaatctatatatgttgttctagttcctttaaactaaatatttataaagttattgatggtcaaagttattaaagtttgacctcaaccttattcaaagcgtcaattaatatggaaccggagggagtaatcatataggcccatgcattggcgccttcgctgtgagacagcagctgcggccgcgtcgaggactcgaggctactgcaggcagagagatggtgtggacttgtggtcgaggacccaaagaacgccgcatgcatcagttacttcggcctttgaatattaatgcaatacaaatctactttcaattttttatgttggtcaaatggagtactacaataataaa

SEQ ID NO: 55265 - DNA, 334 bp, Oryza sativa
ttgagtccccgttttggcatcatcaccacgcagtccatcccgcgggcagtctttgttggtggctggctgaccacgcggctgaagcgttgaacggcgaaccgatgcgaggagacgtggacggaagcaaggaatccctcgacggcccgcatggactcgtgggctctcctgccgtgccgtggccgtgacccaaacaaacccagaccgcgtgcgcgcctggaagcttccagagcccaccaccaccttcgattcccccaacccaatctatttattcgcgccgtcgcccgccgctctccgcctccccacctcgcgttccctcccctctcccctccggcca

SEQ ID NO: 55266 - DNA, 307 bp, Oryza sativa
ccatagaattttcatgtgaaacacagatacaaggaactatgtttatagtaaggaaagtatattctggagagtttgaaatccttgcgttgttaatgccatgatcataatcagatctcttgacattgttagggtggctaatacctgctaattactgttgttataaagcaaaacacatgatcccctgtttgttaaattcgtgataagctagctgtttgtttgagttatgagtgaattaacatttccaacctacatttataacttgttattacctcgtgcagtggaatggtcgttagagatcgatctaagc

SEQ ID NO: 55267 - DNA, 1329 bp, Oryza sativa
caaaaaagggaaaacaaatacaaggcagccccaaaaaagaaactcaagatgaccaatcagccgaggcacactgtacaagtgcaacacatcaacctgttgtcagatgcatcatatgccggagagctgttggctgttgcatcgacctaacaaagggacataacatcacatctaatcaacaaattaaatcaagccaagctaaaaaggatcaccaaaacatgttgtaataataatacacaatatataatataattttgcataaaaaattttgtctgccttgcttttgtcacttggggcacaagcttggaaggaggggataggtggttgtaaaagcatcaaaggcttcccggcaatgcaagcaacggcaatggcccaaccacagctgcacgtacacccggtgatgacaagagcagagcagctccattacattttgatttctgcaaattgttgtttggtgaaacttcggcctcactctctcctttttgtaaattttgctacactgtttcaataagctcactataaagaggttatcattgaaacgaacaaaatttgattttagattaagggccgatctttgtagtcccttctctttttaaataattattcagttcgaaatttgacaactcatcatttttacgaaatatttgcgaagtcttgaaaggatgataaattcttaaattgtattactccattaatttagtctaaccattttagagtaattagttaaattcatggtaaagtcagaattgatagctacttgaaaatggagggagcatgcaatctcatgtccatttgggacacgagaaaaattccgcgactctaatagtaaataaattattttttagttgaaatatatgcattctaacatggttgaaacataagaaagaaaacttgtaattatctgctgcttctagaaacaaagtattacggctatgccgaaacttgaataggaacaaaatactaccgtaaatggtctttacaggagatgctaatactacttactgcttctggagaggcttcccttcattctttccttcgtttgctcgtcactttgggccaaagcaagatggagaaaacgtgatggtcactattcgctcgagcagttcatcttaggaaatttaactattttattactattagatgagggcaactacacaacaggatcctgttgtaacggaatacattatgaatctaattcccccgtttttcttgttcccatgctagcggcgacccctcacctttttgcccccaccgacatcaacaacaaataagaggagagatacgttgaggagaggaactgaggaagggagaacaaaagaggaggcaatgaca

SEQ ID NO: 55268 - DNA, 299 bp, Oryza sativa
aagaagaagacgagaaggagagagagaaaaggaaaagagcaggtactgacatgtgggtccatgaacagtacattttcatattttctagatttaattcaaaacccaatctttagaagcccatatttccaaaccatagatccgattccgataaaacttggacctaaatttatctaaattcaaaccctatcttttgacaccaaatttgctattttataattttatttgaatttattcaaatatcgtttgaatttatattgccttttcaaatattttcttttgtcccaaattacccttttagc

SEQ ID NO: 55269 - DNA, 1501 bp, Oryza sativa
tactagaacagttcttgtttagccaaagcctcacttttttctagtacaatcttttccagcttttcgtcggatttccagtgttgaaaagcctaaagttatgctagcagatcagccacatacgtcaagaatgtctttagttggtagaagaaaacaaaaactttatgtaccggaattggatttcttctgtccttgggttgatgtcccactgtcacaggttcgtggccggagagatgtactgtatgcagtgacagatcctaacctggtgtcagaaaaatgacagagagtacgaggacacctttacagttatacgtgttgctttccaagatgaatggagagtacatcgtctggttggaaatgtttcgtcctcttcatcatcaccacggcctcattcctcgcttccttgtctctgtctcacctctctctctctcttttcagagattagctgttgcgacatggttttctttgctgtggcctaaacaaatggatctcgtctcctcttcctcatttaattgttctactacgagctcatcagctacttgtgttttttttcttaacagatgtgaataaaagggagcaagtgattgcaagacgatagagtacaatgtaaaatcacctgtcggtttggctaattggattggtcgatccaaccaacaactgacgacaagtaggtgagccctgatcagaaaaacccccaatgatttcgtccttttctccttcctcctcctcaccacctgtgtgctctgggaccgtggtgggctcactcaccatcgggggtccatcgcggcgacgtgacgggaacgagacgccgacaaaataccggacgcgcggtttcgagctgtaaaagtgcgtgagaactgaagaaacgccaacaattccccggctctatccggtggcgcgacgccgacgcggatgcggtgagcgattgctctcctcccgccgctgtagggaagcacgtaggtcaacccgcgaactcacttataaatcaaataaataagtagttctagagatctcatgtcgtgatccgacttaccgtatctctggcaaggtttaaaattgcagaaagaaattttcgaaattttggtcctatcggccgattttttttttgaatttggtagtattttgttcaaatttgatcaaaatttatttaaaattttggaccgaaatttctgaaatttcaaaaattttggtatatcggcactctccgatacaaacgccaaaaacgaaataccgaaatatgatctagggatacaagtgggacgatccgtgaacccatttatagattaaattagtaggtaatccgcgggttactaattttgtttataaatggattcgcgggttgattcacttactttcctacccgctggtgcatcggtgatctgatgatcatgggggttgtggcctgtgtggcctactggccacgagcgctgcctctcacaggttacgatttgtcacgggtgttgcctattggtgagatgctgtgatctgatggggttgattaata

SEQ ID NO: 55270 - DNA, 1501 bp, Oryza sativa
tttaaaatgagcttcttatgtgttcttctatgctctttagacttagagcacatcattatttttcaactttcacttctggcctcgttttctctctagtaccgatgtctgatggactatcggcatatacaagtattagctaggttggtgcttaggtatcatgtctgattccgtagggtatcatcgggtatcgatgagataccaaatctagtaccgttgggtattagtctgtgccagtgtgacataagatgtgatatccaaatggtattgtactattcgaacgggacaccattcattaacgagctattttacggtcagaaaatatacaaggtactactttttatattgtaaatttatacctcttgatacctaggtattatgagataccattaagtatcaaattttacactaaatttttattatctcatgttacctcatcaagaaccgtagaattgctcttcagtaacattccccctttaacatatggcttggatgtggatggattttaagccttttagttttaggtcaaattttccggtccatctactttgatgtgtttaaactggggaaaaagtacaccgaagttccctcaacttgtcctcgagttacaaaatcatcccccaaccataaaactggatacaacgtatcccctaacttaaaaaacagtgtaaactaggtcctcagcggatttgaccccggtttgtctaatgtggcggctgagtcagcgtaggacccatgtgggccccatacgtcaggatgccacgtcagcgaccagcctctcccttcctctcctttcctcccttctctctctcccactcttctctctggattgggcaggccggccggcggtggggtggtcgttgccggggcgaggaggtccgacggccggcgcgacgtggcggcggcggccgggacgaggacgttcttcttcacgggcatcctcctaaagctcccgacccagcgcaaggtccccgatttgcgcgcacgccgagaacgccgcggcggcggcgacggtgtcgatgcacacgccgctatcatccgccatggccgtacaagaaacgacgtcccggccagccggcggggaatccgtcgaagagcgcccacgcggaggcgagctcgacgcgcgcgaggtagagctcgacgagcccatcgcggacggcgaggcggtggtcgaggccgagcttggccgtgtgtgcgtacacggccggcgcggcctcgccgtggtcggcgaccaagcccttgataagggccctgaggcaaagcggcggcagtggcgctccggcgagctcctcgccggtgcccttctgcgagctgcggtagctgtactagattaacttcttgcattttttttgcctaattgtgatttgccagtagaatgacactgattttctatggcctcttagttggatgagataagaagagatgagtatgacgagatggcatttgtagcacgaaattaatttcttgcctgtttctgctggatgccaaatttgcaagctttgat

SEQ ID NO: 55271 - DNA, 1501 bp, Oryza sativa
gatttgatcagttgcttgattgatcctttttgttgtgattacgtgagggtttatatttggattacgatttttcctctgatcggtgcagaggttttgtcttgtacatcaaattggttactgggttatgcatacgacagcattatggatgaacagcatataattagaaactgtttttagacatgttttttgtactttgatgtgatcatacggtttgtttggttggagggagttagtgatgaggaatgggagtttatgatatctaggagtttaaatctgtagtttggttgaaagacttgggaattcgagagggtttgggatagggaattaagaggtccaattcccatcaatctcttgcctgggggaggcctgttaattcgtgagacttgtagggaattcgatgtgaaaccaaacaagagatggggactaaaaatgtaactcccatgaccaatcccaccatcaactccctccttaaaactcccattcctcttctcttctcttgccaaacaggccaataggtccattcagattggcaacccgtcttgctcctgtgcaatgtataattgtacattggcttgtttaatttgttgctgaaattaaccttatctgacacactttggagtttccaaactttagcaatgttggatgtgtgtagtttgtagcctaaccaaaatttagtagtgtttgtatgagaagatacttttgaaaataccaaaattttggtaaagtgacaatgacaaaagtttgcttagtttgttaccctaacaattcttggttattacgaaagaattggtaggactgaaagtggtggtaaagtgaaattggtagagttgtggtttatttcgaatttagaactttacattcggaatcaatttagggccaacttttgtcactttgctttgccttttaaactgtccgagtagaagtacaaaaattcgtcttcagatccgtgtaatttcgggacattttattgtcactttcttcacttagctttcccttttagactgttagagaagtataaaaacttgggaaaaaaaggaataagttcccttgaggtcccttaactcgacgagttcaatttgcatcctagaaccataataccagatacaacggatccctcaactgtcaaaaccggtataatataggtcacatgacggtttagacggtggttttgatttcgtgacacctacgtggctaatttgactcggttttcatctgacgcagcatatgaaacaaaatttaacaattttaaaaataaaacaaaatatatggacccacatgtcagtcaaataataagataaaaaatagtggagcccacatatgggcctcatgtcctccccctcatcctctctcttctctatctctcccattctccttttccctcttccccttctccttccccggatgcagccggcacaccaacgagcgagagtggaggcacggcggaggcgtggggatgccaaatcgacggggaagaggtgggcactacctccactgttgagca

SEQ ID NO: 55272 - DNA, 1501 bp, Oryza sativa
gaaaaataacccaagatcaactctaaaattaagcttcaaaattcaatatttggtaataaaccaacaagcagacaatgaaagcctaccactgtcataatattgctatggatacttacatcaacgggactcatgtcagatgttggatttgtgttcgagttggatcatagtgcaccttcctggtatcttgttcaacttccagtgactgacatcaatttgtaataggaataatggatgaacagtaagcaaactcttatgcacgttgagtgtctgcttggactcattagcccgttttgggttgaagccaaaatttatcctacttaattttctagccatttgaatagtacattgtaaatatttggactataaccaaaacctaccaaatcaatactagatgagtcagtgtaactctcgagggcgcttatacttgctgaaggaaagtaccagcatatttgtagggcatcggaaaaaaaaaaacaactattagtatgccatagttagctaaaaaccatggcaaaccataggatctgtttattgattaggcatgataacacaatagcgaaatgatacacatactttttttttacaaacttcctacaaacgctaggtgtcacattgtggttgaattttgactttttatgacttttagttattcaaccatactgtcgagattactaatgattcttgttagtaagaagtctgtaaggaaaacacaataaccgttgtcattgggtcaaattgatgcaaggggaaggagcgaatgaagagtgattaccgatagtgtcatttgttattagaaaaaagtattaaccaaaatcccttatatttttttggatgggaggagtataaaacatcctaggggtgctaagcaaggctcaaaatttgactcaaatacacgtaccgtttctaatgtgctcgtcgcacctataatttcatcgaccggaattcagagagttccatcaaacctctcagttttctcctccaactttactgttagatcccgaaaagtatcattaaatgcctatattttggcttatgcttatgcttataagccaaaatttgaattttcaacctaaaatttggaattgattttgggattttttcatcgtagtttatttttcagcctttacttttagatcaataagaacacgtatatacaagttttattcacaaattattttatatcgcttattccatcaataagtgaaacaatggagccttagttccaacgtatataaaagtttcgtttaaaatccatgaaatttcatcttgggctgtgtttagttccaccttaaaattgaaagtttgaataaattagaacgatgtgatggaaaagttgaaagtttgcatgtgtggaaaagttcgatgtgacgggaaaattaaaagtttgaaagaaaaaaaagttagaattaaacaaggctttgcattttcaccgagattgggaaaagctggctctatctccctagagcaaagcatctctctctgctagcctgcaaagaatcca

SEQ ID NO: 55273 - DNA, 1501 bp, Oryza sativa
tgactatatgagtatattctgatgacttttttctaactcttcttagtgttacacatgtttcaataaatatttttctaatgtttcactagttcttggtaaatattgcacatattatacttgctgaaacatctaaataacactatgcgcaacattcacaaataaagtaatgaaacatcacaatatatttattgatttcgtgtgcagcactaaaacaatatgcatagtataaaaaacttaaaatgtgccacatattcgaattctagctaaaacatttacctctcacacgtgaaacatcaaaacttaatgtttgaaacatatgtaatttttcaattaaaatataatcgtgtgagatactgttgtaaaaaaataattataatgaatataacgatataattagaatgacaattggataaatagtttggaaaataaatgcatgcatccttacattgcatcggagatgcaatctccgggcggtagttttctctatttagatggcgccaatccggcctatctacatgtatgggctgggatttctgttgtcttgtagtcccagatacatggatggatcaaggttgaggtccatccagacaaggttttccttgatctatcaatgttctgacccgtggagataaggctaatgagaagtagtaaaaccaagccaagtcaaaaagaatttaatacaacgtcttatatactcctatttattattcatgctttaaaagtcaatgctaaaaaataataggtgaaaaaaaattatccaaatcaacttcaaaattaaatttctaaattcattttttggttatgggtgataagccaacgagcaaacgatgaagacccatgtcatgctacaattggatcatagtgcgatttgctgatatattattcaaccttcaacgagtgacaatagtgactaacaggtataatggattagatatatactaagcgaactcgtatgcatgttgagtggctgcttggactcattaggctgtcttcggtcaaaacaaaaatttgtcctacctaaatttttggggcacctgaacagtacattgtaaaacgtttggactgtagccaacacataccaaatctatagatgagtcattgttgaagaaaagctatcaacattttagtaggaccaaaaaaaaacagtgtgtcatagttagctataaaaattattgcaaacaactagtgctaaccagtaggaaccggcaggtcggttttgtgaaaccgctatcataaatcactgaactgaacatgacaaccattttattcatgtcacaataatttaaactgtgcatccatccatgatctagctagagttccaaagccatggccatgggcatgaccgatgcaagctaattgaggtctaggggcagcacggcacagggagaccacagacaacaaagaggcacctggtcttggggcttcagatgtatctgccgtagttggggctccgcgcgtacgcgcacaggcacgccgcctacgccctcagctacgcgcaaca

SEQ ID NO: 55274 - DNA, 523 bp, Oryza sativa
aggactatatgagcactggtgctctaccaatccattggtcaaagttagagttgcaatatatatttcctgttcatagaatgctgcacctgtacttttaattcatacaataatctgaagcctcatcacttttttttattagctttagtatattcatgtacttggaagtactaaaagtttgtcccttgtcatttgccaagcagttctttccaaagatcctacatattgtaaaagtgctccaaggatctaccattgcttgggatagaagattttgagtatcttgggcattcagcattctgccctacgtcgccctgtcgatgcatggaacgatggagaagaggcaaagtctagtggccaactagaaaggtttccggtgaccaatgccagaaccttgggtttcacctccctttgatctaaagtatgccattggtaacccccacatgtaccttaaaccatattgatgcatcagactcccaggtgataataaactaaaaattacatgtggtgtggggtgaatcagacgccc

SEQ ID NO: 55275 - DNA, 451 bp, Oryza sativa
aagttttaaatagaatctaacatgaggtagaaacttatgaaaactttcctttgatattttatctctcctctaattcttatgttttttctgcggttcaattaaacgattattcttgtgttttttctatgtttgtaaatttttattttacgcttatattcctgttaaaatcatttttatatctattcctaggtttttttttcaaacatacaattcaaagaggccttgagcctctagaagcaatgattggactacaggggctttattgtagagtattggtaactacgagaggtgaagtgataaaagtgggttttcgggggagagcacgggtggtacagtggaagggcgcggtgttggtggaccagagctgacgtggcgattcggtgggacgtgattgggccaggatgcaggttggtggcccacttgtcagtgaggggatagggctgggtggcga

SEQ ID NO: 55276 - DNA, 1501 bp, Oryza sativa
tccaatcagccacatctctattgcacacaccattgtgcacaacctttagctcatctcttgcactgacaagacatgctctcatctctgagttctccttcaaaccatgaacaacattgtgcaaatcatttaacacctaccttaaataaggtgtagtttctggctcataccatctccagaatgcacagcaaccattccgctcaaatagaagaaaaatcgtacaatattatatccatttaaacaacaaatgcattatattaatattttaccaactcacgcgagctctcgcacatgtcagatacctcctagatggattattcccactcaagaaatccatctgaccgtcattgtacccacacttgcatagaatagccggagaataatcaaattgcccctccctttgtcgaattggaggtggattgctcccgccttgactggatttgctgtcatttccagaactagtcatgtccttcgatctgcttgttccaccggctgcagattccacctgctcatcgtcgcttcttccttgatcagccatctctatagcgtgtgtggcttccatcggcaaccgtcaccgctcgtgagaaggttaggccaaaacaacccagcaaatcctacgcgctgacgtagtgaagggctgatgtggcatttgacatgtcatccatgtgtgcaaaaaccacggtaaaaaacagctcgaagggttaagtgcccggtatcgacagttggaggatgaattatacccggttccgtagttcgtggttgcatttagataaccataaaagttcgagggtgtaaaatggacttctcccctgtaagcctaacccatacagaaagcttaattcaagcttcaaattaaaggggttaaagaatacaaaaccaaaaggagtttttctggcttttttgcaacctgatccagcgtaacacccgaaaaattgcctactcgtcgacggactctcacgacccgcgcgcgccacgcaagaatcaaagatccccctccagcttcaaacacgctagccgacgccgccgccgccgcggcgacggcgcgagcgacgcctcgtcgcccttggagaggcctcgacagcgcgcggcgcgggcgcgccacaagctccgctcggcttagccgtcgccgccgcgaagcgaaggccgggggccctcgccgcgctctcctcggcattccgcgcacgccacctgttcgacccaatgcgcagctagaccggctagagattaaggttgcgcgatcccatgtccttcctggcgcccggacgcggccgcctcctccgggtgctccccacaaggcggcaccgtcttccgcctccccaaggtacgccaccttctctcaccaacgcgtcggttccccgtcacggcctcacggggtaagaatgccactaacgatggtgttctgttgttgtttctgttcctggagggtcaggaggctacgcggcgtgcttccggcggtgcaaggcgcacttcttgctcgatggagtcgaggatgcggtggagggag

SEQ ID NO: 55277 - DNA, 1501 bp, Oryza sativa
actggttagcactagttgtttgcaataatttttatagctaactatgacacactgtttttttttggtcctactaaaatgttgatagcttttcttcaacaatgactcatctatagatttggtatgtgttggctacagtccaaacgttttacaatgtactgttcaggtgccccaaaaatttaggtaggacaaatttttgttttgaccgaagacagcctaatgagtccaagcagccactcaacatgcatacgagttcgcttagtatatatctaatccattatacctgttagtcactattgtcactcgttgaaggttgaataatatatcagcaaatcgcactatgatccaattgtagcatgacatgggtcttcatcgtttgctcgttggcttatcacccataaccaaaaaatgaatttagaaatttaattttgaagttgatttggataattttttttcacctattattttttagcattgacttttaaagcatgaataataaataggagtatataagacgttgtattaaattctttttgacttggcttggttttactacttctcattagccttatctccacgggtcagaacattgatagatcaaggaaaaccttgtctggatggacctcaaccttgatccatccatgtatctgggactacaagacaacagaaatcccagcccatacatgtagataggccggattggcgccatctaaatagagaaaactaccgcccggagattgcatctccgatgcaatgtaaggatgcatgcatttattttccaaactatttatccaattgtcattctaattatatcgttatattcattataattatttttttacaacagtatctcacacgattatattttaattgaaaaattacatatgtttcaaacattaagttttgatgtttcacgtgtgagaggtaaatgttttagctagaattcgaatatgtggcacattttaagttttttatactatgcatattgttttagtgctgcacacgaaatcaataaatatattgtgatgtttcattactttatttgtgaatgttgcgcatagtgttatttagatgtttcagcaagtataatatgtgcaatatttaccaagaactagtgaaacattagaaaaatatttattgaaacatgtgtaacactaagaagagttagaaaaaagtcatcagaatatactcatatagtcacgtgagatcttgttacgaagatttaattgtaatgaatctaacaacataatttgttcatagtttggataaaattataggagagaaaatgaccatttgaattttcaatcaatatgaacaattttactaaatctgactttatatacctaccatacacccacccctactattttctaggctaggaagcgtgcgatcttttcctttcacccggacaactcatgagaagcaattttccatctaaatcgggccgaaatggtacacagtctggccatgcaccgcttaatggaaaagtttgaaacgaattgaa

SEQ ID NO: 55278 - DNA, 304 bp, Oryza sativa
attcctgcagcccgattgcacccagattgcaaagtcgatctgcttactcaaccacgggcggaagaaatccttgcctggcgacacgatgcctccgcacggcggcggcgctgctttgcgtagacaccaggatcaacaaggaaatcatcaagaagagaaaaaagagagaagaacaggagcaaagagatccccagatccatgtcgcatccatcagaatagaattgcaaaatccatgcatccatcatagaagagcatctgcatgtgaagcatgacgcagcactccggaggggtcttcgtgtggctgcga

SEQ ID NO: 55279 - DNA, 1501 bp, Oryza sativa
tattgatttggccctaaatgacatatatgtacacaagagaggggaacacaagagaggggaaagtactctaatacccttgacatactactacacttaacacccccactcaaatgcaatgtgtatgcaataacattgcatttgaagggtaaactaaacactaggacacaaactaaatattagcctatctccaaagtcttgatgatgtcgtcaaagtgtgccaattcttggatgatgacgatgaagaagaaaaagatccatctcctcttcaatgaagtggacctcggagccttcacaaactgttcttcggccctcggtaccttgaagccttcacgactcgttcttcggctcttcattgattcagagacgttgacgatgatggaaggcccttcacaaactgttcttcggaccttcatagatctgataaaggaccttcacaaattgttcttcagtccttcattgagtgatgatgatgtcaactccgatggggagatggtgatatgacagaccagctccgatgtggagctggtgaagtgatagaccaattccgacggagagctgatatgaagctggagatcaattggacggattgaagaatatgcaatggacttggatggattgaatggcaactagtaaatgacacaatgatactaatagatatgcagcaaggctttaatggataaactagataggatcataggaaacaaaggaaatcaatttgtagaggacattgatatgctagcaaaagacataattgtggctgccaaggaattgcatattaactgattaattctatccaatttggtagcagagagaagtagctgatgaagatggacaggagatggtaatgagagaccacgaatactttcagtaaagcaccaaattggaaaggcaaaagcatgaccacaagctgggagcaactctttgaagcattttgtcgagcaccttgtgtgcagcatatggacttgtgcagtttacaggcaatagccaagactgaaggatctgccggcagcggcagctgcttgctctgctacaaacgggtgacagggcctgattggcggagaggaccggcgccacgcaaggggttacgacaggcagcgaggtgtggagctggtgaggagatgcacgccgcgacgagcggcagtgacagatgccgttgacgagcgctgcgacgggcagcgaggacgacggctggtgaggacggcttcgcgattgacgacgagccgcagcggggacgacatggctgacagcttggacggggttgccgccggcggcgtgcactgatgcgtgtggatgaggaaggacgatgctcctgactgctgcttgacaggcttgaggacgggacgacgaacaacgatgctaccaacaacttgacgaagacgacggtagtacgagacaatggctcgccggcggcgaccgccgccggcgtgccgccgatgggaacttggtgggtaggattagcagtaaggctctgataccatctcaaggtaagagagagattagg

SEQ ID NO: 55280 - DNA, 1501 bp, Oryza sativa
acgttcaggccatggtgttgttcaggctgcctcacaggaggtactactttgggccggctcttccctacaggctggtgctgaagccgccattgccggcctcttgcgggttgatcaactagacagcaatcatcattcaccaatgtcaaggtagaagaacctttcatgtaatttaaccttgctgaaattctgtaggtatttttgtgttaacgctgttacttacattgcttagtttttctgtatttcgtactgtggtagtaagattatacaaattctgatttattttcccacaaagttttacacaaagttaaaagtttctgttaaatagatacacaacgttgaaatattgcatttcaatctccctcaaaacgaggctcataaaaaatgcaaaatctaagactattaataaaataaaaagaaaaattcgagcgatgaaattaccactccctaatatccaagtttatagaacatttagaaaggattatctagttccgtagttgtatttgttggagtagtgtatttctattttatggttagtgtcgggaaactcttattggcacacgtaacgcatgggaatctgccgaacagttcgggccaaatcttgaagaaagcgggatacttaatgtgttagctacagcactgcacgggttgagtcgcacaacacctagtatccatcgtttacagctaggactactgagttctctaatcccatttgctcgcaaatttaccaattatgagttgggcgctttaaccattcaaccttggatgcttaacagggatcgttgtacatcgtaaatgctttcgcttctttggttggtactcttctatctgggactgggaaagatctgttgcatttcaatttcttttctttctgtattttctgcatagttaattttttagtcatgcacccacgaacaaaaaatgcctaatgcagataccatatatatgcaggaaaagttaattcacaacacttgattttacattgacgccatgatcagttctcttttatctgttcaacgggctcctatttgcttgtttagtaacagagtatccttttgtaataattaagtgtttaacgttttatgaacactagttaagcctattcaacttttcttttttagtttttgataactggttttagcataatttcaagagctgttggtatcataattttggtgaactactcttggctgtctggtactttgaactatccgccttgaaaacatttttcagttcccttttaactctcagacttcatcttcagtagggatggttgaatattagattatttgttcactagccaagtggctgagaccaaatatttactttcagaaattgtctaaaattatgctggggattatgataatgttaataatatatatcacaggttttgttggaaatacaaggttgtcatgattgataatcagggtttattatattcaagaatcttttgtgcgtcccttctgtttggacaaagtttctctcaaggtaagagagaattagg

SEQ ID NO: 55281 - DNA, 1501 bp, Oryza sativa
tattttttcacgactataacaaaaacgggtttagtgggtggatccggtaagcatgttgttgatcgtggctggttgttgatcaacggtggatgggagcaggagtacgtacacccaggtgcatagaatcatttatatatatatatatatatatatatatatatatatatatatatatatatatatatatatatatatgtaaattaattggtgctacatagagtatgggctccaagattcaaattgagtatatacctaatttgaatgagtatgaaatttttttaaatgtttagatatgaacattaacttctttactaacaagttcaaacaagtttgaactgagtttgaactttttttttgttagattttggttctaggtatataacatccaaacatataattcgttaggtatgcaataatgaattgtgaaataaagttgagtttgagttgttttgttgttaggtatttgtatgaatcaaattcttatacctaggtatatactcacaatttgaaaatttttaaaaatttgagagaatttgtgtgttttataccttggagcccgggcaccatggagtcccatatatatatatatatatatatatatatataagttatttttagatttgattaaaatacttcctatacattcataatgctctgagatgattacttttattatttttttagttaatttcataatttgtgctgattaatttaatttctagatagagtcatgtttttatctttacaacggatttacttcaaatgacatgctaaagttaccttcgttttgttctaagttacttctataatatatgtaaattacttttaggttttactgaatttacttttatatatctaagaagtaacttagtgaaatctaaaagtaatttagacatatcataaaagtaatttgtgatttttcatcaaaatataatcatgtgatatcttgttgtaaatatttaattgttactaacacaacagtgtaatcggatcgtatatcggatgagtagtttaagagaaaattgtatttgaactataggtggatgatgcgtcttatagatggagtggtagctggtttgtactagctgtgtagttacatcctacatgcaggtatgctctctaatcatgtacaaatcatccacaaaatcatgcgcaacaaatcatccataattcacaagcccatcacaaaatcatccaagttattcacaaaattatccccaaatctaaaaaaaaatcgacaacaaaatttaacaaatcagttaaaatagaaccgaagggactatgtgctaataactgcttcgtttttaacgtcggaggaaaaggttcacaatcaaacaggatttagggattaatgatcagatggatggcgatgcgtcggcgctccgatgatctgacggttggtatttattgagaacatatggcatagccgtcagacgagacatcgtcggaatcggaggtcttctccgacttccgagttgccaacgggaggcgcgcgttccgc

SEQ ID NO: 55282 - DNA, 1501 bp, Oryza sativa
catatcggccgatacagactccagccgatgcgctgtgccgttttggaaaccgctttatcctcttcaaatccgcttcggatttatatgccctacaatttttgtgcttcctatatatgaaagaaaactgattcgcccatgtgagcaggtgtgtgcagcttgggacgacataacggaaatgacacagggcatccacggcgccaccccgaaataacaacggatttaatttttagattgtaatggcatgtacaaagctagagtctaatatgggctctctatattaattaatgtcaatagagactatcctcctataatagtagagaaaataagatttttaaaccattaatacactaaatatttttttattatacttctttccttttctataccctcatgcaacaaactttccgttaataaatgagagttgaatctgagccgttgtcatgcgtagcaacgatgtttctcattccttccctctctttcttccacgtcactaaatttacttgcataacaacgaaatgtcaccaaatttacttgcataacaacgaagagagcccgttattagacaccattgcatatgccctaatgtagtcagcaggtggttgatgacagtacaagcggtagtaatctgtatgcctattccatcttggaacggggcagtttcttgtactcataggaattgagctgattcttgcaaaggtcacatttttttttcacgagctcgaaccaataatttcctccaaattttgtaggaatttaactgacaaatgatataaattctgcaggtaaatttcttgaaaattccttcattccaaacagtttcagattcccatgttcaaaatggtacttaaacttgtatatataagtgagatttttttttagataaaaataacacacacaaaatgtacaatgctacaagcaagtctagtaaagcaccggaagcgagtctagtagctggtgcgtgcgttgcatctcttcgtctccgttgttctcctgttccattcaacctcgtctgcaacaaacctctgctacaaggaagagagggtcctctaacttatttatttctaactttgagtcactaatatgtgagcccgctgggtaaaagactaagttcaaagagaaataagttaaagaggtctttcttcaaaagaaataagttaagagggactacttgcagctgggacgcatccaatgcaaaaggttctcaaggagagccaaacatccaacttggaagcaagcagtagaaatgataacagtagttaaaaatactaaccgcaaagaatggcaatttctttgtttgtggatcaacagaaataaaatcgtggaaaatcatactacacagtttgcagatttggggtttgcaatgtgtggccaaagcaaacaatcattcagttttaacatccacaacatttcaaaatcaaccatgaaaagctaaacaaaacattacagagatagaggtaggcaacattgaattaaattactttccatactagaaataaaaata

SEQ ID NO: 55283 - DNA, 1501 bp, Oryza sativa
ttgtttgctagagcacaaacaagactaatattttattgaacaaatagaactccctctagtcacaaatatgtccttttattttattttttttgaacttttgaaactttgactatgacaatgttataattttttttatttggattgaggtaaaaaaaacagacatcacaaagagaaaacaactaaacttttgttgaaaatttctatgttctttctcaaacacgaagcatcatttgtggcttataaaatccacttacaagatttatttgagagttctgtttgcagcactgttgcactttcctccccttccgctctcaaaccttatctgcaccaggtaaaaccgtagccaaaaccatctccattttcaccaggcgtccagtggatctctcaaaatccaccatgggtgaagcagccatggacaagatcccacataatggggtactcagtactcccaagtgcttgagtgtcgactggtagcttaagactgatccagctggtagcatgtggtcaatctgaccaggagcctcatggtcagacctgaggaggctgactctaaatctaactactcgctccatttgaggttataagatgttttaactactatttaagtttgactaagtttatatacaaatataataatatttatattatcaaattagtttcattaaatcaataattaaatatattttcataataaatttattttaggtcaaaaatattattattttttcttcaatttagtcaaacttgaagcagtttaactttgaccaaagtcaaaacatcttataacctgaaacagaggtagtatttatcaacctgcattgagtagcaaaagagaagaactaagtatagctgattagtttgtaattaactaactcctaacgaactaattatgtcatcatgccaccttttttatagcaggacaagccctccaattcattaacgaagtaatgcattcaaaaggtcctgagtaaaacaaaaactaaacagacaaattgttctgctagaaccatgcatcaacatcagttcagtacgctagctacatatacttcgataagagcatggaacaaatgcaattaacacacacttctatattgatccaactaaaatttgtgtgcttccaagaccttcaagaccgcctgtaaccattcctgcacacatgattaaccaccaccatccacgctgtcaagtgtcaaaagcttcttgttctcctttcttcaaaatagaccataaacctaaccagtaaggcaataacagacatttaatatcaccttgcagatggactgataacttaattatttcagaaacacaaacagatctataccgtccccgcaaaaaaaaaaaaaaaaaagatctataccgaatcttcaacagtgcagaaaattgctgaagaaccagttcaaactagatcattccaacaaggctgtgtttagttcagcgcaaagtttggattttgattgaaattggagatgatgtgactgaaaagttgtgtgtgtataacagg

SEQ ID NO: 55284 - DNA, 1501 bp, Oryza sativa
ctctgtcaagttgagttaagcccaaatcatgcaatcccaaagcataagaagtagaattaggccttctagggtttcggcttgaagaaattagaagaaggggaagcaaaagttcatggaaatctcagacaaatccccaagaaccgaaaccctagctacagtaaagacctcaaaatttccccaaatcatgaaaccctaaccctaaaatcatggagaaaaggagtgcggcgggcttacctaagggcatggtggccggcggcgacctccgtgtcgccaccgacgcaataagaggcgagcgcgcgcccgaggacttggtccccgagcggcctcgcgacccgccgtgccggcccggctcctcctcctcgccgacgccgcctcgctgaggtagccgtcgccgccccgtctcgccgtcgccgccgcggatcttcctcgcgcgtgcgactggcgggtgcattagggcaccgtcgagcaacgctcgacagggatgcgcgccagctatggcggcacgcagccccgacgagcaaggctcggcggcgccatcactactcccgccgtgcgccgtttcgccgtcgtcgtcgtctcgctcacagtcgccgcgggtgtgagagaaagaggggaggagaaaatgggggctagggtttcgcggggggcagtcgcgcgccggttttgtcccgcgcgggagcgatctcggccgtccgatcagatggacggctcagatcggctcgctcccgacgcgggatgacgaggccacgcgggaggcggcaaacgccagcccaggcccaggtttttgggcctggagcccaggcgggaggcggctcggccgtaacaggccaggctgaatgcggcctgcctcagggaagaaggcccagataaaaaaaaattgttatgggctgcatagtaacgggctgcatagtaatgggcctaattaaaaagattgggctgagataatattacaattaaattttccttttttgatgaattatgattatgattatgatatttgtgtttaaacattgaagatatttattatgttttagttaatgataataagaataataagtgattttgttatgtgataaaattctctttcatttatttatttattttatgatcatattatatttattagttaaaattattattgttattgttgttttatgcattatgaagtttatttccgctacaaataaatattacaattaagtgtgacaaataattgtcattctggccaaagctgattgacttttatttgatcacaaaattttattaattcaattcaaatctggccaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaagatacttatttagctgttgattctctcttatgcagcatcttatgcctcac

SEQ ID NO: 55285 - DNA, 1501 bp, Oryza sativa
atatactgcctggattgcaaattctattgtgaacataatatgattcaatttattctaaatcgggtattgtaaaacaactattttgttctttaaaatctcctcccagtcttagttctgatctgtatgcggaatataagtactactaaaacacatcatgctactgtgcaataagtatgtagtatcacagcatacaatttctgaaataattaaatcagtacatgcttctaaaatcacaccatacaatttctgaaagacatcagtacatgcttctaaaatcacagcatataatttgtgaaagatgccggatccaagcagagatctacgtatatacaggattcttaaagaaagcagtatatactactccaacctgggatgaagtatataccatatcctaaaaaaacagttcataccactgctacctaaaaataagtatatactactactaacaaaaaataagtatatactactactaaaaaaaagtatatactgctacaacaaaacaaaaggtatgtactgctgatcactgcaaagagtatatatactgcttcctaaaaaacagtatatactgttgccaactaaaaaacagtacatacttccacgtaaaagacagcatatgcatcccgctaagggaaaaacgtactgcgtgttgattggagtgtcgttgatgattctaaaatttgaaaccaccgaaaaactgggcatgcacgctacaaataaaaaaaaacttatttttcagcacaaatcattttgaactacgctaatggattatccaatagagaagatggagtacatactcctgggagtatatatgataatctgttcaatgaaaaaagacattaattaaagttactttatttttgttataagttacttctataatatatgtaaattacttttaggctttactgaatttacttttgtatgtctaagaagtaacttagtgaaatctaaaagtaatttagacatatcataaaagtaatttgtgatttttcatcaaaatataatcatgtgagattttgatgtaaagatttaattgttacgaatataacggtgtaatcggatcgtagattgaatgaatagtttaagagaaaattgtatttgaagtatatgtagatggtgtctcttatagatagagtggtagctagtttagaccactagctgtgtagtcacgtccatttagtaagtttatttttaaaatatttaatttattactataattaaataaataatctattactctgtatttaatactccctccatataccggccgggagcccgggagtgctgagtgctgggtcggggcggacacgagagttgcttcaagatccgtgcatctacacgtggcgtaatctcgttagccccagaaggaaggcgaaagctaagacccctcccttccattcttcccaaaccctagccgccacttctctctccccgcctccgccctctcccaattcctcctccggcggcggcggcggcgttgggacgcgcgagcccatcacca

SEQ ID NO: 55286 - DNA, 428 bp, Oryza sativa
attcctgcagccctatatcctctctctctgtatatatatattccacttcgatatgatccatatgtcagtggcacagtaacccttatattctaatcctaactacacttatctgagaatgccacttatttatgataggaaagagttacagtaattttttcttttgaagcttaatccctcttttaatcaacatcattaaccttttaatgactaattatactatgccacccctctgctgccgttctcgccgtctcccttttcttctccgatcgccgcagcttccgcgaagaatccgccattaaaaaaaaaaacccgagctctcctcgccccggcgaacgcagcaccatctccagcgagcagcagcagcagcgcgctcttcctccctgcactgcccgtgcccggcggcgaggagggagggggggagggaggga

SEQ ID NO: 55287 - DNA, 1080 bp, Oryza sativa
cgcgacatacgtatttttgtagttataatataaccacgtctcacttatctttatgttacatggaagttacagtataagtacattacaattagactataatcatatttaaaagtttctacacttaaaaggaacttgtaatgtttggttagatggtccctcaaatgggatgccccataattatcaaaatttttagtgttagactgcttaaaatgtcagaagcacttatcacctcctcgccaccaatttttacaaaagaaacctctacgacagaattcagatcgaagcaacggcaaatcagacaaggaaaaataatcctatttgtgaaactaaaatggtttagacccggtataagtgaagtggtttcttcggggttttgaaatgaggtttctacgtcactgtcatgcgtttcttctaccactgaatcccacccatcttaaccgctacacctttcgtcccataaaaacccaacccttctagacatatatgtgtattcagatttataactatgattagattttttttagacggatagagtattgtaataaatttcccttccatcaacattggccttccaccttttcccacagcaaggcatcaccacagccacctcaccgcccccgccgagcatagcttttttttttcgttttgtcccaaaaatccatcgatgcccaggattttcgttttcaaatctccctaaaaaatcgtgtgatattattccttaaagtgttcccgaattgtctctagtaaaattagaattagtagctccctccatatcgccaatttctggtcctgtccagagttcaagtttactcacatagtcatgtttgttttcccggttttctttttcgagaatatgcataaggctttcgtatcttcatattaagaagggggtaaagagtgcatcatgacaattacaaaggtatcaaatgaaaaaaaaacacacaaaaaaaaggacattggggcttttatctcgtgtcattagttatgtgacccgatagtcagtcttgggctagtggagcaacccggcttcctgccagagagctgtctcatcccccttcattgttgccaactcggtctagg

SEQ ID NO: 55288 - DNA, 1065 bp, Oryza sativa
tattgtggtatgaaattattttttctaaataatgtaattgccaagaaccaaatagataaaattctttaggtatcatgtatactttttttaaaaattttctgaaccagcatgtactctgtaaaacttcgcaatatgttagctgaggttcagtatatacagctatgcaaatttaagctcgagcggtcgagcctggtctgtgttttttctagtttatgtttaatccgcatagttgattgtaacctcggtgttatactctagtgcatatgcccaggtaaatttatactaaaagtttcatgaaaaatatcatgcgcacacaaggtttctcgtgtacacatcgtacacaccaactaacaaatttcaccaaaaatatctagaaaaaaaatgcacaagtactttagtattacacctatatgtaaagttttaaactcaaattcattatattttaggcataacaaaatagataaaaatttgacaattttgtgggtataaatctgtcagaatttgtccttttggtgttccctatatatgatgaatttaaaaataaaactttacacataattgtattaaaagtatatgtacatttttttagaatttttatgatattttttaattggtgtgcacaatgtgtgcatatgatacgttctcataagtttcctagggtctgtttataaaataacttttgaaagggctaaaatgtaaaagtccatttgaaaactttagaattataaaactgataacgcaaactttcaatactattgagcccattttattttttaaaaccatttgcattaaattacattttgttgcttaaatgttaagtgcaatttgcaagcggttggcgtgttgaatgtgtgttagtcaggacgaccaaacaatacctttccttcttcttttttgtccatctacagatctatacctcgtgctatccaaaaatacaagcctagcttctctaaaatttcttttttttcgacgggcttgtttctcttaaatcaaaatcgatcccgatcggttgcacctaccaagaaaatctgatggagatgagaggggtattcttggcggcaggga

SEQ ID NO: 55289 - DNA, 934 bp, Oryza sativa
gacctaaatcattctgtagttagtatgagctgtgtccttcataagaagcaaacttagtaaaaaagaagtactgtacagaacagttgacagattagaaatgggacctcactgaacagactagtatcagtgcactgaatgtggtaataggcagtttctgcttaattggacatgcagatgcagatgattcaaccgaatgatacactcatctgcattcagcaagacaataatcaattataagtttgtttagttctttgggtgtaaagtttttgaagtatatggacgaacatttgaagtattaaacatagactaataacaaaacaaattacagattccgcctgtaaactgcttgacgaattcattaagcctaattaatccgtcattagcaaatgtttactgtagcatcacattgtcaaatcatggcgtaattaggctcaaaagatccgtctcgcaatttacatgcaaactgtgcaattggtttttttcctcacatttaatgctccataaatgtgtccaaacatttgatgtgatgtttttggctaatttttttttatctaaacaaacaaggcttgtttaccgggacaagatttttgcccatgtatcctttcgtttcatggattaagacacaattattgcctcttgagaaagtgggtcactgcttagcagtgttgctgccagttgaggtgtactacttcagttaagaagtaacttagttccccaaatttttttcttaaaaacattatatcgaatctttggatatatgcataaagcattaaatatagataaatgaaaaaactaattgcacagttaggaaggaaatcacgagacgaatcttttgagtctaattagtccatgattagccataagtgctacagtaacccacatgtgctaatgacgggttaattaggctcaaaagattcgtctcgctgtttccagg

SEQ ID NO: 55290 - DNA, 162 bp, Oryza sativa
ttcctgcttgggctggccatcctatcggtaacatttggaccctttgtcaccattgcacatagaggtacaagctgattcatttccttttcttttcaagtttatttcctcctccgtgtaaatagcatgtgtgagaactgacgttacatattacctgttttcaga

SEQ ID NO: 55291 - DNA, 1439 bp, Oryza sativa
aatggttctaagaattgggccaatttggttaaaaagccccagggggccttcgcttccaaataagtgatattactggttcatacatgtattgccttctaaagctgagaacttggtggcaataacactcctctcttgatctcataggacaaaggtatatgcttacatttaccatggtacattgtttattcgtgttgcatatgtatacaactgacatgtttgaggattcagtcattaatgtgatctctacgttaaccatggtctgttgttcctgttatctgagcttacaacatcttgataggtctgcattattctcgttccccagtacttaccatgtgacactacactctaatcaatgttttttttaatgtaaatgtgatggcaccagcaatgcacgatttccattttatatcatctagttgtgcaataccaggtatgcgtaaatggaaattatctcagcttcacaatatttcactttaaagaaacaaaatcccatgagcataaacagtaggtgataaaataataaagcccatgtcattatgtttttgtatctactacttttccctgaatttatataggatcgatcatagctaatgaaatccatctgctttagatgggctgttataatgcaattatgcaaagtggtgctacatcaactcattggttatatgttaatttcactactcatatacgtgggagggaaaaattgaattcctaactggaaatagacagttttgattatgtatgtcaacatgtaggtggagagctggtcttatccaccaagagaatttcatacaaggacagaacagcgttctcatgttcacatgaggcaatagcaggcaactcatggactttggcaaggtttggttttctacggtaaaccattgttttcagcttgcatattctctatttggttgtcacgtaaaccagcgatggccttctgtttaaactcatgtcacatttgatctcttgatggggctgactgttccacttcctctctgatgcctatgattcaaaatttgaactgctttaaataatctgtgaggcatcaagttaagtggcccaattgttttattccttatgatacattacaaagcaaaacatcatacagttatagtgagacaccaccagacattagtttgggccataatacatgactcaggcttgagtgccttgccctttcttagttatgaactggtggcctcctatgggggttggcatggtaatccttgttaagcaatctgagaacttcatctctggactccagcattttctccttccagtcttcattagttctatatgagttgcagcaaatactcgaacctttttgttcttttttggagcccaaactcagatgcctgtaataaggcttgaatggcagtattatgatatgttggggatttggtatgttcagtgtctgctcagatgtgcttccttctagt

SEQ ID NO: 55292 - DNA, 241 bp, Oryza sativa
gctgttcagtgtgctcaggaaatgcttaaagattgtcactcatattgcgaacaagaagcttatgaaagaggagcagaaagctcttgttccaggcacacatgatgatgatgtaaatctgagtggaaacatattgtaacaaggcgctttactggcgaatgcactcatcaagagagggcaagcatgtctctgggagatcctagctgaggtgtggggtcacttgattgtgcacattgctcccagt

SEQ ID NO: 55293 - DNA, 1501 bp, Oryza sativa
cccaagacacaccggatgacgacacaggaacacacgatatttgttaacgaagttcagccaaagcctacatctccgaggctttgattatgggcgctcctccccaatcaatatatctcctagccactacaaatcaatggccacgcggccatcatctccctgcgtgtctacgctacattgtagtcgccatggtcaccacctcctctccatttaagagagatgtcgagttacagagtccaactctaactccaccccctaccacctattacaaccccaagtctaactataaccaaaatagaactagtatattcaacacctattctaacatctgtgttggatagtatatggtaatatctgcagatagtagtatcgaggttaaactcaacttcatttgtgagatataaaattgagaaacataaaaaaaaaagaaaacaacaacaggaatagtgttattaattaatttcatacttcattaatgaagttgagtttagtcgtgaaatagtttcgtatggttatttatttacatattacctacatgtatgattttttttgagattttttagaacttataaaaaagttttacccaagatgtgatttttaccaaatactttttccagcttatcattgtctataaaactattaagcctgtaatgatatgtagtagccaactagaatgcattacaacagcagggcagtgaaatgaatgcagagaaaactccaagagaagtttggtgggctattctgttattactagtattattttgcagtttttttagacatttcattactcatgatccgagatatcatctggaatatcaaccagtactagttcagactgagccaggcaaacagtcccaagctgagctaacacatgagctactctgttacattctaggcataagtctaacttgaatattgacaaaatttgttaccaacagttgttcaagggccaagccaccgcgaatgaagagatcgtagtctgtagatattactacttgtttaaccattgccgcatcagtttccagggaaactctcccaattcccaggtgtgccgctgctagagaattttgtagggtactagaggtaccaatgggattgacaggaacatatatttctcgaacagtaaaattttgtaatctttgttggtgtttttgcaacatttataacatgttcactgtttttcaaatggtacggaaaccctcttccatctccaaacataaacaggaagctttctatatgaaattaagtctaatcggatagtgaaatatgctcaattgttacatgacttctgagtatgctactcaaaagtaaacctttgtatggaatatctgcaattcttgtgtccctcctcactaagttatcaaataaaatcatgtttcaaattgtcctactggcaactggcaagcctgtaagtgtcaatttaatttacacaactgtaactaaaattcgaggtactaaaacatcctcattcactacagtctacaataaacctctgaaaaacgaa

SEQ ID NO: 55294 - DNA, 742 bp, Oryza sativa
gtagtggtggtgcgtgtcagcgtgtgcagtcaaggcccagatgtacgggccgtgtgggcccgataccgtctgtttctatctgggcctgtaggccagaaggcggaggcgggccgatccagtggtactgatgggctgtccatttcattagctttactgggccgcaatgtgtaagagagggttagaggcacgaggcggcgcagttccagcgaacggcggcggcggcggcggcggaagttgatggctccggcaccgtcttcctcgtcagccgccatcgacgagccgctccggcagccggtgcctccctaccggaggctgacgcttactgggccgagtggcaccgcggctgcttctctctctctctctctccctccgttcggtctcccatttgcttccgctgttgccgccgctcgccggcggggagggaggtgcggaggaggtgaatggcggcggtttcagcggtaggggtggggggatcaacatcggaggtggtacagcggccgcggccggcggcgagggtggctggcgctcaattgggggatgctttcttggtcggccatggcatcggcatcgtccgatggggctctacagtgttgtctatggagctctctgtttctctcacggtaaatttttttgcagctccgtccgatctcctctttttttttaatcgcggtgcatttctcgtcaaatcatgtgataggaaagtaggagtaaatgctatgggattatcgaatggttgtataaa

SEQ ID NO: 55295 - DNA, 729 bp, Oryza sativa
gagtcacccgaccccccctcggggaaatcaggaggagggcggtcacctcaccctcgggcccgacgtccccgaaggtgccaggccacgtgggcggttgtgtctgcctcaagcctctagtcacgatactcccggtcccatatcaccgacagtagcccccggcgttatgccagggcgatcgcccttctcaagggaagcggtcgggcgtgacgccactcctaaagcttggtgacaggtgggaccggtctccatggttgggcagaaacccaacggtctcaaatcacgcatattggtaatggtaatttggctgtcaataatgggcggtctcttcgagactgccacatcacctgagcggcgcacgaatctgggcgagccgatttgcctcgcctggagatacggtaatgtcgcttcggttggcgagcgtaattaacgcgcgcacgatatgatctatctcgactgccgcaactgcatatccatctcacgcgccgcaagcgggcgaatgggattagtggaagcgtgggcgcgaaaaacgagggggcgaaataatgggcgcgagaaacgaggagccgggcacagcgttggcaagggtataaaggcacggaggatgggatttgtctccttcctttcgccatcatttcccttgccttcgccgcttgcgtcctaactccttcttccctgcgcccttctttcgccacacgcgctcgctcttcatcttctcttcgtccggcgcca

SEQ ID NO: 55296 - DNA, 486 bp, Oryza sativa
catatatcagaaataacaggttttacattttaattgtgcttgtgactctgactgccttacatattgccctctactattacatcacaatgtattataatttttgtacctcatgctgaatgccccaatttcagctaccactggcgatccagggagagacatagaaaacaatagacagtataggtaaaaaccacaatctttaccaattgtctgagacaaattactatagtacacgccattttaattcgtgcataatgcatattgttgtttttgttttgatgaaagctaaatctccatagaaaatctgaagaaacaaaatgttgttaggtgagcatgagcttaccaaatactactagtataaagcactaacaacacgtcttcatacttgaactcaaaactaacaactaacacactgcgaaatcaagaccatcagtgatgtaactaaacagaggatgatacattatgaccgacgatgaagtttacccaagt

SEQ ID NO: 55297 - DNA, 1501 bp, Oryza sativa
cgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctggtcagagtaaaactattcgaatagccgtgctcgcggttatgggcggtcaaccagattcaccgtgattagtctcaccttagtataatcctttaatttgtatagcataggtggatggttgggcctgttgcaacgtggtgtagcgttgaacagtggatgattaatactgctaaattattacaactgttttcgcattcaaattcttgtttataaatgccagtatttatgcaaatgaacctgtttagctatcccttgttgaatccatgcatcataccctccattccagtatgacttgctgagtacagtgggtagtactcagccttgctctacttttcccaacctccagagttcgagttcgggtcagatgaaggtttctctgaggagtaggcttcgtccgtgccgtcgaggatgcctgtggggtggtgttcccgctgcagcttagtcaaggcttagcttcagtttctttgttttccgctgcatttatgtaagactttatgatgtttgtaagacgtggatctgtatgtcaacattgtcgtttgtgtacccggctggtcctggacggggattttaatgcacattctgcttgggattccattcgggaatttctgggcgtgacaagttggtatcagagccgactttgaccgtaggacaagccaaatggaaaaacctaagagccctctgaatccttttcattgcatatgctctttgcaattggatttgttccgggaaaattgggatctgttcttgtggttcaagggaaaaatcttggtcgctcgtttaagtgagatttttcaaaacgagtcagtctagggttttagtaaaattattgggatttattcgtcagtcagttgaggtttgaggggtgaaatgcattaggtcctagctcaggaacttgggttgccaggtatttatgctttgttcgttattattattatgtatctaatttctcattatttcatcgtcatgtgagtctgtcttatttattcgctctcatgtaaaatgatctatgcataaaattttgctcttatttgatttcccttatttgagtcttttattgctttatttaaatttggatttgagcatgcattgatcctactcctttgtcttctctagatggccggtcacccacccaaccaccgcggagaaggcatgatcgatttcgtggcagagttggcacgca

SEQ ID NO: 55298 - DNA, 1469 bp, Oryza sativa
ccgcatctcgcgccgccgttgacctcgcccctccccgcggcagccgccgccgacctcgccttccgccgccgcaaccgccgccgacctcggccctccccgccgccgctgcaacctcgccttccgccgcctccgcccgcatctcgcgccgccgccgacctcgctcatccccgccttccgccgctgcagccgccgccgccgacctcgccttccgtcgccgcgctctcgcctcttgacctgtggctgtcgctgatgcgcggtgaagcgacccgacctcgggcgctcgccctgctcgcccggccgctcgggcggttgcatccggcatctgcgaggtatattcctctttgggccgcccaatcccacttccgcccaccaaccaaacaggcaaaaaaaaaatgggccgccatctcccgttcacccaaaacctcccaaccaaacacaccccttactactccctccgtccaaaaaaaaattcattcctagcatcctgaggtggaattagtagagagtaagaatgactaaaaaaacccttaattattgaaaaaaatagtaagagtgatagataggtaaagggtattaaagggataaaacttctcgttttgcgtgttgagagtaggtagaatggtagaagtctgttttcagtttccacggcatgcggtcaggtccagcgtttcccaaaccgcagaggacggggttaccgcgccccggcgataagcacggttactgcgcggtaatcgtgaaaaccgtatgaaaccgtgtaaaatttatcaaaaatttgaattattttttaaatttatatgaatttaaggaggttaccgcggtttttctattactgtacctcgcggtaaggccggtaaccacagtaaccgtgcggttgtacctcgcggtaagatcggtaaccgcggtaaccgtgcggtgcggttatgaacggtaagttgaaccctggtcaggtcccatttattcctggtcataaaatggtgcaggcgtattgattggtggggcatcgtgtggattggctgcctgatcagtgactgacactgatggacatcactgtaccattttgccctccaacattagtaaggcccgttccctaaaatgttttccaaaaaatcagatcaaatcgttggatacgtgcatggagcattaaatatagataaaaataaaaactaattgcacagttaggaggaaaatcgcgagacgaatcttttgagactaattagttcatgattagccaaaaagtgctatagtaacccacatgtgttaatgatagattaattaggctcaaaagattcatctcgcggtttcctgatgagttataaaattagttatttttattcgtgcccgaaaactctttccgatatccggttaaacgtccgatgtgacatccaaaaattttcttttagccaactaaacaaggcctattcgttgttaacttgttattccctatgggcctcatttaccttctataaaaa

SEQ ID NO: 55299 - DNA, 1501 bp, Oryza sativa
  unsure (1)..(1501): unsure at all n locations
gcattgttcagagatcaagtgcagataacccaatcactacctttctgaatgaaatctaatccaaatagtgaaagctaaatctgttatgtctgaacagttctgaaaagctggaccagtcgaagagcttcattgatagccatagatacagctctgatctgagagcatttagccagcttaagcttgatcatttgcttctccgggaccaaattgattgacaggctgaattagtcccggtcccaagcatggcagatgcatttgtccgtggcatctgaatctcctggagccgacatggaggttgcctttgtagcagagatcatctcagtcaccagctagatgatttgtcgtggattattattggcttcacgtttcaaaataatatgatttctcaaaaagttttttttttctgttgtattgtttatttctttagatcactgggtcactggataagatatttaattttgtttggtaagataagatatttagctgtttaccactcctgcatgtggcaattaactatttgtcacttggatctacatatcttatacgtataaaggtccacgcgtcattgagatataagtgataaataattaaactccagtggcaaacagttaaatgcccaagataagatgctactactatgcaattggtttttcaagacaacatggagctaggattaattcggcatgatgcttactagttctatgcaattggtttttcaagacaacatggagctaggattaattcaggagcacccgcgatagtttggtagcttgttgatgagtaggaaacggagtcccaagtcatttgggctgaaaacctgagcaataaaaatgttgatcatgcattacccatccccttttacatgttcatctatttatggtgctttaccaaacatgctgccaggctaagctctttttatttatgttttctttgcccttgtttcaaagtactaagcaacaggtcaaatgaagcaactaaataggtgtaattttcataaagttccactatttccttaaatctccttcatcaggaaggagccagtattattattggacgtccacagtttnttgggnggttnttggggggnaaaggtggttaacccaacccggggaaaaaattttaagcataaaacccttgccagtgatctcattatttcaaaacctagcttgttgtttatggggaaaaactatggaaaaacagtgcctggttatacttatattctgcagagggtaactcagttaatttctatttggtcactcctgtccacttcaattaggtaatttagtggaaattccttgtatacctctgaaatcgacatctttgcagagtttagaatgcatcgcaaactgttcctgtaatttgaattcatgctactgtattccatttatacattcagtaagatctgatgtaagttgcggctcttctcatttgccccttttggctactgttccttgttttctggtaactaatcttggttaaatattatctacatttccatagg

SEQ ID NO: 55300 - DNA, 877 bp, Oryza sativa
gagggatgaggttggcggcggcggcgaggaggggcgaggtctgcaacgtcggagaggcagagccacggcggcggatgcgaggcattttttttctttttcttttttctcattttctttttttttctctatatgtgtatttgtagtatatatatatatatatatatatatatatatatatatatatatatatatatataatttgtgatttgtttgggaatttgtgatttgtagtatatatgaatttgatgggggtatactcacctctcaaagtgagaggtgactacacctgctcatccaccctactccctccaaccaaataaaaaattgaatcgccaaatccacctttatccctacaaccaaacaaaaaattgtatcaccatattcacccaaccaaaaaactggatcgccatatctaacaaaatatggaccgccatatcccatccagccttgatcgtaaaccaaacacacccaagatttcacaccaggttctcgttcgtgccgttgccgctacagcactgctagcttgcaataacgctgaagatcagttctagattctgtggtaacttgtgcatattgatttttatttttgtctagaccatcacgatctttgcatcactatccccagggtcattttcccagtcaagccaccgtaattccacacagtctccatgccttggatgttttgcaaagcataacaaaagatcttattagagatgactattggaggcgtttggttggagagaggaaatgcaaagggtaacggaattagaaagtggtgtgaatggaatcagatcgaacaaaatcctcctgtcccttttttttattgtgcgtggtgtttaagtcaagcacatccgtcgaattaactgagcagaaaaca

SEQ ID NO: 55301 - DNA, 1501 bp, Oryza sativa
cattatgtacttcctcttcatgcatagccaggggggaggttgtagatacacatcgtaacgggccaagtgctatggccgctgctcatctctccaaaaggattcatgccatccgtactcaaaccaaatcgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaagaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttaatgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctagcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatttgttttacttcttttaattttcattttagtttgttttctattatttaagattaactttcactagagttttccttctcaactattttataaaaccttgtttagcaaattaactaaatttctatatattctttcttccccacacacattttctctctcatcaacttacaactaaattttggagacaaaaaaagtgtgcaaaacataggtgcaaatgt

SEQ ID NO: 55302 - DNA, 1501 bp, Oryza sativa
accattgattattggctagctatctagcaaaagtgtcacacaccatgcatgggaagaatggcagttcaaaagccctagccagtgagatatataaaaccaattaagctatttattatttctcaatccaaaagtttagaacattatgatgggggaaaaactttggaggtagaagtatttacagaagctctagctgaagccttaattcctcacaaaacacgtcaggcaaacgatcatgcaacatccatatgcatttttatttgcgataaattggagttaatcaatcaattcgcacatgagatcttcaccctctcttcctaaatcctgaagacttgactagagttggactttgtgttggttgtaagggtcgagtttaagacgatctcggctgtgtgccattgttggcttagtggcggtctgtcacgcttagtggcggccggtccgatgctagccttctcctggttttatgtgttggtgttgccggtgtgtgggtggtggtatatattttttatttttcctgattacgatattacagggttgtaatcttataattttttagtgctctatcaatagaacctcataccgtctagaccagagtcgttgaaaaaaaatcttcacacgtataaatgtctgattcagatgtaattaagcatgcatgttgtgattgattttgattcataatgcaaaacgatcaatatgtgtagagatgttagttagttagtttaccttgggtgctgggtgttcttgacgaccttctggccgtacttgcgccacttgtagccgtcgtcgagcacgtccacgtcgctcatcgtcttgaagcagaatctcggctcccgcaccttccgccgcgccttccctcctcctcctcctcctcccccaaccttcttcatcctcaccgcgccaacccccagatgatgctgcgccgccgccgccgccgccgtgttgttgccggcgtcgttgatccccatggcgcccatcgccgccgccgcctcgcccttattccccatctgcggcctccctcgatgatcgccttcctcgcaagacctagcacggcaataacgtcgtcgacatgggagaaaaggggggagagagagagagagagagagatcgattggttgttacggttacttaattactcgtaattaccatggatgcggcggcgacgatctcggaggaggcgcggcggcgtggaggccgccgccgtggtggtggtggagggtgggaggagagggcgcgtgcgaggaggcggcggcggtggttgggtggtggtggtcgaggacgagggggctgtaacctaggacgccatggtggtggtggtggtgagacggcgtgggcgtgggatgctggaaggagaaggcgacggtggtggtggccgtggccggggcggcggcggcggaggtcgtcgacgaggaggccgccgccgccatggtggtcggcggttggcgggcggcgccgtggtggcctagcgccatcaccgccctccctggtgatgggaacatctctc

SEQ ID NO: 55303 - DNA, 1501 bp, Oryza sativa
tatatggaaaatactagaaagtcttacattgtgaaacggatggagtactacttactaaattttagcatttctaaaaaacttccttccttaaaactctaccaaaatttggtaaaaccaacagtaccaaaataagtcaaaattcggtatggttgatcccttgtatgtttgtccaggcatccgcctcttcttcttcttcctctatcgaaacccgtgtcccaaaagcggaagcgggaaacaatcttaccgcccgcgtcatcgcgcgccttcgttgctccgcaagcatttcccgctcgcaaattcccccccgaaaaatcccatttcctccccccgcctcgtcgcctccactccattcccctctctctcccattctcaaactcgcaccctccgccttccccccgcccgaccctcgccggcgacgatgcagccgcggcggcggcagcagcagcagcagtcgatcctctccttcctccagaagaagccggcggcggcggcgggggaggagggcgcgacgcccgagaggcccccgcggcctcccgccgcgtcggtcgcggggatcatggagaggctcgtgcggccgccgcggcagcagcagcaggggaggtacggcgcgccgatcgctggctgcttctatgtaacgcagccgtcgtactgtgaatggcgggaggcggctagggttttgggggtggtggtttgggggccttcccagtcgggttgcggcaaagcttttggtcgggtttagggtttcaagcgcgttcgtatcactagttaatactagacgggaaggattcaatcgatgtactattgggttggttccaatgtgcgccattcggattattctagttgctatcgcgcgccgacttatattggtggtatttagtacttactgccactgtaggtctgtatccaataagggtgacattgatgtgaatatgccatggatcctactttcgtccccttggcttatctgtggattgactcataatgggaggtttaatggttttgattgctgcggtgtgcgatgtatggtagttttggcctgcaatgcgtggtcctagtcatgtttgatcggtctgtctcatctaagtttgtttcaagtttgtgtctgggttttcagatagtatgttaatgcgatctgtggttttgattgtacttttgcgattaatttgcttcttcaggcaaggaaggaggacccatccacagagcttcattttttgaaaccaaaatcaagttcgagtttggattggtctagcacaaaacggcatcaactacaaaattgataatttgcacatattttatctttattaatcttcattgtgattagcctcaatggatatcagatttctggttcagaattatattttagtgaagtagtccatccttaatcttagttgcagccttgcaggtttggattgttgtactgattacttaaatcggccgtctttgtttctcttggtttatttcatttcagggtgttcttttccatgtaccaaagttatttgtt

SEQ ID NO: 55304 - DNA, 1488 bp, Oryza sativa
caccttaaattcgtcgtgattaaatctttacaaagagatctcacatgattatattttattgtaaaaaaaatctttttcaaccgaaacattaagttacaactgctgaaacatcacacaataatagctgaaacattacaaaaatatctactgaaacattcacagagcactgtgtgcaacatttcaaatgatctaatgaaacatcaattaaattatcacaaaatatctgctgaaacattcaaatagcactatgtgcaacattccaaatgacatagtgaaacataattattgcaacatttaaaagagcattatgacaaaaaaacattaaaatattttttatccaaatataatcatatgagatcttattacgaagacttaattacaacgaatacaacggtgtaatcggatcattgattggatgcatagtttaaaagaagaaaaatatttaaagttttgctattaagttagtgcatgaagagtgagattgaggagagaggtaggagggtgtgtcagatctagtgtccccgaggagcggtaagcaactagaaccaatgaattgcttggagaagctagagagatggagacagagaatgtgccagcagccaacacactaaattataggggtggataattagttggctcggctcgtttgagcttgttatcttaacgagccagcttggctcagctagttagcattaacgagctataatgctagcttagctctgcttggctcatgaataggatcgttaagctcgatgacgagctctatctcatttttaccatattaataattttaaatttagcattttgtcatatattaacataataataaaaactaactaataaagaactcaataaatacgaatagtttgtaactaaaagactaagcactaattaagaagcaccgatatcttatactaatgagctaaacaagcggatcgtgagctagttcgttaaactctcgagctagaaggctaactcagctcaactccgagttcgaggtgatccaagtcgaattcgctacataactttattttttttcacccttacatgtatcaatggctgggaaaatattaggtatttttttagcgttgtagtttactccctctgtcctacgtaaaacaaatataagactagatgtaacatattctactacgacgaatctagatagaagtatacggatggagtacataagagcgatagtactctttggtggaacttcgaacaaagatgtcaggacctgcccgaggttccgaaaagcaacaagagccttttcgcaaaagagcggctcgtccgtggcccgaacatacctggggctcaaatccaggggaggaccgggacgggaggcccgcgcgtcaatagcgaaaatcggtgtgtgggactcggaaaacaatggtcggtgattcctcgggtggtgaactggtgatgatactccggccaaggtctctgctgaccttgaccgtttctaattaatggcgtttgaagcggcca

SEQ ID NO: 55305 - DNA, 564 bp, Oryza sativa
ttatgcaaatagccacaaccgtcccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgccgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaactcgactgtaggttgagccaaacggtcaaacactaaggacaagctttctgaaaaccctatttgaaaaatgtctcccctcgcccttcggcttttctttgccaaacggtttttcaaaattctcctccctgcccctccaattcctttagt

SEQ ID NO: 55306 - DNA, 1501 bp, Oryza sativa
tgtcatcggtctggggccaatacccaatattctctgctccgagatgttcccaacaagggcccgtgcaacatgtgcaagtttttgctcacttgccttctggtttggcagactactttcaatttactgcttcccggtgatgctaagtaccattgggctcagtggggcatgtgcgatttatgcattcgtgtgctgcttggttctcgtgttcgtctacttaagagttccagagacgaagggtcttcccttggagctcatagctgagattttcaagttttcaagacaagaatgtctatagcagatatgtgcactatgttcagtattcaaggtgacccaggctgagtgttgaatgattgcttgctagtccgtgtacatagacaaatgtaggtttgaatgttgcaaattttgtcctagttaggagattggccatagtgtttgtactttgtagttgttcattgtctttctgtgctttggagatacataaaaaaggaaaatcatacatggcttcttttgcagtacaaaaaaagtaatgatgctgtatacagacaaagattacctgtagttaagtaggagtaatactcttcaatgtaacatggtgattcagcactcctggtgaagttgtgacatttctgatgctatttccaggctcaagcagtgtgacacatctatattcagaacaccatctcatgttcagaacaccctgcttttgatcgccctcatggtttgcaacaccagaaacaaggaacaggaagctgtttcagtttactaattttaaccttgttcattgtctttctgtgctttggagatacataaaaaaggaaaatcatacatggcttcttttgcagtacaaaaaaaattatgatgctgtatacggacaaaggttacctgtagttaagtaatactcttcaatgtaacatggtgattcagcacttctggtgaagttgtgacatttctgactctatttccagtctcaagcagtgtgacacatctcatattcagaacaccctgcttttgatcgccctcatggtttgcactccagaaacaaggagcaggaagctgtttccgtttactaattttaatctttgcctaatttgctaccctgactatttttagtgtgtatttacaggacaactgccacatcacctccctcattttttttcccagtgagagagaaacaggcagtaagcaaatcctgttaatccagcctaatccattgcatattttgcatttgcaccatttgcacgtctgctgtgaagaatctgccattgcattacctgtagctgcattgcattgcattgcattgcatcatctccattgatcaccttgttgtctcagctgcattatcctatttttagctcccaaatctgcctgcctaaccactggagcagaagaagccattgacaaaaggcacaaggaggcaaagcccccaaagaaaggcaggaaaacattagagaagctggaagaaaggtagaggaaaggctgtgaccttccaccaatttggtca

SEQ ID NO: 55307 - DNA, 378 bp, Oryza sativa
taagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgacttatgacgcaataatgaattatttttgaaaaggaaaagaggatttattgcgtcagcggctagggtttcggtggaccgggcgcacggcggcggttcacgcgaacggacggccgagatcgacttgatccaaaacggacggctgagatcgatcggtccacgaccggctcacggcgaacggccccga

SEQ ID NO: 55308 - DNA, 362 bp, Oryza sativa
agaagtatgttaacagggcatttacatgaaagtagttcaaaggttgaataagaaactggcaacaaatgacccttctctgataggtcagtttggtgctagaatagaggttccaaatacctgagctgcctcgatttctgaatcttgcttggtaatatcaaaggaaagtggccgtaatatgcaaacaaaaaacagatccgatttatcaaaaaaagctttgtggctctgcctgcacattggtaattgatccatatgagagagatttaactcaaactgtacaggtaaaaacaattgaaataattacaataaattagaagaatgaaggaatggtgtaaaactgcatagttaatggaaatgcaaaataa

SEQ ID NO: 55309 - DNA, 229 bp, Oryza sativa
tggtgtcttgcatcgttcaacggtagggagaaggaggggcgatagcagaggctccagtcccctcccatcggtctcctagatttggttagagtggaggagatcaacgtttgtggcgacaggcgtcgtaaaaggagggtggcggtggcagcggcacgtggtagaatgaggaggggatgacgtggcggctccactctcccctcttccctttctctcccctccctttcccaga

SEQ ID NO: 55310 - DNA, 1139 bp, Oryza sativa
gagccagctcatggcggcgaacacgtcgccggggaccgggccggagaacgcgttccgggacaggtacagcgcgcgaagactgcgcacggcggcgaggctcgccggcagcgggccggagaagttgttgcggatgaggttgatggagtgcaaccccggtagccgcgacagcgccgcgaagtcgaagtcgccggagaggttgaggcgggcgaggcggaggccgatgaggacgccattgtagcactgcacccttggccaccggtgtgtttcatcgcacggcggcgacggcgacgacggcgaccacgcctctagcgcgttcgtcgggtcgatcagcgacgccttgagccggaggagcgccgccgcctcggtatcgggcgcggcggcggtatcgggcgcggcggcgccatcgggatcgacggcgatggcgccggcggcgaggaggaggaagagagtggagaggcggaaggcgaggaggagggtgaccatgaccaaattggtggaaggtcacagcctttcctctacctttcttccagcttctctaatgttttcctgcctttctttgggggctttgcctccttgtgccttttgtcaatggcttcttctgctccagtggttaggcaggcagatttgggagctaaaaataggataatgcagctgagacaacaaggtgatcaatggagatgatgcaatgcaatgcaatgcaatgcagctacaggtaatgcaatggcagattcttcacagcagacgtgcaaatggtgcaaatgcaaaatatgcaatggattaggctggattaacaggatttgcttactgcctgtttctctctcactgggaaaaaaaatgagggaggtgatgtggcagttgtcctgtaaatacacactaaaaatagtcagggtagcaaattaggcaaagattaaaattagtaaacggaaacagcttcctgctccttgtttctggagtgcaaaccatgagggcgatcaaaagcagggtgttctgaatatgagatgtgtcacactgcttgagactggaaatagagtcagaaatgtcacaacttcaccagaagtgctgaatcaccatgttacattgaagagtattacttaactacaggtaacctttgtccgtatacagcatcataattttttttg

SEQ ID NO: 55311 - DNA, 1016 bp, Oryza sativa
agattttgtgatgtatttgagtatttgagatgatcgattgtggatttggaggcaatttgaggatgattgatttgggattttggggacgggatggggtgaaatcaatatatattaaaaacaatgaagaaaaaaaaataataaagagcaaccggatctagtctttttagtcccggttgtatctttagtcccagttggtaacaccaaccggatttttactcccggttttttcacccgggactaaagatagcgatctttagtcccggattcgtagtcccggttgaaaaaccccttctccaccagtgtatggacatacgatttgaaactaagtactttaaaagttatggatggttatagtattaaggctgcgttctttgttaggagttcccaactccccaccatcgtttttcgcgcgtacgcttttcaaactactaaacggtgctttttttttgcaaaaagtttctatacgaaagttgctaaaaaaatcatattgatccatttttttttagaaaaaagctacttcctccatttaacatatatatatatatatatatatatataataagtcgtttcagccttgtgcgaaatgataaacaaataaataaaaatgttttttttgcaacttcctctaaattgttttactagggaaaaaccgtttgtataaacaaaggtagtatttagtagttaaaaaccaactagtaaggaaattttaaaaattatgcggatatctgaaacaacttatatttaattagcaaagaatgaaaataacagattgtattttgcaactggctggagaaactgtgtggagagctagtttccaccgccaaaacaataaaaaatatcattgtatgttgggtttacgattacgacaggctcttctgtttcgggcaccggcgaaattcggaatttcgtgaaatccggtaaaaaaccggtaaattccgaacaaatttcataaaccaaaatttgaatacaaatccctgagtttgtcgacaagttcttgaaaaccggtcggttttagc

SEQ ID NO: 55312 - DNA, 286 bp, Oryza sativa
ccagccactctggcgctccaaaaaggaccatttctgtgataagttttttttagggatctatttacgaaataagttttttaaaaggaccaaaatgtgaaaaatccaggttgaaagtccctcttctcctctccatttgtggagcgcagtggcggcagtgcttggtcggctcgtcgacggcctggctttagtggcacactctaggagtgccgacgagttctgtggtggtgccatgggctagtgcggtggcgggttggttgctgtcgcgcgctggctcgcaagggaagaa

SEQ ID NO: 55313 - DNA, 471 bp, Oryza sativa
agttcagaagaggtccctcgggggccgaaaataaagaaaagagaacagtagcaatttttccattttattttgtataattttcatgcaaattacattagaattttaaattgattttgcatgttttacctctgtttaaatttgaaccaatgggagaattttcacagagagagaattacatagattttgctactgttcatatgatttttacatagttttccgctgcaaatagatgtaattgatgaaaattagtgtttctaaaattaaatttcgaaccaacgggagaatttaattttaggaacattaattatgtgctatgatgttgtaattttctaaccaacgttgttaatgcaatattatagttatggttatatgtgttatgtctaattctgcccaacggtgatgtaggcttaatgcataatattttaatgttaattttgttctcaccgcacatgattatttcaagtggctact

SEQ ID NO: 55314 - DNA, 678 bp, Oryza sativa
atagcaaaaacaaccgcgagcagctctttttcagtagttgtataattcaactgagctccggttagagttttgctagcgtaacagattgcatgatgttttttatctttggtttagcccaagaccgctccaacagcaaagtcacttgcatcacacataatctcgaagggcagagtccaatcaggggattgaatggtttgagcagcgacgagtgcctttttgagaatttcaaaagattttaggcacgcgtctgttggcaacttttttgacaagtcgacaagcacgatcgcaacacctaaacgccttacggtgatatagagttgccaaccaccttaatctaaccaaagggccaaatcaagatgggttttgtagaaaagcaactaaaccagctagcggagccgatttagagatcaaaatcagcctctaggccgatttagatcgatatgaggataactacccgtctcatgggaaaaacggaaggttttcaggacaaacctacaaagaggtgtcgcactctcgcagcgatgacggacagtttagggtgcaaaccgacaaagatggactaaactagggtaaaatagaaaaacatggtaaaataacaattaaagtaaattgtattcgggggttttacaatgaacctgccttgtctcttaaataggggttggtcttgccctctacagg

SEQ ID NO: 55315 - DNA, 1017 bp, Oryza sativa
ctccaacatttccatacgggtttggataaggagtctgcattctatttggacatagccgctggaggatcattcatgcacaaatgccgtcagaaggaagaataattttggatcgcgtcctagaaaatacttccttcatgacgcaacccaataaaccccagccggaggtatcgtgtccaagattgaggaacctctaacgatcgagccactcgctgaaccatccacttatgctagctcgattgatgagaaggttcctgagcagccgtccgtcgagaatgaagaaattcagactccggattgtgccgcaattctgctcagggactgttttgatgaagactacggcaataccctgaactattttagcaagaggaaaccacccattcctttgtcacctcccgatcctatggaactcgggctcctacgagaaactgtccgggagttgacatccataatgagcgatgaatggctaagggaggcagagctttcatccgaagtaattcggataaataccgctccccgaatcattccttgccatctggaagggaacaacatcggtattctctacagtccaactatcggggccaatctcgtttcggaatcttttgcattcgcttagttaagtggtaaggcagtgaccctgacaaacaaattttttaagcatccaaacggaaatatcattgaaggatttgggattgtacaagatgtgcctatctgctttgaagacagggaggcgatcttggatttccacatctttgaaatccaagactttgatatcctaattggggtacccattgagcaacttctcatcaacacaccctgattagatagcctcaaaataacactgggagggaatgaattctcaattccattctcgcgggcaaggatcaccttgacagaccctctcctcgaaattaagtcagcggaagaggttaccgcagttcctcctcatgagtctcccgaagcccttctggaagatgaggtcccccgacttcatcaaggaagaagtagatcccggtgaga

SEQ ID NO: 55316 - DNA, 1501 bp, Oryza sativa
tagcaacaaaattataaccgtatgaaagtaattttaaatctcaatctaatgatataatttttaacaaataaaattcatttcatattatactaagcgttggtcaaatgttttaaatgttgaatcttgaaaatgcatgtgcgccttgtattatgggatagagggagtagtacactttcaagttttaacgtgtgtctacataaaactcagagcgacccctaacaatttgaggattatatatgtgtaaaatgttaaataagactttatctttagaaaatactaatcgcatatataatagatcaagcctaaatattttttttacaaaacattgggatgggtctctactacgcatgcaaccagtgtccctccataaaagctacgatcaaataatactcttttctttagatatatcctactatcaaacgaacaagaattgttcacaaccataacacttagagctatgtcaaagaagctcacctacctacacatcaattcagtttattcttatttttagggtcatgtatagtcgctgtcatcttacacgtgtatattacacgtgtatagagacagatcttgtaaaactacgtacacttctaattgcgatgcatttagtataacttaaaaatacacttatacagagaacacaactaaaaatgcgaattttgataccttatggtttgtgtgaaacccacaagcatgctttgcacacattttccacccacacaaataattaactccaaaaatgaaactctcaaagcataaattaaaccaagcatgcccaaattaaggtgcaagggcaagggcaaggtccctcctttttctcccctctttcccccaccaaaccagcagccatcaccgcatgcgttactacgtgtgtgcatggcctccctcaccatcaccaccagcagcagccagcccaacgtatactccactactactactactacgtcagttacactccaccaccgcgtccgcgtccgcgtctcgccgctcgccgcccgcgcgcgctcgcgtctctcgcctcgcatgccaagtgtgcgccgcccgccgcgccgcgccgcgccccctagcgcgcgcgcgcctcctcatgaccaacgtgaccccacccaccaccaacccccgcttccgcgtcactccgctcgcctccaaaaccacaccgcgccgcgctcgcgctctcgctctcctcctcgctctcgctctctcgatcgatcgaatcgattccgctctcccgaatcatcccctcctcctctcgatcccctctcctctcccctccccgccgcacgaaaccctagcaaccaccgcgcccgcgcaagccaagatgcctcttccccgccgcgccgccaccgtgaggatccgccgcggccagatccaccgcgtcaccgccatgccaccgccgccgcagcaagccccggagccggccgggctgcaactgctgctgcagccggaggtggtggcgccgaaccacccgccgcccgctccaccggcgccggcggcggtgcccgcg

SEQ ID NO: 55317 - DNA, 1501 bp, Oryza sativa
tggccttttcgcgctgtagattccagttctgattatgcattgttcagagatcaagtgcagataacccaatcactacctttctgaatgaaatctaatccaaatagtgaaagctaaatctgttatgtctgaacagttctgaaaagctggaccagtcgaagagcttcattgatagccatagatacagctctgatctgagagcatttagccagcttaagcttgatcatttgcttctccgggaccaaattgattgacaggctgaattagtcccggtcccaagcatggcagatgcatttgtccgtggcatctgaatctcctggagccgacatggaggttgcctttgtagcagagatcatctcagtcaccagctagatgatttgtcgtggattattattggcttcacgtttcaaaataatatgatttctcaaaaagttttttttttctgttgtattgtttatttctttagatcactgggtcactggataagatatttaattttgtttggtaagataagatatttagctgtttaccactcctgcatgtggcaattaactatttgtcacttggatctacatatcttatacgtataaaggtccacgcgtcattgagatataagtgataaataattaaactccagtggcaaacagttaaatgcccaagataagatgctactactatgcaattggtttttcaagacaacatggagctaggattaattcggcatgatgcttactagttctatgcaattggtttttcaagacaacatggagctaggattaattcaggagcacccgcgatagtttggtagcttgttgatgagtaggaaacggagtcccaagtcatttgggctgaaaacctgagcaataaaaatgttgatcatgcattacccatccccttttacatgttcatctatttatggtgctttaccaaacatgctgccaggctaagctctttttatttatgttttctttgcccttgtttcaaagtactaagcaacaggtcaaatgaagcaactaaataggtgtaattttcataaagttccactatttccttaaatctccttcatcaggaaggagccagtattattattggacgtccacagttttggttggagtgtacacgataagcataaaacccttgccagtgatctcattatttcaaaacctagcttgttgtttatggggaaaaactatggaaaaacagtgcctggttatacttatattctgcagagggtaactcagttaatttctatttggtcactcctgtccacttcaattaggtaatttagtggaaattccttgtatacctctgaaatcgacatctttgcagagtttagaatgcatcgcaaactgttcctgtaatttgaattcatgctactgtattccatttatacattcagtaagatctgatgtaagttgcggctcttctcatttgccccttttggctactgttccttgttttctggtaactaatcttggttaaatattatctacatttccatagg

SEQ ID NO: 55318 - DNA, 1501 bp, Oryza sativa
cagaaatcgttgacaaaaatgatactatcaacttgcgtatgaaagatgaggctggcatcacactataattgctgcccaaccgattgtttgaaagagaaaggtcccaaaaaaatatattcttggggaagccatcttggtgtgcccaaaatcaaatgcctgtcatcttaaagaaaaggcaaaggaaggaatcttcagccttctgatcttttgcggttcttttcgtatgctcatcatcttggtatgttggtaccattaattcttctttttttttcttcttgaagagttataaattggtattttgtttttgtttctttgcaagttggtcgatcatgcgttgagcataatataattgatgagaaaatagccatatatacaatccccaaaaattcacctattcagactgttgtgatcatgcttggtgatgtcaataatcacatcgatcacttgcctatttttcagccaaaacctatcacaattggccactagaccagtcgtgtgctacaatttgctatggtactatttggttaggaacttggtatggtagggagttgttgtattgtgagccaaaaggtgtgtattgcagctctcaaccatacaccctcatccgtcttagaaaaaaaaaaagctcgaagttgtttttttctaggacggctctccggtctataatacttgacacttagaatcaatggttgttgtccaacatcaaatattactgatcggaggaagtaatagctaatgattttggacatggtgagtgaagttatgaatccacaactctgccatcacctcaattggtagttcggtgcttatctaaagatcgctttttcttggtttcataatgactactactccatgtattcattgagcccactatgtatctccattgagccgaaaatgtttgatatgggcttgagcccactctcgctaactcacaagcacaatcctaacacattctcataaacacttttcactccgtccaaaaaatactcaacataggttaatgaatctgggcaaagagttgtccagatttattgtactagaagggatcaaatcccctcttagattaagtttttcttttgacggagagagcacacaagagctcgagcctacactgttcggctcgatcgagccgaggaaatgtcaatactattttaaaaaacccaacgttttacctcgtatatgagttcacattttacaactgatgattgacttattatgctataataatatgctgaatgaatgaatttattttttctcttctacttccaagaaaatccgttgccaagcaccttctttttcctagttttcgataataaaatgataagcacaaaaatattcgagtagtttttattttatttttttagctgaaaaaaggggtaggtggttaggagcgtagctatatcgatagaaaggcgccgcgcgtgctcctcctcctcctcctccgattccaatccaatccaatccgattcagaagtagagcgagcggcggctgcggcgatgg

SEQ ID NO: 55319 - DNA, 1501 bp, Oryza sativa
gataatgcatttttttcacctttaacactaaattgaaaagcttttttttgttcccacagtttttttagatggttttgatcctacagttggtggcacttccacatcgactacgtagggtcttcgacattatgtcaacttccaacatatgggctgtggtcccaattaaatcaacccaaaagtatttccttttttttttcttcaaatccttcatagtttaatcttggattctgtttgattataaatgtctccaaaaccttcaacaataggtgataagtctctctataaagttttttaaaattcttctgctggggaattttcttgtttggggggtagaaatttctacaaagcatccaagagtaggaaatctggtatatgaagcagatattataaagattgaaagattgaattgcacatgtgaatttgttgcaactttagaattgggctctccacttgtgaatttgtgattcactttacacggcgacatgagcccatcacctaccctactacttcatgcgcttacctctaggagcactaaggaattttcgatccagtaacactgaaaagaagatatgatgtttctttatagcagagcataatctttttttgacaataatttatccttgcaaaacatgacttaaagtctcaaaaagtgcaaaacttgttgagcaatggagcatttaaaatgttgatgggcatactgagagtcaacgattaggttgttctgtacaagttacaacttaggagtatacaacagtatcttcaagagcaggagcagtacagaaatgcttcaggttcaatggactcgactctatatcatttgctttgaaaaaaaaaatttgtatcatttcgtgactagcaaaagtaaactaatgtttattaaaaatatgtttataacctttcagctggtcttctttctttgaatagctgaggttgtcccgtcactcgtttctttttttatccagtaattattcaatattaacaaaatcttatgtgtcaggataaacaccggagtccatgggtgcatgagtgcatgactctgttcaccacgattcaaatctcgatgcctcacgaatattacgcatggatcaggatcctctgcagccaactgcaccatcctgtcaatgtgggcccgatggcctccgggcccacatgtcagtacaaaggcacggtacagtgactacggaggatctcaatcctactacgcatatataggtgggtttttaactatattttgataaaatcatagatgtagattttaatgtgatctgagatgtgtaatagtgtacgtgtgtctgccatgtaatcgaaaagaagaatatttgtgagggaatatgaaccatttctaaggttaaaagggaaaatcttttggtgtgagaaaataccctccaattatgtactcaacaaggagggaaaaatattagtagataaaataaatcccctttgatttggttaacaaaaatggttttttttcccaacaaagcaaaggaaaaaccaccctccc

SEQ ID NO: 55320 - DNA, 479 bp, Oryza sativa
tatggccgacctaacagcatctgtacactatgctgacatgaacatggcattgaatggatcatttggaatcaagcaatgcatacgctgagtcgcgacacgcagagttgctgcagcaattcagttcaaacttgcgagagaaaaagtgttgttttgtatgtaaaactttcttgtaacatttgcttttttcttcaatcataataatattcggatgaccctcttcggttgcttgaatagaagtgttgctttaccattgtcagggaatacaacttctttacattttgtctgtccgattcagaatcaacgaataatctgctgttagaattctggaaaaattcctgacaatggcatgtcgagtaattaatactcctatggaatttatacaaaagctagctcatgaggtgagggacccctccccttttaagttggtgccactccccctaaactttcaatgtgggactattcccaacaatctcccccgt

SEQ ID NO: 55321 - DNA, 1501 bp, Oryza sativa
gcggatttgtttcattgatttatgtctttttattttaataacaaaacaatggcagaagcaggagacgtaaaattcgattatctattttttattttttaatgacaaatttaacatgaaaatgttaaaaatgaccgaattgtcacaatttaagaataaaactgtcttagcactggcctgttcctacgaatgggaaaaaaaatgaatggttcagcagagacagcgggaatgttattcatttgtgtctaacaaaatgagttacacaaattgttgccatatcctaccctgatcattggacaatttcgactgacagacataaatttctgacggcgccgctctgctgacagatattatttgcccaagcaaatcttgctcggccgaagagaagatcacaccagtcgctactgacatatcgccatctaatcaagccaatctttttaaagcaacgcaaaatggggcaaatctgccatggataacaccgcaatatcttccagaacttccatcattgggccattggaccagcagacctggaacaatcgatggttagcacttcgcaattagcagattggttagtcatcagtgtgggaaggttggggtgttgtgtgtttgtgtgtgcagcgtgcatggttgttcagatccgagtcacctaatggggatttcttttgctgttgccttcggttgggcttgcttgctcagcttaatggggagctcggagctaccatttggaatggacaatttagctgcatgctctggcctttgcaattgtttgctttgggttcatggcaaaggatcaaacaataagatttgagaaattgagaaccttattaactatttgactgcctcaatttatttgagtttgggaaacagtttacttgaacaaaatggtagtctttgtttttttttaaaaaaaaacattttcagatggtcgtttcgcccttgctgattaggaatattcattttcaaaccaacgaaaccggttttattgaaatgaagaaaaagacagtttggtgatttatgaattgattgaaaccaggaaaaaccacatcgacatatgtatggacaaatgtcacagatcaaagtttatagtcactttcagttgatgaaaaccacactttcaaattgaaatcaatcactttctatccagcatatattgcactatcagcttgacaaatatcacattcacctaacaaactatgcatgttcatattcaacatgatcaatttgctcatgtctcctagcaaatcatgcattcatttaattcaaaatggaacactttaaaccgacagaggatcgtaatcacctctaattaatggtgtatccccactcgtagttgcattactgaagaaaaggtttatcagatgtataagcagaaacgactggagtagattggaaagttacatattgaaatgctcaatttttgctacactgatgactggttagtcatccctggttttgtcaaatctggtttaccttacttttattcgtaatttcacgaaagatcact

SEQ ID NO: 55322 - DNA, 931 bp, Oryza sativa
ctgcagtcgactctagaggatccccaggcttcccagatagtatcaaggaagtgaaacttaccagatcatggcatctagacaatgggatgccagagtcctcacccatcatgactgcttaaataagcaccagctttctgttggtgaactcctcttccctacctctccctaattcctgtttccccgcacatggttacatttcttccctgctttagaaacccctaatggtagtcagttagggaagtgaatttgagactgatctcccatatcctcaacagcagcacctgattaaagccttcttccctggcaatacttgttgtctcagtgattggctttctgtggagtgaacagcaggacttagaccaaacctctggcattttggtaataaaatgatgctgtgcaactttcaaggatagatcacaaaaaatgatgcaacttctacgtggatccctgaaactctggactgcatgtgagaagccccactctcctgaggctgccctgctgtggaggaagccaggtcacacagagggggcacatggaggcaatccagcctacagacctgctcaggtcctagctgacagccaacatcaccctctagccatgctgatgaacatgcctccagatgattcttccctctgagtcattccttgcctttgagtcttcccaaatgaggctctagaaaatgtggagcacagacaagattttctttctataccctatccaaaattccaatactaacaatctgtgaacttaataaaatggttgctttacatcaccacatttctgggtgttcaatgcaaaaatagtagctggcatattcagttttctcatatgtaaaataaggataattttacttacctgttgtccaataaagtctctataagtatgctaaattgcattacacagtaaagtttttttaaaaagtcaaatttag

SEQ ID NO: 55323 - DNA, 444 bp, Oryza sativa
ttaggtcaggcaatttctctcagggtagcaaccaaacagcccctaaatctcacattcttatcaagattgtgtggatcttagcattaaaaatttgcactatattccaaaatcgttccaatagtcaccctcatgcgtatgacatggccgctgtcttatgtcgtctcgttcaaataaaatctcgaaaattgtaagaaaaaagaatctttcctctttttttgtctttacagaatggccatgtggatgtggtggccccgggaacaggaatgctggacactgccaaaatgttgccgtgcggactcatcacccacaaactatcaaattaaatacgctttccacaagaaaaaggaaaagaaaagaaaaaaaaaaccctatgaaagtacgcacgcatttgtgtcataaatggactcatgcgtctcagtcacacacatctcgatgccatggcgc

SEQ ID NO: 55324 - DNA, 1317 bp, Oryza sativa
cacaaatgcagaacccagagatacagaggaccagctgtagagttatttcatacaagggacttgagcatctgcaaacttcagtaacctcagtggacacctggaaccaattcttcatacatactgagggacaactatacatgcaaaatcctttaaagtgtttcaaagatattcttcatgagcacagaacaagccttaaatttgccttttttttgagacggagtcttgctctgttgcccaggctgcagtgcagttgtgcaatcttggctcactgcaagttccgccttccaggttcacaccattctcctgcctcagcctcccaagtagctgggactacaggcacctacaaccatgcctggctaattttttgtacttttagtagagacggggtttcacgatgttagccaggatggtctagatctcctgaccttgtgatccacctgcctcagcctcccaaagtgctgggattacaggtatgagccaccgcgcttggcctaaatttgactttttaaaaaaactttactgtgtaatgcaatttagcatacttatagagactttattggacaacaggtaagtaaaattatccttattttacatatgagaaaactgaatatgccagctactatttttgcattgaacacccagaaatgtggtgatgtaaagcaaccattttattaagttcacagattgttagtattggaattttggatagggtatagaaagaaaatcttgtctgtgctccacattttctagagcctcatttgggaagactcaaaggcaaggaatgactcagagggaagaatcatctggaggcatgttcatcagcatggctagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaaccatgtgcggggaaacaggaattagggagaggtagggaagaggagttcaccaacagaaagctggtgcttatttaagcagtcatga

SEQ ID NO: 55325 - DNA, 1501 bp, Oryza sativa
gactaaatttagtccctctcacaaaaatataagtccctttagtccactttagtccctccaaccaaacaccaccttcaaacaccaccttagtaactgaaaattcttagatttaattgatcgatctgctgagagctttgcattgtggagcacatgccaggccagctagtacattcttgtgataagaaacatgaagtttcggtttaacctcttaaatacatgcatgcatggttgatacaatacacgtcctgaacatgaataaatactattaaatacgttatccgaattttatcatatagtaatatatttggattagtttcttaatatgacttttattcttttatcccaattatatatcaatctcttgtgtactaaaatgtgatgtgctattgagatatttcactgtgtttgtaccaactcctgaaaatactcatcatatcgtcgttgttggttggcattcatagtttattttgtagcagctgagcaattttaattagtctttttagcttgtaagattcttatatttcttagcaatagccgagcgcattattgggctatagtgtaaccaggtgaagcgtacgcgtgtgcataagttgtccttgtggttgaaagaagaatactggaaggatcgttggatgttactgctgatatgatggacacttggatccaaacatcatgaatgcgctcaactacttgcatgttccaaatgtacaacatgcatgctagctgctacaaacgactagctccgttaggccgctgctaatcattttctcatcactaatactaacactgtgtgactagctagctaaaccagccctaacaaccaaccaccctgattcaattgaattgaattgaataacattagacgcaccgacgactaagaacggtgcctaaacactagcactccaagcttaattacactatgcgtacaccaattaaaaaatgtcacgaaacattctataaacaaattagatatttactcctaatagtattatacatatgtgcaaagtctcatattcaaattcaatatattttagctgtaacaaaaagtgaaaaaaacccgaattttagctgtaacaaaaagtgaaaaaaaacccgacagttttaagggtaaaaatatcaggattttgtcttttttatggctaaaatataatgaaattgaagataagatttcacatgtaggtgtaaaactattggaagtatgtgtccaattttttctaaaattttttatgacatttgctaattgatatgtatagtgtgtacataagtaaagcttgtgtgtataggatatgttctctaattataggtggactatatattccacgtagtaactacatttgacttggtcgatgcatcggcacagatgaaatcatagctatttaaagccccctacattcccgggaattctcatcgatcgatctcacctgcagcagcaaacgagcaccacacaccagcagcagcagcaaagtcgatcgatcgtcagcacacacgaccaagatcgaga

SEQ ID NO: 55326 - DNA, 258 bp, Oryza sativa
aagctctgttcacacacgttcccttggattcgataccctggaatactccgtaggggaagtgctacatcggtatatccgtgcgctgcggattttatctgtgatcgtaagaaataccaacaagcatttctggcgccgttgccggggaacggttgctgatcatttccgaacccagttcatcctcgtatcctttttcacttttttattctaccttcacccctgctatcctagagaagtattcctgtcaaactcttctcacca

SEQ ID NO: 55327 - DNA, 1501 bp, Oryza sativa
cttctgcatcactgtcgtagagtctagtaccaacagaaggaaggagttagttccaattatgtgtacggtgcacaaattttacaaatctacctgtaatgcatttcgaagaacgctgctctcttgttgcgagccggggggcatgccaagtgccacgcccgcatcgttgactgtcctgatcagctcccgtgcctgtaggagaagttataagcacgaagtacggaaatgggaaaacgagtaactagaacccatactcaccactctatctcaaactggacccgccccgaccgtgctacctctacgggtacttgtatcgtacttgttctgctcctccaccccagttgggtcgtccgctatgttggctagcgtccaagacagacgtagggcgaggcggtagttcctcgtgagccaggctaagtacgcgtcaaactcttgcctgttgtgcattgctttatccggcatgcggttggcttcgaactggttccatcgatcgatgtgtgtctgatgataagcagtcaaatcggtggtcttcttgtttttccttctgtatgtcaatcctacatgcaagacatagtaatatgcaaatttttagtgacaaacgtgcaaataagaccgactagatgaattatccaagaattgaacttgatttctacatatggttatcggagggaactggactttcttaattatggagttcgatgcttgtagagaatctttgcgggatcgttggcactaagggtgggcatctcagcgccgaagcggttggcgctaaggttgggcaacacagcaccgaagcgattggcgctgaggttcttgccacgtcggcaggggggtcggctcagctgccacgctggcacgaggtcagcgtcaggtccagtggcgctgctatttacaacctcagcgctgagccgacggaaatagttgaagtttttggcagtggctagtttcgaaataagtttttcaaaaagatcaatttgtcaaaaaaaaatggtgaagtccattcgcggagtgaaaagacgcaagataacaatggtggcaattaagaaggttgttcctgagcatgcaaacaaagatggatggatcacatgcgtgcattcacgcacgtatcgacagatcccgagggtcccaatacgcaaccaccggctggtacatatgcatatgcatgcacgctctatactattagctaaacacagtagatcatctcccatctccggccggccggccgatctggaagtttcctatcgctaaccagctaagctaacctaattaacccggccttaatttctttcttctccacctccatctatcgctagctatttataccacccctcctcgacagctttgctcactccagtactccaccacaagctctagcttacagctcactaccagtgtacattgttgctagttagctagagctagatctcgatcgagacaatggcgggtgctcgcaggacgatggcgctggttgcgttggtggcggtggtggcggcggcggtggtgg

SEQ ID NO: 55328 - DNA, 1501 bp, Oryza sativa
cgttgaacagataatactacaaagaactactgaacaaagctatatagtcaaatcgaggagcaagagcaaatgtgctgttataaactcaccatgattatctttaaaacctatttattagtttctccacatgttgtgttttcagttcttaaagaattaagccattaacatcgctaaatttgtccaaggatggtaccgaagtatttaagttcagagtggtcatttgctcagttcagagcgatgctcaaaacaccgtaatattgattggcttcgatggcgttgaaatcgttgaattgatctgacttcttgtcgtggttcagggcttcaggctcgctagttatatgtctccttcttgggcctggcgtggaacgcatactgatctctagcatttgagccgctgggcaaggagtagcctcccgaggctgatcccccgccgtaatcccgcaacgatctcatggaagcacgccgccgatctgctcatcgcatctgctccgccacactcaccctaaacctagcacggcccaacgatgctcaagtgtttctaattgatatgcaaaattacgaattcaaccatccccgtccatattttttggacgattataccctctgacgtttctactattgctatttaagataggagtataaataaatctaacccattagatataaaacgatcaacggtttagattaatttatactccgagtggaaagcactggagtgggactcctccaacaatggaagtacgtagcagtaggagtagtttagatttcctgtggtactagttgcatctattgttgtggcttcgctggtcaaatttgctgttctacacttcataacagtagtttacgtaggagtactttactcgctctctctatatagtgcaacgaccgtcaagatatctatagttcgtagtagtactgggtttgccattcgtcaaacgatttgccttctcaaaaatggcagaaggcgaggaaaattagccccctcacacacctgacaaacccttgttgctgcaccagagcaaagaacaaaataaaacgcagagctttcatttcacggcagaggccagaagagcaacagatagtcgtaggaaattaaaaaatggggcgtcagccttgttccaacagcgaaaaccctgcataaacataggaaaacaccaagtgggtccttttttgggacgtcatggccctacgtgcacacatccagctccattatatagccatttttatgcctcttccacaggagcttctgacctcggtcactctcactctcatcagcttagctacactctctcacacagtctcactccccgtgattctgcccctctgctttagctatcttctccttcccatcgtctcggcgactgactgggtaacccttcttcacccctcgccacagtgcccatggagctctacgccgtggtgaagccgtgcaggctgtacaagaagaggagcagcagcggcggcggcggcaaggtggcgatgtgcgtgcgcagcggcggcg

SEQ ID NO: 55329 - DNA, 1501 bp, Oryza sativa
ccatccatgcacagtggccttcacaagctcgcagagctcagctccggctgcctgcactgcactggctgcaacatacggtttctgctcctgtcccccctctcccctccctctcttccaggacggctgctgcattcatgcccctatccagtatccggccttttgtgcttggatacttgcatgatcgatgaagcgtgtgtcacggagaggtagcaagggcagatcctttagagcaagtctaatagtatagcccactactagctataattcatctataaccgatttaatagccaattcatacaatagttgcttactacactattaatatatggtctcacctgtcatacacacagtatgtcttggagtccgtgctgcagctggctacaaatctgtagcccgctgctcttctctctcatcgtttatctcattaaaatatatttatagctggctaatagtctgctattgtacctgctcttatgtgtgtggttgcaatgattccgaccacagtgtgggtgactgttcctcttgatatcttgcatctggtaacagtggtgacaagtggacgctgatcagctacatgcatagttcagggctaatggtcctatgtagtagtatatttgtaaggcacgcagatgagaatagtaacaaaaagcataagaattgatgctagatagatttcattcggtgtttcagcgcataaaagtgtagctgaagttcgaaaagaaaacatgggcagaagatgtagttaagcttcagaatcttcagataagcaacaccatgtactatctcgttatctttacacctatgcgttatcaacacagacgtgggctgatctgatacgaactctgcacacgacttcttgactttggccaatataatccgtcactgcactgaatgcctttgcaggtgtaggtcgcccagatagtagcaaatattctctctactcgagtctcgtcatctcttatcttcagagttcgcactcttcaagaatacaccgggcaactcgccgaagaagaagcttcagcggcagaagaagaatcacccatcgagagttttcccctcccaaggaagatcagggtaattccgtatctccttcctcatggaaacgcactagttcatctttaggcccaaatcgaaaaagtttatatatggctagttcttgtgcatttttggtggtgtcactcatttcagtacttgatggagcatattattcaggaagaatattcagggaacatgattgtccatttttcatgttttgctcgtttgctgggataatctcttaggcattcaattttaaggaatcagatatcagcgtaccatgttttttcattagatcctaatagttttgtttttttgagaaaatgcattcttggatcaaatagaagaaataaaattttaaaaaaatgcataaaagtaggaagaaattggttgtggtttgcttcaactatatgctagtgggttctatgctgattttcaggatctcttcttgagataaaaacagtca

SEQ ID NO: 55330 - DNA, 407 bp, Oryza sativa
tcctgcagcccagaaatgacaggaaccagccaattgagtcaaagaagaataggtctctcctaagatgtttactgaaaacgttaccacttaattatttttctatcaatattattcggcctaaaaaaatgtttttggattcattgaaatcagggtttaaaaaatatatttctataattatatcacatccggtcctggtggtacccaaaccacctttaaagttaacccaaacctaattaaaccttattccctttggccaaaggactctagtgataatggctgagtgccaggtaaaataaaaaatagtggaagaaattagtgcaaactctcgttaaccatattgtgaaaataatgaatgttggaaatgcacttctaatagcatagactgaaacaaacattctgaggggagt

SEQ ID NO: 55331 - DNA, 1501 bp, Oryza sativa
acttgcaaagttgcaatgtaactttatctaagtatttaaggtccctgtatttttcaatggctatttttgatcggagaatttgggctcgaggactaatgttgtcatacatttttaactagggttgaggataaagtagagttgtggcaggaaccaaacactatctattaaaattatgacttccttaagattaggtgtggaaaattagttgccaagtaaaactccatggctccatgctagctagcagcctagcagttccagtgtggtttccaccagtgaccgcaactttgctcttcatgcaatcaatctgggcttctattgtgacaagtacaaaagaaaggagatttagagaaagagacatcattctaaacattattttaagaaaatattatgagcatattggggattgaactctagatttcaggattgaaaccacgcactaacccttgccactgcactgctataagtgcatcttcctttatgacaagtaaggacgacccagtaatgggagaggcaagattgaattttttttgtctacaaaatacaaatttccagtgtggttccactgttccagccggtgatcacgattttgctcttcatgcaattagtttgtgctaccctatgacaagtcagaaaggcagagtaatgggagatgcaagattggaatttttctttttctacaaaaaatactacaaatttctagcgcggcacgtactttctctatctcaaaataaacatgtgagtcctctacgagctatatgtttgaatctacatatgtttgcatggactaaacatgttattatattgtacataaatgaatgtttaaatttataagttgctatatttatttatatccaccatataattttgtatatcataagtgtaatttatctatatttattcttgcttggtcgtagcttgaattaattgaaaggtcatggtataatttatataactctgaaacaaacaaatgcagcagagatatgcgtacagttggaattaattgaagctatatatatgtgttgcactgttgcatggttgagaagatttggcgggtcattatcgatcgatcagaacaaatattaatggtgagaattaatgtttacctttaaaacactggaacaggttcggtcatctgtaacgggcctaaagcctcatctctatcgggtagtgcccccgtcactaagcaaatgtcactaatatgagaaaatatctcaatcgggcatgcggccgtcacggatgacatacatctcaatcgggccaacactatagcccgtcacggatgactatcatctcaatcgggcctaaactatagcacgtcacggatgcctctcatctcaatcgggcctaaattatagcccgccacggatgactctcatctcaatcgggcctaaattatagcccgtcacggatgagtataatccaaaaaagataaataaattttggtctttttttagctattctcaagcctttactaggcacgaccgcgggccggtcttttctt

SEQ ID NO: 55332 - DNA, 904 bp, Oryza sativa
gattttgatgaattatacaactttgttgttgatgactttttcagttgaaatcatttaatatttgaaaatattgtttgaagttattataatttgaaattcaaattcaaactattcaataaatgttatatagagaaatgaccaaaataaaaattgtaaatcttgataagttatacaattttgttgttgatgacttttctatttgaaatcatttaatatttgaaattattgtttgaagttgtcatattttcaaatttgaattcaaactgttcaaaaaaaatgttatatagaaaaatgaccaaaacaaaagttatagatcttgatgggttatacaactttattgttgacaatttttccatttgaaatcatttactactcgaaaaattatttgaatttcttatattttaaaattcaaattttatatcgtgcaatcaaacccggatggagaaatgaccaaaataaaattggtagatctcaatgagttctacaactttgtttttggtagttttttcatatgagttcatttagtatcataaaattcaattcaaaatttatttttgcctagaagtctgatttgcctcctcatcatgttaatacttgctaaatatatatttgatccaattaactcggtttttctagtgaaacatgtgaaatatgtgaatggatgtgaaatatgtgatcaaaatgaatgttatgtgaatgtggttgtgttaaatatattgatggttgtgtatgtgaataaatgtataacttcttctccggaaaccgatcaccaaagaactttgaggttaagcgctcttagggtggagcaattttgggatgagtgaccgatcgggaagaaaagaccggcccgcggtcaccaaagaactttgaggttaagcgctcttagggtggagcaatttcggga

SEQ ID NO: 55333 - DNA, 441 bp, Oryza sativa
tctcatacggactcgaaatcaggcaaataatatatgcacggacatctacagaaaaagttacatccaattctcccccgctttgccgggttcggcgatattaaaaactccaaattccacttgcaagattgtgttttcgaggagagaagtttttcggtggagctttggaaaattccatatgccacatatttcgtccgtttgagtttattttttacatggttggttcctatgagttcctaagtgtgaaaaaaatatcaaaaaaataaaataaaaataaaaaagttgcacatctctctcctctgcactagttcggagagaggagaggagaggaaaaattctacatgtcacatattacgttcatttgagttcaatttttctatggttggttcttgtgtgtccctaagcgtgaaaaaaatatcaaacaaataaaacaaaaataaaaaa

SEQ ID NO: 55334 - DNA, 501 bp, Oryza sativa
ggatattgcattaataaagacttcatctaattcataacaactcaatgttgtaaactgattggcgtactgcttagctgttaatactaatgactaaaagtatatctccttcggacttgtctcaagtgcccttaggggagtttgtttaaaacatactcaacgtttgtttaaaatatagctcactcagtaagaagcttctttcatccttgcaattgttcttgagttattttttttagataatggatttatattaaacccggcctctacacttgtgagggtgtatacagccaaacaagtttccaagagtacataagactcatccagttatatgggagacaacacaaggtacgaagtttacataagactcatcccgatacatgggcaacatcacataaagataaaacccaaaataagaatcaagaaagctaagctttaattcttcttctaaaattccagccataagtagcataaaactccattacccgtgactccaaaattctacaa

SEQ ID NO: 55335 - DNA, 1501 bp, Oryza sativa
tgtttcctgaaaaacctttatatattatcatcatttacttttaaaaaaacttttacactaaaggttactttattatggatttatttattcatattcacactaaatttttaaataaaacaatcaaacataatatttaaaagtcaataaaaccttatattacaaaaccgagagactatcccagcaacttaattttcctagctaaatatatataattgtagctcaacaattatcagttgaaccaaaagaaagctcgatatattaattattagcggaaaaaaaaataatgttcaaaaaataattaattgcctcaattagaaaatgaatgcgctatagagttagaagcaagtatagtagcagtgattactactcgcccatgattaataaatcttccgatactgatagaacactgagagcaagtacaataacaatttataagcaaactataagcacgtattaaaaaaaaagaagaaaatcctcctacaaatttatagtaagctttaacacgggttttaagatattacgtgcatatgagcaatagatcaagtattaatgatgctattattttaagataatagaatagaatcccggtctttgctcatagagctaattatttaaaaaaattccaaacacaatcacacctcaaaagaatacataaagacataagggacacatccaaactgacatagccacacaccggcactaacaccaattgaaaaaaaataaagtacaaacttattgaatattgtttgtgaacttccaaccaaaatttgtgaaaagttgcataaacgttgactccagtttgcaatgtgcaacttttattaacttagtgtcttcattacatgatcagagccaatatgttacgctgaaaagcacatgtaaatatgatctagatagtgttattaaaaaccatatcatttttgctcaaccgtatcataggctcaacataaaacagatgctcttataagaatgagtttttttatcaacctccacgagctatttttaaaaaatatgatatactatgtggaatggatgaaccagaagaaaattgcaatgctctccaaagaattttgtatagagacactccaagaaaagatgatggacagtcttattttcttttaaaaaaacaacaccttaattaccattccaacactttaatgatgctattagattagatataggatttttaagctagcatttagccacactattatcaaacttaatctaacggaacacatgttgttgtagtacgtcattgagattgagaagactctagtactagctactagctcgatggagtccaactcccaacgacttagcagagcgactgccatcaatggatgattctatcatagcacgtggccgcatctcctgttgcctttcctatttatacgtaccctccacccatcgaccgacgatccatccatcgccggcgacgaggagacgctgactgaacgaagcttacctagctactcgatcgatcatccatcagtctagatagata

SEQ ID NO: 55336 - DNA, 1501 bp, Oryza sativa
aaaattgcataaagcaaggatagcctcatccgctggaaccacactggaactactagcgtggagtaaatttgcaaagcaaaattagccactggaaaatatagggacctttaaatataaaactacaagttacgggttctgcagaaaaagaacaatttgtactatcctgcttttttttttagaatatttgtactatcctgctagcatgggttggaatcttggaatcataagaaagctagcgtcatctaattaatcatttcgctggtagtggccggttttaattaaccaagtttggactaaccaagtttgcagagtaatactaagtgttttgtatgttattgcatctatttgtatccacccgtaaactcattcacgatgagtgcaatttactcgatcaagaattaatttgtaatatttaagagtagtgtccatatatagcaggaattctgggaaaatataacgtactgataatttaagaagatatgtgttaatcctatcttactataaagttaatgtcccctaactcctaaagctcaacatgcaaacatgtcacccactagtaataattacatatttaatctcatgcaaacatacaaaatcatttataatttatttaattctacaaatcaacatgcaagtatatctctaatcgttattcctcacatcatttccataatattttaacaaatatatctatcatttataatatttaacatatacatgttccatgttaaatcgtgggtatcatttgtttgttttatgataagtcctgctaaaccctcacgttttattatttttttttctttttaatactagctcgataatcgaaaaaaatattgaaaattaattagtaattcccgcagcaaaacgcgaggatcacctagtattttagaaacgagagtattttatcagctttatgttttgacgttgggaggtatttggatccagggactaaactttagtccatgtcatatcggatgtttggacactaatttgaagtattaaacatcgactacttacaaaactaattacataattgagagctaatttgcgtgataaattttttaaacctaattaatccataattagcacatgttttactgtagcatcacataagctaatcatggattaattaggctcaatagattcgtctcacgaattagtccagagttatggattgtattttagcaatagtctatatttaatacttctaattagtgtctaaacatccgaccagggtttagtcccatccaaaccaattaattccgttttatcccttacctgaactgggatcgttatcgatgacgtggtgtcaacatatacagagtcaagagtagtgatgacatcaggataacaatcaatataaatagatagaagcaaaataaagaaataaaatactacaacctacgtgtcaaccttacttcattttcacatggtgaggactcagtataatgtacatatatacatcaacacagtaacaatataacatatatatatatatata

SEQ ID NO: 55337 - DNA, 1501 bp, Oryza sativa
gccgctgcaacctccccttccgccgccttcgcccgcatctcgcgccgccgttgacctcgcccctccccgcggcagccgccgccgacctcgccttccgccgccgcaaccgccgccgacctcggccctccccgccgccgctgcaacctcgccttccgccgcctccgcccgcatctcgcgccgccgccgacctcgctcatccccgccttccgccgctgcagccgccgccgccgacctcgccttccgtcgccgcgctctcgcctcttgacctgtggctgtcgctgatgcgcggtgaagcgacccgacctcgggcgctcgccctgctcgcccggccgctcgggcggttgcatccggcatctgcgaggtatattcctctttgggccgcccaatcccacttccgcccaccaaccaaacaggcaaaaaaaaaatgggccgccatctcccgttcacccaaaacctcccaaccaaacacaccccttactactccctccgtccaaaaaaaaattcattcctagcatcctgaggtggaattagtagagagtaagaatgactaaaaaaacccttaattattgaaaaaaatagtaagagtgatagataggtaaagggtattaaagggataaaacttctcgttttgcgtgttgagagtaggtagaatggtagaagtctgttttcagtttccacggcatgcggtcaggtccagcgtttcccaaaccgcagaggacggggttaccgcgccccggcgataagcacggttactgcgcggtaatcgtgaaaaccgtatgaaaccgtgtaaaatttatcaaaaatttgaattattttttaaatttatatgaatttaaggaggttaccgcggtttttctattactgtacctcgcggtaaggccggtaaccacagtaaccgtgcggttgtacctcgcggtaagatcggtaaccgcggtaaccgtgcggtgcggttatgaacggtaagttgaaccctggtcaggtcccatttattcctggtcataaaatggtgcaggcgtattgattggtggggcatcgtgtggattggctgcctgatcagtgactgacactgatggacatcactgtaccattttgccctccaacattagtaaggcccgttccctaaaatgttttccaaaaaatcagatcaaatcgttggatacgtgcatggagcattaaatatagataaaaataaaaactaattgcacagttaggaggaaaatcgcgagacgaatcttttgagactaattagttcatgattagccaaaaagtgctatagtaacccacatgtgttaatgatagattaattaggctcaaaagattcatctcgcggtttcctgatgagttataaaattagttatttttattcgtgcccgaaaactctttccgatatccggttaaacgtccgatgtgacatccaaaaattttcttttagccaactaaacaaggcctattcgttgttaacttgttattccctatgggcctcatttaccttctataaaaa

SEQ ID NO: 55338 - DNA, 1501 bp, Oryza sativa
aggttaaccatcagagcttattttgtcactaccagaccttattttaatgactaagcctagcagttaaactgaatggtaaccagtatgtatgtgtaatcatcgtggatttatgtcatactactaatagtgttgggctcttcaaatccaacattgtaccaactcctgagttgaagtttgtgcttgatttcatcatgctttcttggccttaggtttaggggccggtggtgggaacacggccctgaagacccaggcagcaagaacagcaccaacaaaagggcatatccagtagacgtagaattgctcccatgtgttgtggcgattgttcacatatgcccagccaaacgcctatggaaatgtagataatatttaaccaagattagttaccagaaaacaaggaacagtagccaaaaggggcaaatgagaagagccgcaacttacatcagatcttactgaatgtataaatggaatacagtagcatgaattcaaattacaggaacagtttgcgatgcattctaaactctgcaaagatgtcgatttcagaggtatacaaggaatttccactaaattacctaattgaagtggacaggagtgaccaaatagaaattaactgagttaccctctgcagaatataagtataaccaggcactgtttttccatagtttttccccataaacaacaagctaggttttgaaataatgagatcactggcaagggttttatgcttatcgtgtacactccaaccaaaactgtggacgtccaataataatactggctccttcctgatgaaggagatttaaggaaatagtggaactttatgaaaattacacctatttagttgcttcatttgacctgttgcttagtactttgaaacaagggcaaagaaaacataaataaaaagagcttagcctggcagcatgtttggtaaagcaccataaatagatgaacatgtaaaaggggatgggtaatgcatgatcaacatttttattgctcaggttttcagcccaaatgacttgggactccgtttcctactcatcaacaagctaccaaactatcgcgggtgctcctgaattaatcctagctccatgttgtcttgaaaaaccaattgcatagaactagtaagcatcatgccgaattaatcctagctccatgttgtcttgaaaaaccaattgcatagtagtagcatcttatcttgggcatttaactgtttgccactggagtttaattatttatcacttatatctcaatgacgcgtggacctttatacgtataagatatgtagatccaagtgacaaatagttaattgccacatgcaggagtggtaaacagctaaatatcttatcttaccaaacaaaattaaatatcttatccagtgacccagtgatctaaagaaataaacaatacaacagaaaaaaaaaactttttgagaaatcatattattttgaaacgtgaagccaataataatccacgacaaatcatctagctggtgactgagatgatctct

SEQ ID NO: 55339 - DNA, 1501 bp, Oryza sativa
tacaagaaacatgtttgaccaagctgggttattatacctaataacttgcattatttattgcaaattattatgtgctcactttgaattggacgagctcgttgaaaaaaaaaaactaaagaagacgcaaaactgatagtaaccatcttctggtaataaatgttagtgcatcaaactaatcagatgatcttagcaaactaatcctcatgtttataaaaatatatttttgacgttatttaggaaatgctgtctactgctgtcaaataaatttaaagcttgcctctgatcatacatatctacacagacgctttaatagctggtatgtgcaaaatttggcagatgttcataaattttgctgcaattactgatcatgcatggaagagttttttttttttttttgcggggaatcatgcatggaagagttgacatttacagatggggacagatatgatttctcacaatttttgactccaaaattgggaggaggaggaggaggagaagaaaaggagagaaattgagagaaaaagaaaatcaagaacgagaaagccaccggttttctctccgacgatcgccgccgccgccgccgccgccgctgccgtcgccgtcgtcgtcgtctacacggcgacccgctgcagcaccctcgacgggacggcgaagcgcgcggagaaggagcgcgagaggttctccggctccacccacgccgcgccgtcgtcgaagttctgcgcgtagctgtaggcgtcgtagggcaccctcgccgccgccgccgccgacgacgacgccggaacgcagccggtggcgcagagcaggatccgcttcttgttctcccgcaggatccgccgccacaggcccttcagcctcgtcccgcacccgcgccccgacgacgccgacgccgacgcaggagcccccgcgccgcgggacgccgcgccgggcttcccgtcggcgtggtggacaccgtcgaacaccccggcgccgaggtagccgtactcctcctcgtcgtcgtcgtcgtagtcgcccgcgaggtcgaagccgccgcggacgtagcggcgggacatggagatggagggggcgcaggagcaggaggcctggcgctggaagcgcgggctgtagccgccgccgccgacggcgtccatggcgagagcgatcggagtgtgagagaatgtgagggagaagaagaagaagaagggaggagtggcgtcgcggtcgtgtatttgtaggggggagggtggtttttcctttgctttgttgggaaaaaaaaccatttttgttaaccaaatcaaaggggatttattttatctactaatatttttccctccttgttgagtacataattggagggtattttctcacaccaaaagattttcccttttaaccttagaaatggttcatattccctcacaaatattcttcttttcgattacatggcagacacacgtacactattacacatctcagatcacattaaaatctacatctatgattttatcaaaatatagttaaaaaccca

SEQ ID NO: 55340 - DNA, 1501 bp, Oryza sativa
tagtaatacggagtacatctcacattaagcgattcattctttcttatatatttttcgagtgaaatgctttttttttcacaaatcaagtcgtctaagtgtaaacaagttggaagtaaggtttaaaaaaagcaattgtagttaaagaaagggtatttttcatgttgataaaagataagccttagttttttttttattgcttgaaagacgcacacgtgcacatcacgctcacacactcacaaatgatatatgatgaagaaaaaaaatagaattttgttgtcaaatgtaaaatatactggcaatgtttatcattagttacaagatgcagggatggccgtggggtgattgtgatcgaaatttacgtgcatgggtggcatgattagtgaaatccgggctgcatcatcagctcacgtgctgtgatagctggctactagctgcttgcatataatggcaaccgagatgcatggtgataaactcataataattgctggggcaaggaatattagctagctaaagtgcacctgttttgtaatctgagcttattattaagaacagtattatccgttgcatatgcatgttgacaggggtggagccagcttgtattattttatcctagttctctaaaattcaagaaaaaatatgaaatttatatggaaacttattgtcctacacataagactcgaggcctagctaccctaggcatggagccgtcactacatatatcttgacataacatctaatgtgtgcctaacattatatatcttcggacacagaatgaatatcgcgcaatgtgtcaaactgcaatgtgtatttgcactatgcttgaaactaagtgcgggagaaaaaaaaattctaaatttgcaacagattagttatttgtcgaatgactgcatgatattatatatttaattgagggtaacaaaatattttataataaacttaattagtagtttaaaacaaaatgtctaagcaatataataaatgaaagttcgtcaagaaaacatatttttaaatgaaaataaataatccacactaataatcatataagtttctgaaaataattgaattgggtgattaagcctagcggaaaaactagcccccgggtagggcaggcaaccgtccgaagttcgcgcgctgctagtgtttttattgtagattgttgaaggcttggtttagttcctaactttttcttcaaacttctaacttttccatcacattaaaacttgtctacacacataaacttctaacttttccgtcacatcaatcgttccaattttaattaaatttttaattttggcgtgaactaaacacaccctaagaaaaaattgatcaaccaccgaaaaatacttttaatcgctcacgatttacgaaactgctggctctgccactggttgagctaacatataaacatatggaagtaagagcaagtttaatagtatagcccactactaactccaaatcatctatagccaatgtaatagccaattcatacaatagttgcttg

SEQ ID NO: 55341 - DNA, 1501 bp, Oryza sativa
aggcagcaaaactatcaccacgataaaacatggaaggcggatgaaagtttccatgcatactggttttgaaatctaagatgtccttggcatagaacaaatagattaccccaacctcatctacgacagcaagaacaagagaatatgatgccaaaactaacctcttaaacattcttcttgcatgattcccaatatagatattttctccatcagaagtttttacggtgggggtgatgctccccataggaatatctatatctgttctgcaccgttcaagaacactaaaggaggcggcaatgttacaagttctcacattccaaatgacaacaaaccctcccgagttaaggcatgcaagaaaatcatctgacaattggaaatcaacccattgttgattaggaacagcaccatcatatacattctgaaggtctgccacaaagttccactgtataccccactgatttagctcaataacaacaaccaaaatatccttcatgttgcgttgatggacctcacagctcactggttcattacgaattaagaccaagccaatcaaataacctgaagaactaggcaaaaccttcaaacattcccactggcagttgcaggatgtttcagttgtaggaacatgaccaagaaaaccttgttgggatttagtatcgttttgcatccaggtctttgaaggataattgctagaccagaacttaataaaagatagagtaatgtcgtatatgctaaacgataccacctctgctgaatgcggaagtgaagattttagaggaaatttggcttggtattttccatcagaaacagatccactgattgtagtcagaaaagaacgaaaactgttctttgtacctgcctcatcatcctccggaactgaacactgagtaggacgccactctttccactccccatgcaaatctccagtgtccaatttagaattgtctgttagtgtgcttttgtaagaatgacaaaacccatgaagtgtgatagaatcatcatcagatacaacaagaacttcattaaaaattgaatcctcaagttggctagaggcattataacattgcccccatgctaaagacttcactctaggaatagaagagaagcaatcaaagacgactggactacagctatctgagagggaaggtgattcaacttgtgattgatcaacattggtcattgacaagataagatcccctggattataaaaccagaatcagtacggaaacaacaatatagtaagttagcagagcaatgaagggctccaacagggatggcagtggcagagaacagtgaagcagtaaaacctcaccatggtccgagagcagcccaaataggcgccgtgtaggagatataaaagcttctcgaaatttcgatagttcaagatgcggttgggagcttttccatctatataactgtagcacagcgggcccatcatctacttcacgagatgtagacattgttggtaggcacccgttcacctgctaatggtaccaagcaacat

SEQ ID NO: 55342 - DNA, 1501 bp, Oryza sativa
acacccatgacttttccaatcgattggcaatcatcctcatttttcttctactttcttgattgtcaaaactaatactgcagggtagtattagtaatggataatctggtgtatcgtatcatacagtattaattagcgtcgagattgtgtcaacgtaacgacgatcgagcaaattaagtctcacaaatacatctggttatgagacaacttaatttgatcgcaacctgtacgtatatgtgtaagctgttacttcttccgttcaaaaaaaacccaatcaaacattgaatgtgccactttttactacaacgaatctggacatatagaagtatattagtaggttcatgcgaacaattgtaggtattatatgtgggtgttgatatgcagtagagagactttagacggttgaggccaacatataattaagcatgcaagttcttatgtagagctgcgagaggatgaaagtataagcgtggtgatatatgctactccgttccataaaactcaacccttagctacgaatttggacatatatgtgtccaggttcatagttagtattagacttttttttagatggaggggtatgttcttatttcgaatgctgattttttttcatgttttgcttgaaaattctaggaaaaaacaattatgatattgccttaaagtgaatatatattggatgtgtgatatatctgctttttgttggctgtgggagctgatggagaatctttactgttgggtaaagggccatgagatgatgaaaaggtggatttgagctttgcaaagggcccaagatttttgtaccctgtaattattaccacatctttctcaatatctatgccccttaggtttgagatgaggaatgatgctaccagctgggtagcctggaatattatctccatggcctagctagttggtgtgtcagcagggtcaggccatgattgagaattttccaatatctgtctctccttgtactttaacataccaattcctagaatacttgtaatctctctttcacctggaaatccgactacataaaaactatactccatatttgtagagtgtaggtagaatagagtagcacgagcagtaccgggtagaaaggtatatctaagctttaggacgtgcgtagatctactagctagcaaaagcatccgttgccataacgctaaacagaactacttggagtatgttatactccgtactaaaaagttgtttggatgtcatccgaacatgtatttactagctaggctactagcgacgcgtattagttagtccctaattcaatactactccgtattactatactatattttgatctgtgcgttgtgttgcaagaaaaggcaagattaatcaaaatcgattttcttgttgataagtgataaccttaaagcaaatttacacactcctacgcatatacacacacacgtactgaagtatatatgtggttaactgtgtgtgtgattgtggatatatatttgcatatatatatatatatatatgcagg

SEQ ID NO: 55343 - DNA, 1501 bp, Oryza sativa
agaaaaatatgtcaaactctttcttcaattgtttgtggaacatgtattgatcactggatcaaattacctaatacttcatctacaaggcgcttttcttttgatggatagcaactttgaattagctgcaagcatgcaagaaaaagaatgcaaaagttaacacactggagaaagattttatcacagaagatactaaacatgcttagagatacagtacctgagctatatcttcagggaattgctcactgtcagctgtaaactggccaaagtactcaacataggccagaatttgtgccttcagagaggagacgcaaccaagtttcccattgaggcaagtatgttcaacatatagaatttctaacaagaatcaaataggaataatgttacctgtttttgttgtgaatcctgtggtgggggccagaacagtgatgagaactggagcccatcaatccacttctcatttgaagctgacatacttggtagctcaagagcctgcccaagaaactgagagaattctcaaagagaaagaaagaaactacacaaactgctccagttagcaataaaagcacctgtaatcaacaccacgttgaagccgccagttagttcatccatttatgccaccaaagtccaaatcttcttataagctacttgccttggtatcaagaaacttcgagcaagaaagttataagagtgctatccacttcattcaatcaacccccataacgggggtctgcatctcacaacgtgacacgttatcatatcaaccaatgccaaccatatgagcttcagagtctctacactgtaatatatcgcacaacaaaaaccaaaaaaggaggaaaatacatgaattttaattaatgcaaaaaaaaatttactccctccgtttcatattataagccgtttgacttttttcttactgaaatttcttccaagtttgactaagtttatagaaaaatatagaagtattttcaacacaaaaaaaacatattatcaaaatatattcaatgttagatttgatgaaaccaatttaatattttagatattgctaaattttactataaactttgtcaaacttaacaaagtctgactaggaaaaaagtcaaacgacttaaaatatgaaacggagggagtagaaaaaaactgacaaatgaaaagagagggaggtaatgcaacgaaaattgcataatcttacaagcgcattattttattgtcaagtacaactaaattcataatcaaacgaaaaaatatatctaggaaaaaggtggaagctttctcgtttttaattatcgaaatgaaaaggtacatgttgcaatcatttataaggtaaagtttaccataacatttagttatggtgcaagctcacatgtcgataaatatgttaaggaaggcatcatagaaataggcaaatttatggtaatgctaatggatgtggtgtacagaaccattcacttggttcctcgtaggctcctatggcttatcacacaaaatcaatagatgtgttttt

SEQ ID NO: 55344 - DNA, 1501 bp, Oryza sativa
ttaggtaacattaggtggttttacaactctagactttgggatattctcatcacctggacactatggaattgttggattattgtggaattggattcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtgatggtatgtggcatgtggttacacgtgaggaagatgtgtcttgtgggtaaagttgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccccataatatgggtgtgtcttgttgagtacggtggttgtactcagtcttgctcaatttttcccaaacccagaagaggagcccctggatgttgaaggctttggtgtctagctcgtgcctgccatcaagcgcctgtggtcgtcgccctagtcttccgctgtttcccgtttgtctttgtgtgtgctgggccttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaacacctcagcttaggaggtataaccactagcaactgcattgttatttgtgataccatcacaaaaactctaataatacctagtacctatatgatatcagataaaacccagtacaatggtacctatgaatcagagttggtatcattttttttatttaggcaggtatcaacataagtgcctacaagtatcaacacctcagcttaggaggtatcaccactagcaactacattgctatttgtgataccatcacaaaaactctaatgat

SEQ ID NO: 55345 - DNA, 1501 bp, Oryza sativa
aatcgaagatgaggattgtcgtggaaacagaatgagtatcggctggagtctagatcggctacggttaggatcggctaagtctgagtcagattgggttaagtgattcagccgattccgacaatacgacttgtatacgacattgggttcaaattaatgtacttcaatatgattgccacgcacggatagagtcctggaaaggcaattgtatctattaattaggatattttatgtaaattccttatagataaatgtgggcaaaagtcttccgcaaagacttatgatatcttagagtttgttagagataacagtcgtgtccggtatgggcatatcttgtaattcttgggtataaatagaccccgagacctatgtaatttttaacacacacgttcaatacaattttggcgcatcgccaccttttgctttaattttatttcgacgagttcttgctttcgggttgagctgcatcggtttgatcttcaacaagaggtaaaacttgttatgataacttgcgttctcgggatttgtacttccatctttacgatactgtaatcttgtttatgtgattcgtcgagttatcatatatcttacgtaatctctggcaatatcgtcatctaacctacaatcggctaacatctatcaaggaaggcaaccgattaggttagatttcaatgttgattcagattatataagatatctaccaccctatgaaacatccagcggtttgattgtctagatattgtccttttcatacttaatgctgcatcagttgagtttgatctattaagtcgtgcttagaattacaatctctagcctgccttctggttgccgattagggtagtatcggagtttcagccgatctgatctgatttgacaatatttgctttatatgcttcattgacatgttaaatctgccctttatattaagatcttgtcacatctaagtatattaagcatctgcttgagtattttatctgcttcaatatcttaatataaagcagtatcggagtattagccgatacatgctagatctatttgatcagccatgctacaaacatatatataatctcgttattaatatatattttgatttaagtgatttatactgtctcggtatggtgaccgatctactccaatcacttgatttaagtgtatattgatataaagattatatattattgatatctacagccgatctagtagatttggtgttttgttacttattgatgatcgccgatcgattcacatacgacatcggctcagagataaatgatatgtcattggcaaacagccgatcggctatcatttatagatttaactacggtttgtttgtctttgtttcttgttgattgtaggatcaaatcaactggcacgcttatacattcgaaggcgagctttggacctgcactggagttaagcagatctcccaggtctcgtgttttctgtcaacacgcttttggcacgcccggtaggacactcaagaagtcagacaacctctccctca

SEQ ID NO: 55346 - DNA, 1144 bp, Oryza sativa
aaaagtcaacggtgtcaaacatttcgaaacggagggagtatcaattaaaggttttctattgtttcatcaataatcaccatttgtatcacaatcctctgtccagaatttaagaaaggtttaaaaaatatgtatggccatttttggaaagaccatatttgaaagagaaaccagcaatccgttgcaacacatgatacacatctttggcgacaccaatttctcatagtatgccatagtatgccaaaagaaaatccaaatctcattctgttggacatacctggtccaaatcgaatttctagaaactaatctagccaacaatgagcatttgtttcttttgcaaggaccgctgaacaacttacagaaagggcatatcaaccattaaagtatccaagtaagaattgttttagactgagagagctttgatagccacccatcaaaggttcaaggcacttttatgaattaagaaggcatgaaacttataaaacaagatgcacatctatattacatccaaaccaaggtctctaaaatactactacgtagttattagccaatgcatatccacaaggaaaaaataacgtgaacagtgatttgacaaactgatatttgcactcaaatatgatagacaaggttcagcaaaagatattattaaaccctgatcaatctagtttgtgaaattatctgaattctgaagcgctttacgcaaggagcagatcaatgatgatatatgccatattcaagtcactacttacagtgcttctcccctacttacatactcacacagaactcaacacttgttgaacactgcagagatcacaattcatgtttcacaattctgaacattaccgatcgatttgacactcttgccggaaccatcatatagtttgtacttcctccgtttcacaatataagttattttagcattttccacattaatattaatattaatgaatctagatagatatatatgtctagattcattagcatcaatatgaatatggaaaatgctagaatgacttagattgtgaaacggagggagtagaagtgatattagcaaatatagacaagcacggtataattaagctagcacatcaaatggtttggtctaagagattttaccatgtcccagcaacagagcagcacctcgcca

SEQ ID NO: 55347 - DNA, 1501 bp, Oryza sativa
ccaggatccgggatgtatacaataataatcgcaaatgtagtacaaaaataaataatctcgctggtcttctcttccttcgccgactgatcgaagcgccgccgcctcctaagccaccgccgccgtctcctccagtccctccgcctctgatatcctcccttacagatggggccagccgcttggtggagctgaagcccaatcacatgaatgtattccttctgaccctttccttttttttctttttcaaaatttgatatcgtacatctaaaatgttgtccacctcttaaaccaaaacggtttattataaaatataaattaatttatacgtaaaacttttatatatttattaagaaagatttgggaaataccatcacaaatatacatgagttgcaagataccattatacgtgacaatgatatgtggggcttcaatgacacatacgatgatttttccaatttcgtgattggccctatttattcttagcaagttaaaagtcaaatataaaaaaactacgttgaaaatatatttaaattaatttcaaattaagattaaaaattcaaatttgcttttgctcattaggcctaccgatggagccatgaaattttggttatttgctggtggacatttatcccattaaaacgagctatggaatcgtctcgtttctcccgaccagttggattgcttctgcctcatcccttcttgtcgtccacgccgccatctccttggtcatccgcaacaacgaggagctcgagaagctgctgtctgggggtgaccatcgcccatggcggagtgctgcccaacatcaacctggtgctcctcccaaagagggccgcggagaaggccaacaaggaggccaagtcgccaaagaagaaccccgccaccgccaagtcccccaagaaggccgtcgccgccgccgagtagagtagagtagagtagagtagagtagagtagagtctgaatcgggtttcttcttcttctgctgtatgtaatgctgccgttagatctgatagtggtggggtggtattggtcctagctttgtactccttgcattccttggctaatggaagttccttccttacttttgctcccacatctgtcttgttcttggaaacgcattccgtgttctatttctgcaaaacgggattcttatgtgcttgcttgctacgtccggagtccctggactagcagtaacactgtgcttgagattgttggattggacaatttattaacagtctctgtccgagtccaaaatatgtggatttcacagggttccgattgtcaaaaacgacccgcttctcaaatcagtatttgattcggggatagatctagggtttaaagccaatgctgaataggagaccaaagctggtgccttacgcggcgactcccttcgggattctgtcccatccttcatctactgcccgtgcccgtgcctcttcctcctcctgccgctccaaactcttcattggcggtgcaaatttcctgcctacctgcttcgaattcgata

SEQ ID NO: 55348 - DNA, 1501 bp, Oryza sativa
taacaaaggatggcataatatggtcttatttgcataaacaacatttaataagcatttgagagaatagtaaaacagttgcgtaattaagcaatattaagtaaacactatacaacactcccgtattgcataggcccaaccattctgaacaaccaatcccggctgcacagttctatctccaaaccaggaatataccattccaaaccaggagctaaacaaattattatcatcatcatttattatggtgagagatatgaaactaatcacgaaagacattgttagacccgcccataaccgcgggcacggctattcgaatagttttactctggccagagatgtacaactgtacccacaagacacaacctcaacatcatgtcaaccatgcgtcgcgatacttaacaagtacccgaatagagattgtgacaataccccctgcataacacaattcaaagtagtgcaccgttcccggatcataatcacccccttgtaaataaaggcatggactccccagcgacccccgtgggtttatctccgccacttcacagtctggtgctctacaatgaaccatactatatagaaagtaaagtcgttgcccacgctggcttgtggttggcacgattaatgtttcacaaccgaaaatcgtgaaccggtgcttaattgtcatgagcacgaccatcaaaaccatgtgctcacaacccaccattattaggttttagttggcacattaattaattaaccaatcatgattaaccatcgtgaactataattaagccatcattaaataatagtgaatcataagttattccatttatgtgagctagtgtctctaagcatggctaagcatcctaatgacttttgctaaaaccatataatgttctagctaatccaattattaaccaaacgacaaagaatagataatcaatatcaaaagggctataacaaggcaataggttattcccacccaatgacattcagaaataaatgcaatagttgaatagaaaccatagctttaaacgggatcaacatgctcaaagggttatttgggatctgtgtgacttgccttgctggccttggaactcttcaaagtcttctcctgcaaaatcggactctccgggaacatcggaatctaagcataaaagagcaaaatcaccaaaacagcacataaaaaatcatgaatagtacatgtggatatttttaacatgtagatctcaattttagaaaaaattagagacttaaaccaactaaatccgagctaagatgaattagttatgaatttttaaagattgaaccggattaaaacacttatttagattttaattgaatcatgacgcaataaagaattatttttgaaaagaaaaaatgatttattgcgtcagcggctcgggttcatggtggaccgggtgcacgggaacggtctacgaaacgaatggccgagatggatctaatgcaaaacggatggccgagatcgaatcggtctaccgcgggtctatggggacatcgacgg

SEQ ID NO: 55349 - DNA, 1501 bp, Oryza sativa
ttatggaacccacaagctttaaattattcatttctctcttggttctctgatgtctattggctagagaagactagaagttgaagtttaagctaattgttatgcacaaattgttaagataacattgttttgatttttttcatgtcagcttgctaattgtcaaaatgtttgttgtatggcggttgcatattttgagcatttggttcaatgcctaccggagagaacagagctctgcatttggtaaaatagtttcctttcctgatgcatgtcggatattcggtttgatcatttcacttccttccacagaaaatgtttgcaatactgtcactagtgccctattttaataagtttccgaacacatctccaccacgccaccgtcctcgcagccccctctgtataaatcagtgctttaagtgtccatctccatagtttcttatcagtagaactgcagaattacattgacattatatatatatatatatatatatatatatatatatatatatatatatatatatatatatatatatatatatatattcatgcgccatattggaaatcttgtttcatggctaatattagtgttcttacttttctgaaccgataaatttcaggttgaaaggtgaaattaaacaaacattgtctattcatcacatcatatgtgtctagctaactgctaaggtacatatagtcgctactcttgctgatatgcgcatgttcactggcacgccagtctattcggtttgccgccggctgcgatgaacaagagctggattaatcttgcaaaaaagttctttttttcaactgtatatctgttcagatttttccgaattgcattaatatactccctatgaatctttatattaaacgctgcaatccttgttataaatctacaatttttcctaattgcaggatgtgctaccatgatcattcgtatggcatgtcactgactcactgtcacttaacctgttgataactgtacatgctattttggtagctcaagttatggtggaatatttataatcattttataaactctgatggtaaattggtacgacttcactccataagttttgtttctctatgcattatgaaaatgacacctttgtgatttgttaatggaatgcgggatagtatatctgtttagtttaagatatttagtgttttcgtggatgtatattgaccacatattcggttaatatttcttaatttgggtgcacggtgaatcagaccatataggctcagttggatctgttgagataaggttgcgttcttttggtgagtttgaagaaagatttttcgcgcacgtaaagcaagaaagctcattagcacataattaattaagaattaactattataaactttaaaatagatttatttgatttttcaaatatcttctatataatttttttaaaaaaaactcgccatttagtagtttgaattgtgtgctaacggaaaacattgaagttaaagtttggagtcgaagacaaacatatcaataaga

SEQ ID NO: 55350 - DNA, 573 bp, Oryza sativa
cccaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatactctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 55351 - DNA, 905 bp, Oryza sativa
cggtgtcaaacattttgaaacggagggagtatttgtttatgcatgtagaaaaataagaaccatcttataaagtagtcagatcaactattacacatcaacatggtaatagtgaacaaattactcttgattgagacttggaacttttataactaaaggctactcctgtttgtaataataaaatttaaataaatctggacctcaaaatagtaaaatattttttaagtaggaaatgaactttttaacatggatttcatgtgcatatttcctaaacatcgccgtagtgttagcacgggtaaattatgcttgagaggtggcttcaagagaggtttgactaattttactattaaatattgccatattctgatgcttgagaggtggcctggtgaaaaatttgggtcccacccctattttattagagtgtaatttcagggtcttagtatgcttatggaacccacaagctttaaattattcatttctctcttggttctctgatgtctattggctagagaagactagaagttgaagtttaagctaattgttatgcacaaattgttaagataacattgttttgatttttttcatgtcagcttgctaattgtcaaaatgtttgttgtatggcggttgcatattttgagcatttggttcaatgcctaccggagagaacagagctctgcatttggtaaaatagtttcctttcctgatgcatgtcggatattcggtttgatcatttcacttccttccacagaaaatgtttgcaatactgtcactagtgccctattttaataagtttccgaacacatctccaccacgccaccgtcctcgcagccccctctgtataaatcagtgctttaagtgtccatctccatagtttcttatcagtagaactgcagaattacattgacatt

SEQ ID NO: 55352 - DNA, 1501 bp, Oryza sativa
atttggtaatgttccgaatttgtcatgtaccgtctccgagtaagtttcgcactccgccattattgaccgttattccagcgctttaaatactaaccgttcccctcgagaaatctcacgccgtgacttccgttttcaccgctcaagcaaaacttcttcctctctcttctccggcgattcctccggcgcaaaggcgatttccaggcgacttcctccccgacgagatttccgcccgcagcgatgtcgtcttccgccggcccatctgatgcgccatcagccgagtacgctgaggtaagttctcatcggctaaatcccttttcccaagagtagattgattttctcttgtctcctattgttctcttcttctcggtcgctttggatttgtagcacctctccaacctagttgcgattcctagcttatcgcatgaaaaccactactttctcggcccaatcggcaatcctgatccaaccgagttcattatctgtgaaaccaataggattccgttaagattaaccaatccagatccaggtcactggaaaaacacctttaaatcttggccgtctctagaaaaaacttccctcgagaaaagttggactacatggttcatgcgtatgtcggctagcaaaagagttcactgggacgaaattggaatcagccaagaacttgacctaaccatagcaaactcagccaaggatgaacctctcatggcagctgcctcttatttctggtccaacactatcaatgccttcttattcaaccaagggccgatgaccccaactctcctagatatcgtcatgatcacgggtctggatatcacctcatcggctaaccctatgagcttgaacataaagaaccaatatgacttcaagaccaagagcataggcggctggtcaagttatgtagcagtatatatgggccaaggttcggtcaccccccgagaacatgtggctttcttgttaatgtggctagagaaattcctcttttgtggatcaagctgtggccctacaaccaactggcagtttatagctgaagctctagaaacaaagagacaatttctcttgggtaaaatcctcctcggctatttataccagatgctgaacaatgcatcggctaagatagctgtcggcgcagtagttggagcaggctgaccatggttgctccaaacttggctaaatttgatagtcatgaaagttgtcaatcggccaaccgtgtcagaatccgagttaccaagactgtcacaccttaaaaatcccaaatgtataaattgttgtttaaatggaattattagaaataattttaaaagccttgaagcaaagatctaattttaaataagaaattccaatataaaagtgggctagataaaattttataaaatacttcgattgattctatagttcctagatttttttgggatttatttgagccaaggaagtatttttaataaatggaattgcatttcatgaataatttaaatggaaaaaggttttaaaatacctcttttgg

SEQ ID NO: 55353 - DNA, 275 bp, Oryza sativa
cgtcaaacatttagggatggagggagtatatttttatgtatacatataattttacatatttcataaaagcaaatatatttaaaaaagttaacagcgtcaaatatttagagacggagggagtagtagctatcagtatcaggtgatttaattacatcatgggcgatcgagttggaattaatattttgcaatcgatctctcctctatcgagcgaattcatcttcaacaattaatattgatgaatattgctccagtcttctgaatatcaacgttaagcc

SEQ ID NO: 55354 - DNA, 1265 bp, Oryza sativa
gaaagggaggggagagaaagggaagaggggagagtggagccgccacgtcatcccctcctcattctaccacgtgccgctgccaccgccaccctccttttacgacgcctgtcgccacaaacgttgatctcctccactctaaccaaatctaggagaccgatgggaggggactggagcctctgctatcgcccctccttctccctaccgttgaacgatgcaagacaccaccaatctggggcgctgccaaccacgcctccagccagttgcgaggaaaaggagggatgggaggggatagaacaggaggggacggcagtggagcatccgccaccgcctctcctctctatcgtcaggtgctgcagacctacctccagctagatttggaggggaggagcccccatcaccaccatgctgccctgctgcagtagtggaggagagggaaggggaggggaaccggtggtggaggcatggtgaaggaggagactaccaagacttagtcgctgcgagctccgctggatcgatcgggtcctgattttagtaacgcccccacactataaccccactttctagacagacgactttagaccccgccagcaaaaattaatttttataggcacggtctaaagagtttccacctgcgaaaatatgaggtattttcataggcaaacctcttcaaacctcgcctgtaaaagtcaatttttcataggtggagccaaagatatgaggcctcttggtattttcaaacggtaaaagtgaaaatattttgtctgcttgaaaaaataaaacacagtgttaggaaaatgctttatatattggccgatcggccttatggtctaatatatttattttcattttgttagttacaaaatcaaactaactagcataacatgaacctaattgataggacctatactagagctaaatatatctttcgaggcttcgtgtgtcacaacaaaaacaaatccacatccaaatatgtaaaatgaaaaatacaggcaagacaaattttcataagatggaacatagtggcaaactgtggctagaccttatgccatgggggatggcatcgttgggtgactcagggatcggtgctggttgtcaaggagtgttggtggctaggggtcaattaatgctaaggtggcacatgccaacagggtcatgtgaagactagggctcaggaagcagtgatgtgcagacaatcactagcgacgagtgttagggttacggataaggtataccctctacccttggatgtatgttgtataccgata

SEQ ID NO: 55355 - DNA, 608 bp, Oryza sativa
gcttaatttattctataccttaaaaaatatgtacgtgttacctccatattttaatataatatagatgtttagaataaactaattaggtaaaaaccaaattagctcctttggatgggaggattttcaaaagaaaaatgaaggatttgtatccttaggattttttttcctatggagtttatttggtttgtacgatttgggcttgcaaaattcctgtatatggaatcattcctatatctcagttcttttcaaaagaatttagggtttctttgaagaaacacgaattttgaaaacactggccgaggtaagaaaaaaaaggatgggagtgccgtcacatctcagatcttatggatagaaaaaacacagaaaaactataggaatgactatttggatggaacacaggaaaacacacaagaattagaagagagatagacacatatgagtttttccaagaggtttaatctcatgttggaaatcctccaaaattcatatgaattgaggcaattctaaggaatttcaaaggaatttaggagagccatttcttcattccaaaggaccccttttataggaatatatctaattaatccttcaaaattcctttgttccaaagg

SEQ ID NO: 55356 - DNA, 1450 bp, Oryza sativa
acctaacttaaaatgtatagctcaagacaacggttagtccacaattagcgcttgtcattaattaccaaaattaacaccgggggcctagatgcttcaacgccgtgctaggtcgtcgagttcgatgttgtccttgcgatatacgtgtcgaacttcgatcccgtcaaaccttttctcctgcaaggtacttggataactcggggctagagcacttgtagtctttgtgcacctggtttacgactagttcggaatctcctttcacgattagtcgcttgactcctagtgcggctgctgctcttatcccagcgagtagtccttcgtactcggctgtgttgttggtcgccttcaagttgaggtgaattgcatgcttgaactggtctcccgaaggtgatgtcaagatgaacccttcccctgctccttggctgtagagtgcaccgtcgaacgccattgtccatgtttcgctgtcggtttgactgtccagcctgttttcaggcatagtccagtcagctacgaaattggcgaggacctgggacttgatggttgttcgtggtacaaagtggacatcaaactagcttagctcgactacccatttcgcgatgcggccgacaatgtctttatttctcacgacttcactaagagggatggagaaaacaactatgaccctgtgggcttggaagtagtggcgtagctttcttgatgtcatgattactgcgtaaagcagcttttggatctgtgtgtatcttgtctttgcattgtggagagcttcgctgacttaataaactggcctttgcaccttctctctcgacaacaatgatggtactcacagaatatggcgtggcagcgatatagaggaataattcttcattaggttggggagcaacaagtatagggggatttgacaggtagcgcttgagtgcgatgaacgcctcttcggcttcctgtgtccatacaaatttatcttgtttcttcagcagagcgaagaaaggttgtccacgctctcccatcctagcgacgaactgtcacgcccggaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcctctcaaacaataaagatctaagcagtggaaaaataagataaacggtgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttaacaaacatttgagaatttaataaaaca

SEQ ID NO: 55357 - DNA, 1501 bp, Oryza sativa
cggcccacctaatccatctactactagtactccatcggtagaaagtcgtttataacaatttttaagtcaaagattagaaatataaatcattaataactctcaagttgttagttgttgagtttaaaaatgtaaataattatatgaatagatttattttaaaaaataatttcataaaagtatacatatatcacttttcaataaatattttttatagaaacaagaagttaaaattttgttttggagactgtgtcactatccaaaaccactttctttacgagtacggagggagtactcaataattcccgtttatactatccaccctctaatttaatttaacgaacttgcatatactacttactacatactccctccgtacttgtaaaggaagtcgtttagtacaatgttcaagtcaaacattaggaatataaatcataaataactctcaagttgttgagtttgaaaatgtaaaacttatatgaatagatttatcttgaaaactactttcataaaagtatacatatatcacttttcaataaatatttttatagaaatataaagtcaaagttgtgttttggagaccgtgtcgctgtcctaaacgacttcctttacgagtacggagggagtactactcccttcatatacttttgatagtcatatttcatcttagcacacagaccaaggataaataattctacttatcatccatttaaatatgctagtactagttattcctcgtaaacaagcatgctagtactagttattcctcgtaaacaaacgattcattaatatttacatttctcgatgtccatgtagtcaattttgtgtgaaagaatggagagttgcccgttaaatctaagaaagtcattaagataatagtttgttggattgaaatatgcctatcaaaaataaatttttcagatttagaaatatacttatcaaaagtagatggagggagtattattgcttccaaaataaagtactcctacctaaaaaattgacagctaagctaatggttaatgtgagtaaaaagagaagcgcagatgtgatgggattgaatcccatgaatccaaccaacggccaggatggcagcagtggatagcggagcggaggagcaaacgccaaatcgaaacggtataaaccgcttcccgccgctgctctgcgggcccacctgtcagctataaataagaaaaagaaaaccaaccgacaatccgccgcgatgcgctggcgttgccttgcccattctttcttccttccccataacatactagtaattccttttcgcgagatctcgtcaatttctcgtcccccaccccgctgagccatcatttctctcaaatttctcctcctccaatccaaggccccaaggaattgaaggatgatgctgctcgccaaggagttgggcctgtcgccgccggcagcggtcactcctcgccggaggccgccgcctgccagggtccccgcctctccctccggtggctcgcccgtggccgtcggagacctc

SEQ ID NO: 55358 - DNA, 522 bp, Oryza sativa
cacttctgtcaattttcaaaataaaaaattatttttgtaaaacttttaataaaaaaaattaaaaataaaaaaagtttgcgaccattcggtggcctcgaatatctcgtgggctttgtttccttggcccactaaccaaaccacggcccactaggagagcccaccaatgcattccacaacaaccatgaccgcctcctacctccgcctcctgcgccgcttccctcgccggagcgccgccggcggccaccagctccacgcgctgctcgccaagctcggcctgctccaccgctctgaatttctctccgctctcctctctcgcctcccgccttcgccgtcggcgctctccctcctactcgaggcacccccggccgtcctctcgccgtcactcgtctgcccggtaatcgtcgccttctcttcctcccaggccccgtcctccgcgctcctcctcttcaatcatgcctcctcgtgctccctccccaccccgcttcccaccttccctgcgctactcaaatcctgcgcccgcgc

SEQ ID NO: 55359 - DNA, 1501 bp, Oryza sativa
  unsure (1)..(1501): unsure at all n locations
ttaggatccttctcgggcttggatgtcgtcgatgtgtaacatacctgaattctaggattaaggaatttccatcaaaactagttgaaagggaagttcttcaattttgtaaaccaaaaatttccattttaaacctaggtgaagttgatctaactcttgcatgataaaattttagaacaaattaaaaacctttgcatctctaacctaggacaaaaatataaatttatgtgtaagcatgcatactctcatagacatgtttgacttgagtccttcatatgcaattggatttggattgcattcggattttcgatttgcatatcataataggtctcatgaatattaactaagatctagataaacaactggaccattagggcctagtgctagctagaggaagttaaaataggaaccatacaccttaaaatatatcaacaaggccaatgccaagccccacaaaactattttggtcatccatctgaagactagtcatgaacatggaagtgaccaaataaattatatcatataggatatattctatcttaatcatctctataagcattctcttaatttaatactaaagtaaacttgtgcataataggtaaggagcttatgacctgtgtaaggtaaactgaaattctaacatatcattatcacctcaggttaatgagagtccaaatataacttttataaacatttacatgcatttaggaaaggaaacacatataagacataactcttgagaattatctaaaataattcgtgcaagataaaatcatgggaaaattcatgtaggctctactcaacacatacaactcactgtaattttggtatgatttaataactaaatttgtacctcaaataaatcagtcaaactaataaaaactagattaactgtagttcttaatcggctaaaaccatactttatctaaaagtgcatttaactgcatagaagtgtataagtaaaataatttattcaaatactaggtcatttatcattaataaaaataattttttcagaatttatcttctctgtttagggctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaaattagaggagaaaataattccggaaattcgtccaaaaaccaagctcacccatgtttctgcctacacatctctcttccacctagtttacttcgacctgngccccccttgtcagtccctccggcttgcccttcctctgtgcaacttccctagccgaccgagaaacactgagagggagagatcgagcgccgaccggctctggacgccgcacgacgcgtggccacgacgtgtcgacgccctaaaaacgccgagctccatttctgcctctcccagacgcgtcgccactcttcacc

SEQ ID NO: 55360 - DNA, 1501 bp, Oryza sativa
acgtaggctatgacggcggcgcggcggtcctcggagggcgggttgggctggatccgggcgacgacggctccggcggcggcctcgaggggatcccaggcctcctgcgagatggatgaggggtcggggttggacggcgtgggcacgggctcgagcgccggcgagcagccctggttgtcaaccatgggcgtcgccgtgggagcccggtccaacgccccgagttgcctcctccctccctccctccctcctccggagacgtggagcaaccgccgctagaagagggattaaggtgatgcaggaggcggcggaagaggtgcccaccggcggaggcgatcggtggcgatctgggcgccgccggcgatgggcgcgggtgggtggggtacggattacggggttgggattttaataataagagaatacaagggggggaaaagaaaagaaaagaaaaggaaaggtggaattttctccccttgttcgcgcacgcctcctccgatgagtcactctacgatgattgatgcgcgtgctcgtgctcgtgctcgtctccgatgatggattattattgtattttgctcggctcctcggcggcggcaggaagacgaagacgaagaggagaagaagacgctgtctctgcctgcggcttcaagccacggttcctcctttccccctgcgaccattcgaattttttttatttttaattttttttattaaaagttttacaaaaataattttccattttgaaaatcgcctaccgaaaatcgccctcccagagggcggcgaaaatgatgtggcagacggccgttcgctctcgggcgacggccgtcaacgaaatttgcaggcggcccccttgccgccctccgctagggcgattttatactgtgcgggaggccgcctgcaaatgggcggcgagggggcattgaattttgcaggcggcctccttgccgccctccgctaggtcgattttgtactgtgcgggggccgcctgcaaatgggcggcgagggggcatggaattttgcaggcggcccccttgccgccctgggggagggcgatttttgcctccccctataaaccccattcccccctctctgaaacttcattatattcactaaaaatccaaaaaaaacgaaagagagagaggggagggcagcacaaggggagcggcgaagccctgctggttcgctcacttcatcacaggtttgctcccatacatcttttgcatttgtactaatatgttatgtttgagtatatatgttgcgttttagttttacgttccatatattttatcatatctgtagcacacaccacatatgtgtagatcccgagcatagaatataatagcattaattgagacctacacagtagtgttaattgtaagattgtagtctagtttgatctggagaatgtaacctacttttagaattttggagaacaatattgtagagaatgtaacttagggcgtagtacagaaatgcgagttaacgcagttattgttttcatcaggcacaa

SEQ ID NO: 55361 - DNA, 1501 bp, Oryza sativa
tactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcctttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgtaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaactcgcatttctgtactacgccctaagttacattctctacaatattgttctccaaaattctaaaagtaggttacattctccagatcaaactagactacaatcttacaattaacactactgtgtaggtctcaattaatgctattatattctatgctcgggatctacacatatgtggtgtgtgctacagatatgataaaatatatggaacgtaaaactaaaacgcaacatatatactcaaacataacatattagtacaaatgcaaaagatgtatgggagcaaacctgtgatgaagtgagcgaaccagcagggcttcgccgctccccttgtgctgccctcccctctctctctttcgttttttttggatttttagtgaatataatgaagtttcagagaggggggaatggggtttatagggggaggcaaaaatcgccctcccccagggcggcaagggggccgcctgcaaaattccatgccccctcgccgcccatttgcaggcggcccccgcacagtacaaaatcgacctagcggagggcggcaaggaggccgcctgcaaaattcaatgccccctcgccgcccatttgcaggcggcctcccgcacagtataaaatcgccctagcggagggcggcaagggggccgcctgcaaatttcgttgacggccgtcgcccgagagcgaacggccgtctgccacatcattttcgccgccctctgggagggcgattttcggtaggcgattttcaaaatggaaaattatttttgtaaaacttttaataaaaaaaattaaaaataaaaaaaattcgaatggtcgcagggggaaaggaggaaccgtggcttg

SEQ ID NO: 55362 - DNA, 1501 bp, Oryza sativa
tgccctcacggcgctcctgcctcctctcctcctcccacttcctcgttcgctcagccaaacttttgaccgcgcggcagtccacgaggtcgtggagggaggtgttgtgcacggtgcaccacttgccggtcgggcgctccctgctgggagcgccggcctccttctttttgtcgctcgcaggcctcccctttcgggtggcccgcgaagcgccctcgatggcgaggacgtgaccctcgtcgtcggaatgggccgacctcttcttcctcctcccgtcccgccgccctgaccgagcggcggatccgggggcggctgaagctgccacaccggaaccggtggagttccaggtccatgcctcctccttgcgagccacacggtccgcgagctgaaaaagctccgcagtggtctggggctccttggaggcgatcttctcgagcatgcggttgtgccgcacgccccccctgaacgcgtagatcaccgcgtgtgcagggatacatggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctctcagggccatggggaagaaattcgccatgaccctgtcgtcacccctggcggcctcgatcccagtcatgtagatctggagaaactcggcggggttgacgcttccgtcgtatatttcggtgatggtgggccggaaccttgggggccaacggacgttccgaaggctcgccacaaaggctcgacagccggcaccgccaaccggggacacggggggctggcctccgtgcccggaccgaagtggcgctccggacgaggaagcgccctccgatgcgtgggcagcacggcgatcattgcgccggcgctcgatattgaggcgggcatccggcccctcacgcacatcttcttgggtcggaggcattgacgagggaatggcggacgaacggcgggcaacggccgccgctcgccgcgccctccgcctcgacgatacggagccggcagtagcagcaccagtggccttggtggcggaggaccgcccgccggcgcctaaacgctgctgcgccgtcatgaccaagttggccacgtcatctagccaacgtcgagttggagtctctggatcagggacgacgggcgggtgacgcaggagcgcgcccgcagcctggagcgcgccctggggcgtcgtgccatcaccgtagatgaggagacgacgctccccgtctcgccgtccttctccatcgctcgtggacggcgaagtcgcggatctttcgaccccctcgagcgcctcctcccgcctaagacttcggcgagagggggcggcggagtacgagctcgacgacgcgggttctgctcgctgtcgtcaccgctagcgctc

SEQ ID NO: 55363 - DNA, 1501 bp, Oryza sativa
agaaatttgcgaagtagctgctgatccatctgcccaatcgataggctacaaataaatgaagctggtagctttcattcaataaatatggattccttcaacagtggagtacccattgctctgtttgcccacagatggaattgaagctgcgtgtcaaatgtcaatctttctaaagacctgtcttttaatatgtatgcttgtgaattgtattttgtatatacgccatacataaaaatgatactgccattaagtcattactgttgcaatattctattcacaatgtaaattatctactgttgttatggtgtaatattggagactgtacgtatactttgtttctctcttcgaactcttactgttctgcagggcagaatatgtatacacgttggtttctgaatccatggctgcttgtgcatgtcgtttttatctagattatgggcatgttccactatccttaaccacaaatactcgtagtagctcacactatacataaaccgctgtaatagcatatacatatacttccttcgtcccctaatataagggaccctaatataagggattttgacattttatttgtactgtttgaccactcgtcttattaaactacccatatgaacatcttcgaagactgagctagcaaatccttaagattgacgaagtcaccacaggcgtctcgctgtctaggggtacgtcgcctaccactgaaagcacaataccgataaatcctggaaaattcgctcccgtggagagttgaacccaggacctcaagtgctactgaggctcttgtaaccactaggctacaggccctttcgccttattaaaaaatttgtgcaaatataaaaacaaaaagttaggtttaaagtactttaaataataaagtaaatcacaaataaaataaataataatttcaatttttttgaaaaacacgaatggtcaaacaatataagtaaaatgtcaaaattctagaggacagaaggagtacttatttataaactctctccggatggctggatgcaggtgccatgaatttatcctaaattggggtactgcaaattaaagttggcaagtagtaaatgaaacaactcaacaaccaccaactcatgagatcaaaagtcatatgtacagttaactaaaagcacgcagtgttaattttagctttccaccgccctgcacatgtaactgcacgtgtaaggtatcaactgatgtgtcggacactcggactcggaagtcctcttttctctaggattgaaacactgcgcttcttgaaaaattaccgggaattgaagcacataagcgtgggtgcatgatttcactaattactctctaggatgaaaaccaactccaacttataggtctatcatcgatctccggcttggcccaaaacccctatataaaccctctccctacccctccctcactcacccacaccacactccactccagcatagtactgcgcttagctaattaagcagcaacttaacttgatcttcgtgtgaccgatcga

SEQ ID NO: 55364 - DNA, 274 bp, Oryza sativa
tgcaaaccaagcaatatgtctggcacattggcacatgccaaggtgcttggcgtgggcttcatccttcccgtagcccacatctgactaaacaaggagagggcattcttgctttaaccattttgatcatacccgccgctgatcatcgcaatccaagagatcacgttcttcctcggcatcccctcaaataatgcataaaagcatcgtgggcacgaccgctgctgcagtacacagaaatcgtggcattgcagcatgcgacacaccctcccggcccgca

SEQ ID NO: 55365 - DNA, 1501 bp, Oryza sativa
atagatgatgatagatcatagattgaggttggcagcaatcaactcaactggtacgaagaacatggctggagttctagcttgtctccagtgtccagcagagcaagtcaaacacgcatagcaaacataagattaaacaaaaaatccccaggacaataggtgtcaatacgatgttctaaaatatgtcatctctttgtcattattaatccccatcagtgttgtcacctaactgatcgagccattaacagtggattctgcacgtaatacggcgagctcaaaatcacactgacagatcatagaatgattaattaaccacgatttgtgacaaaattgttgttactcatttcattattggagctaactaatggacttgcaaccaactgattgtgatgccaaactttataacaaaccgttcgaaatgtcagagccacactgaatagcaaaataccatttctactgttgatgtcagagttctttggatttagctccaactaatataattctacgaatcgatatgttatcataaagcaattcaggataatcagttccacagaccaacaaatgtcaacactgccgaccaaacagcgcagaacacgcggaatcaaaaaagaaaaagacaagttctttgaagcaattactaattcatatccagaaacatcagctgtagtattatggaaatgattaggtaggcatcagtgattcagtggtaattgcgcggtgaaagttgcatcaaatactggtatggtcaaaactcaaaagaagtaatgcacacgcgtggcttgggttaggcatagctggctggaaaattttaaaaaatagagcgatttattagcacataactaattaactatcagcaaaaataatttgaaaaataaattactacaatttttaaagttacttttgatagaattttttttaaataatacatcgtttactgtaacgtgcgcgtgaaaacaaagtggtcagtttgataattttctcggatgaagggcctgttcactttgatgaaaaaaaaccttactaatgccaaaattttggtatagttgccgccagaatttttataggatttcttatatagataccaaaatttgacagaaaaataaatgtaaccactttttgacaactttaccaaaatttggtaaggttgaaaatggcatcaaagtgaacaggcgaaatgaggcagccgggaggcaacctgctttgtcggatgcccacatttttcccattgataatattatattctattattctattctattcttgtggtttgcttggcgccatcagatggcaatgcgtttgtttcagagcttaaaaaccaccatgtgctccgttctcttgtcctgcctatctatctaacaaacatatcactgctcaactcacgggtgctcgtgcaagaggcccctccattttcaggcacctagctagctcaggccattgaagaacgcatccaagaaaggtgcgagaaagaacaggagcagagactgatcaagattcagtgattcag

SEQ ID NO: 55366 - DNA, 1501 bp, Oryza sativa
cgccggatggataattcttctcacgtggattccaacaatccatgccacacgagacttggacttcttgctaagaaaaagaaatatagcattccagtaggccataaggaaatattcaagcctaggacggccccaatttcgtctgccaccaccaaccaaaccaaactcctcacgagcgtcgccggcgaggcgaagcagccgtagaaaaacccaagatcagcgagttgcgtccatctctcgccgtctccctcagctgctcagctttgatatgatagctcaagggcgatacgtttagtatggtcgccggcagcaaggagctcgcggcggcgatggccccggtgacccggccgcgctggtcagtgctgccggcgccgcctcgtcgcctccggtggccgcccccgccgcccgccggaatcgccgccgtctgcttcggctaccgacgtactgtaactcacctctcgcctcctctacaactctactagtacttcactgttatacgtggtgatggagagtgcgtacgagtggttaggaacagcttaatatttttcagttttccagctaatctttgtttagatttttcttttccatttgtcttctataattacttttccccgttctggaataattggcagtaacagtaataaaacttaaaactctataaagttataaaaaatactttccatttttccatcttgcttgtctctttttaaaaaatacttaaaattatgtcataattattaaaatatctgatgtcgaaaaatattacaatacggttttcattcatcacaatataattatttaaaagtaatttgtggttaaagtgagatgatcgtaagtattattgcgactattattaacaaccggcggtactataaatcaaattaggacaatgttattcatcacagtaacaattgatcaccccattctctaccatttgtgtagttttcccaaatcgaagttcaattatgcaaacatgcatttgctctgcttatatttataagccaaaatttaaatagaacttagttttgagtttgattttttttctaattgtactttactttacatcatttactaagtacatgtactttttaataaacaattcggataagtatacgagtgagcgcaacaatgcttccataattctaggggatgctttgcttcaaccatttggtcgaagcccaaaagtgagtaatgaaagcttcatttctctacttcccacgtgtcaccctgacgtgcactgctggcagctgacgtggcactcccgtaattatatatattttcccctggaagcttcctgccctgcccctccttttcccacgaatcccgattccgatccgattccgcggcgcactgtcaatcccattcccattcccattcccattccctccccccgaaacgaaaacgaagcaaaaacgtctcaacctctccgcctccgcagatcgcctccgcgccgcgccgccgccgacaatggtcgccgtcgacccgccgccgcgggaggccgcgg

SEQ ID NO: 55367 - DNA, 1501 bp, Oryza sativa
ggcgaaaaaaaaagtgagcccacctagggtttcatggcccaacctaattaggcccaagcccacggcccgaatcgagcgaaatgctggcgccaccgccgccgccgcgaaatccaaacgaaacgcaaaattttcccgcagcccgcacgccccaaattcgaaatttcaaacaaaaattacaaacatttcgcttcccaccgagccaaaatttcgtcagattcttcgctgcgcggctgcgcgcgcgccatctcgctgattcgaccgcgaaattttcagtcatttaaacccccggttcgtttcgatcccaaatcacccgccgcgaacctcctcttcttcttccccgtgtagcaaaatctccggtctcgattccgtccatggagttcgccgtcggcagcgggagcgtgcgtgatctgccgccttccaagcggttcaagtacgtcggcggctccagtctcgggatggcgccgtgcctgccggcgaggaagcggttgtgcccgccgatgctggaggcggcggcggcggcggcggcggccgtccccgtttgcctcccggcgaagaagcgggcttatgcggcggcggcggcggtggaggggggcggtttcgctctgtgcctcccggctaagaagcgcgcctatgcgccaccggtggatgatgccgtcgcgcccgcgtgtctttcggccaagaagcgcattcacgcgccggcgccgccgccgccggatagtggtgcttctccctcagtcccgactacgaagcgcgtcgacactctgccaccggcggcggcggataaggctgctatttctccgagcatcccggtcccggtcaggaagcgtgttcacgcgccgcaaccgccgccggcgccggcgccggagaaggcggcggtttctccgagcatcccggtccctgctaagaagcgcgtcagcgcgacggcggcggcggcggctactgacgcttctccccgcgtcccgttcaaggatctcgtcaacaccctgccgccgccgagagacgccgccgtttctccgagcatcccggccaagaagagcgcccgcgcgccgccgtccccgaaggacaccgccgctccggtctcggtttgcctaccgagcaataagcgcgtgatgccgccgtttctcccgccatcgccgcctccatccaaggagtcggatggagctcgcgtcgccgctgttaaagaagccaagcctcaaggatccaataaacgtggcgccaccaccaattcgagcgtggcaaatggtgtggaagatgattatgcaagagctgaagcatccaagattcaagagaagcccaagattccggagaagcctatcaatcatgaagaaatcaaggagcaagtgtcgaagaaacaaagatcaaacacttgcagagaatcgaaagatcaggaatgcaatcaatcctgcagtgctattagtgcgaagcaatctgaagtcgaagcactcgagaaagcttgcaaagcgattgatctcaacgaagcagcacgggaagaagactcctg

SEQ ID NO: 55368 - DNA, 1501 bp, Oryza sativa
gggtcattcacctgcggggcatcttcatctggccatgaacggggcggttctgcccacaactgaactgtgccatatatatcaacggtgtaaagctgtctcctgtgcttgaagatatccactagatcatgctttgattccactgatgaccagctgttgcttcctttacgcgttaccttatatcctttctggtcacgtaagatgacagcaacagtgaagtttgtgtcattcatgtcaagcaacatggccttggagaaggcccttcgtccgattgggggaagattgaactgcatgccactaatgggattaaccagctgcatggttccatgagatgggctgtaaaagatgagccaaccatgggaagaaccaacaggaatccaggtggagccaaagattgtaacagtgctcgggagacgaatggtttggttcttcctttcaggtacacacaaaaatttagaatcattaagcgcatttgtagggagcatcagccatgggtctatccttggacagttgaatacatccctacagagatggttccaagatgtgcatacagcacggaatctcagatagtcagggacggcaagcttctttacaattacaccaaggatatcagtctgaagaccagcccaatctgccatcccaacggaattagcttctaggcgcctaaagcaaatctgtatgtcagattatcggcatgatcacatcatgcatcaaaacagtaaaaacataaactttctgcagcaagtactcgaaaatgcttaaacaggattatgaagttgcataacctgtattttgcataacatgtgtttctgataggtaaatctaaaaataagtatatgatgcctagtggaaacgtatgagatgccatgttcatttaattctgggatgtggtcaagagaacagaagtaagaaagacaaccaatttcagttatgaaaagcctaatccttatggtcaaatttgtgaagcaagttagatgatgccctacaggccagacgtaaagaagtattgtttgacgaaggcaactttatcaacccatcacaatgttatatcacccaacaattttatctttcttacttcacaagtagagattaaacaaaagcagtgctaaaccatgaatgaaaacatgaatgccctataaccatgctggctggctataaattaaaacacagtttaagtatttcaccaagtgattatgcatgcactgcagtaactctgctaagtgataatagtaccttggaaccttcgcagacatgccacttataagttataagttataaccaattcagatgctgtagataaccaaattcgacgacagaagcattccaatatttcaaaacgtcagcagattgatgaggaaagagcgtgtcctgttgatttgtagagtcagtaaatgcgccaaaaggtcgaaatgattaaataggggaaaggggataacaaattttttttgagcaatccattagtcaaaggatagaaaggaagaaatataggctgccccactgcaca

SEQ ID NO: 55369 - DNA, 1501 bp, Oryza sativa
ggatctgcccggggcgtacgcgttcgtggtggacatgcctgggctcaagtcctccgacatcaaggtgcaggtggaggaggagaggctgctggtgatcagcggggagcggcggcgcggcggcggggaggaggagaaggaggagtcgtgcaagtacctgcggatggagcggcggatgggcaagttcatgcgcaagttcgtgctccccgacaacgccgacgtcgacaagatctccgccgtgtgccaggacggcgtgctcaccgtcaccgtcgagaagctcccgccgccggagcccaagaagcccaagaccatcgaggtcaaggtcgcgtgatgagattccgcatctctctgcatctgcgtcgctgcgtggatcaaagaatcgaagcttgagttgagtgagttgtgactagtagtatgagtagagtgttcatctttatcgtttgctacgtgagaatgtgaggacatggtggtctgtatgccgtatgcgatgtgatgatgatggatggtttgatgtttggtaatggaaatggggatgttctgctgcttatctgaataaatatactctgcatcttttgaaatctcttgtctcgcctgcaaattatgcgttgttcgtttaatcccttcaaatttcccttaaatcctcgttctaagccgagttccgagtttttgggccgagagattaaacgaacaggcaagttattctgtatttttggatctgcgtttgtggatatgcaaatgttcttgagtgagctggggtggagcgggcagtagactagtagtacgtgtgagatcgttttgccatggtctgtatgcataagcagtgtgattgttcctttgatgtttggtaccgaagatgcagatgtcctgttggtctaaataccttttggcactatcaaattttgataattttgttaaggcaaccgaaccaaatactacctccgttccaaaataagtgcagccgtggatatccgtgcccaacgtttaacagtccgtcttatttgaaaaaattgtgaaaaatttgaaaatatttagtcacacataaagtactattcatgttttatcatctaatagcaataaaaatactaatcataaaaaaattttaaaaaattttcaaataagacgaacggtcaaacgttgaacatgaatagtacaaaactacacttattttgggacggagggagtaagaactatgggctggtttggtttgaggtctaaatacggcttaccaatatttgtcaatttcaatagtatttattgtctatttagtttgaagccaaatcttaacatgcctaagaaaataggccttttcttaggccatttcaatagttaacttattttaacttcaatccaaacacaacattgccttcccaaaattagtcatgccacaacttgctaaattttggcattgccaaaaattgaaaaggtcaatttagatctcaaaccaacccaaccctatgtgaacatttgataaggctacacctacacattccaacactacgaaatt

SEQ ID NO: 55370 - DNA, 1501 bp, Oryza sativa
tcacctaaattaattttagaccagtacctattcactgtgcacaaatcatccattttagagtattttggatttttcgcatatttcggtgtttaattgcataacgtgtactttgtatagatgattgcttaaacggtgaagaagtgatttaggtgctgacattttcctgattcaaggcaagtcccacctccatctctttgatcactttgaacctatgttttggaggttattgaaaatgtttgcaaatcttgcatgtcgattgtacactaataaattaaaattttgttaaacttgttagacaaactcctattgtttgcattcaccttgaccccacatatatccatatccctcattcctaaccttaggaacaatatgactataccactttatatatgaattttggagtcactaggttactataatgcttagccatgcttagaatggtcttccttgtcattatgggctcattacaaatatgaaaaattgattttgaaataatctggacagaactttaatacttgtgattttgataaataaaatgatggaaaacatggattttaggtttgagcctcaagtggtgcacatatggtgattagttgtgtaccgatagggggagagtgtgcccaaaccgacctaaggacttcactcaatgtcagttcatttcgtatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacatgtatggcttaggatggagtaacacgtatcgtgctggtgtagggctaaatcatgaattttggaaaagctttgttgcaggtaataaatcgggtacttatgtatcgcgtgacatgctcttgcatgattattatttcgtatcatgtgggtaaagtgtacaaactctgcagagttaaaactaatcgattagccgtgctcgcggtcatgagcggcgtgtggatatgtattgagtatagacttgtgtttattcttctaaatgctgaaatttaccttcaaattgtgatgagatttgagaatgatctccttgctgccatggaaggcaatgaggtgcatatttatacatgattaatgcctaccttgatgcccaatatgtcaaatactagcttgctgaaattttatttgaaagtaaacctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctattgaattaacct

SEQ ID NO: 55371 - DNA, 743 bp, Oryza sativa
ggccatgaccgttcaaaagccatttccacataccgtctccaagcatcagtgctgtccatcggcattagttcccaaaaataaccttctgttgcacgactcactacaactgacactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcatcgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacttgtgatgaattgagcgaaccagcagggcttcgccgctccccttctgctgccctcccctctctctctttcgttttttttggatttttagtgaatataatgaaatttcacagaggagggactgggcttt

SEQ ID NO: 55372 - DNA, 1331 bp, Oryza sativa
tcggagatcgaggtgctcaatgtctatattaattatatggattaccgattgcaaaacaaatttaggtatcatcttattcttttttatgttaaaagctaaagttagttagttaattaaatttagctactgagtattttttttacaagtcaaggttgtgaaggttttacaaggaagctcagtacagatggcagggttaaaaggaggaggaaaaatagaaaatacatcttgccaacggagagctacagccctatatattcttgttgtttgaggcgctcagcacatagccgagcttaattcctgcttgcatcctcgcggagtgttggagatcgaaggctgctgattaattacgaaagttgttgacatcatgttgattgttccagagcgatcagcatctagaataattcatccttatgtagatctagtaaacactttacgtaggataaaatcgtcatccaaaccatcgtgggaatggattttcacagattttaatactggggttttacgattgaggaatgggaatgaaactggactcataaagtgaacttttctttcagtctgtcgctccaaccaagcgtgcaaacaatattcatatttggacaggcaaatcaacatgggccgcaggacacacattatgggccgcgcttgagccccattcccgtcccaggccagcccagacttataggctgcacgcgggctaagggtgctccggcccaacagatacaggccgcgctccagctggaaaacgacggtaggatgcgattgcttagtacggaccgacgattaaagttgattgatttctggaggcaaagattttacttgaaaacattttactcatatatatccctgatctttgcgctttgactgacaaaacaagttactatatattactattgttttattttaaacccagtgagacaaacaagttcagcagcatccagcattatattccagttaggtgctaaaatactgtaaatcatcaccccggccatgaggagtacaaatgaagaacatgccagaatctgtaggagcattatatgtagattagcatatatgtatgcagatccagctaatgaactgaaataattgacaagatgcattattaaaagactcttcattggatggatatatattgaagcatgcatgcatgcagtaaggtacaatgcaagcaggtcctctaaaattcatgcatgattcgtctgcccctcgtcccgtaaaggagacagatcaaaatcaaccctcacactcttacactagctataacgacgactatcaaaccgcgacgaagcaacaggtaagcagatagtaacagaacggaggagtaacatgcattt

SEQ ID NO: 55373 - DNA, 1501 bp, Oryza sativa
tttctatagtaccatataccatatggttagcacgtgcttaaatttcaaacatgggtgttccattgcatactgattactgaagcatacagacagctagcgactactcttttcatgatatgtttgaatgaaaaactgaaacatgtaccagatccatgaacacaaactgggctccatccttgtaggtaaattgcttagtttcctttgaaatggatgcctctgggatctaaaacaaaagtgacaaaataagtgctcttctttgttagaacacattgaaggagagttgatgagtatcatatcagttgttttttattacataagctaaagcatgatctgatacagtcacagaatggtactccctccgttccagattataagacgttttgattttggccaaagtcaaactgttttaagtttgactaaatttatagacaaatatagtaatattgataatactaaattagtttcatcaaatcaataattgaatatattttcataataaatttgtcttgggttgaaaattttactacttttttctacaaacttggtaaaacttaaagcagtttaactttgaccaaagtcaaaacgtcttataacctgaaacggagggagtaatttctacaggtttagaaaggtgagtttctgcttggattaccgtacttccagctcgaaaggttttgtcaactgtgttgccagtgatataattacgcatttttgtccttacaaaagcagcaccttttccaggcttgacatggagaaattctgttgttgcatgaagacagaaagttttatatgatatttcttatatcgagcatctaaagtaaaatggaatagatgagcaatagatggcaagaaatgatatacatctgtcagaatactctatgacatttcaacatttgttttttcacagatatagattcgtctggaatttattgaaaaacacataattttatttaaatcaaacgtaacaaatggaactcttaaagctccttttataggtactagagtatgctttaccattccattctagcaactgaaagaaacatagcagtgagtgatctgaaaagcagggaatacttgggaaagcaaataacattcacatattgtggcaagctaagctatatgtgaagtttgaaaaatcgaaccaacagaagcaaatttgctcaagtacacactgaaaggtatgaaaggaggtaattcttctgaaacagtggatgcaacaaccaagaaaatagttgttttttatagcactagagtgtcacattgcttatgaacaacatggattgcagttgtataaaagggagttgttattcttcctaaaatgtgttaaagaaatgaaggtagcagctttcgtcccccccatctggtcctatatatgcagataataatgtgccttgaaataatgaaatttgtggctacatgaggtatgttcaacaaagctactgtatccactgggagactccaaccaggaatcaggtatgtttagtactagcagaaaggaaga

SEQ ID NO: 55374 - DNA, 1501 bp, Oryza sativa
tgtgtcagttatgtactctttctcacgtaacttattgactagtgcatgaaaaatgtcgacctccatacggaagtttcttttgcataatctttcatgtcctgttaaaatctcatgtacacggcaaccccctgtaagttttgacgtgtgcattggtctcctaatacaagatgattgtgatgaatctcctaaagtaggcagaacaaaatgaatgaactcatcatcactttctgatatacgtcggtagcttggattcatggtgtgcagatgctaccaaactgatgctgtaaactcaaatagaagagagctaaaaatcaagacttttgctgaggaaaaaacaattttggtgcaccagatgaacaagtagtaccttgttgttacacgagcaagtaacgtctagctatggtggctagacgatgagtaaagcttctggaaaaattatgcagatagtgaagagaagaacaaaggatcagcaagtttcttccacagttgatgagcaaatagaaagaacaggggagaatggtgcacaaggctaacgagggctatttatgcacttcaaagctaacggctagttgagggccgatgtcagttgatgcaaacttaaaaaaatatatttcaaatggcagatttcctacacttctcctgtggtgtatccgaatgcacgttttttttcaattcctgaggtttagcttcccataggattgaactccacaaccatctctattccttcatttttcctaatcctatgaatgaaaaaatcctttaaaacgaataagccctaacgttcttggtaatcaatcgaatgatctatagctgaaaattaataatactaatttcatgtagtctttgttgatgtactacttctccaaatactcctaacttaattacgagatggtgattgctaattggtggtactagctagtaataatcagaattaattgcttacaggccggctggtcaaagacgaacacgaccgatcatatatatatatcctctggcggtggtgggtcgagctagccagccagccaattttgacttgttctaatcaatcactcgttggtaattactacaagtcagatgatatgatgaacaataagcgaccatctaccttctactaggtggtaattgcatagccagaaatttatttattttaccacggctggacctgggcgcttccatcaactcgaccagttggatcgacatgtcgtcgtcgtcgtcagatgtcatatctggtggtaacatcgccgtagccatcggtacgcgccatggatcatttgatcgattccctagctctagctcctttttgatcgatctgatcgattcatatagctagctagctagatagtttgattattatttgcgttttgcagtgtccgtgatcacaggcggcatagtagtcatcgttgttgccattctcatctacaagtgctgcaagctgcgcatgtggcgcaagtacggcctctcgccgccggaattaccggcatcgcagccgcccaggcccagg

SEQ ID NO: 55375 - DNA, 464 bp, Oryza sativa
aaagcagacagatatttggtgctgagacaagtatggtgtatttccctctaacataagaaagctcctttcatcctaagtggattgaaatttatgttatgatgatgttgcctctgatatccaaatagtatgtgaacaaactatacagattaacaagatacacatattgcagaagtctcttgatcttccgtgttcattatactcaaattaacatgttaactcaaaactacatgagtaacataattctcccaaaaaaaaattgatgacataatttttttattaacctcttgctaaaaaatggtcaatgctctctactaaccttgcttgaaaaaaacagataaggacattgttgacccagcgaaaggaacagaaaaaaaatccttcgttatcttaatggaggcaaagaaattctaggcaagcaccattgttgcttgtgtaggttgattgtgatgctaacaaagggaatg

SEQ ID NO: 55376 - DNA, 506 bp, Oryza sativa
aagaaaaacatgtgcagctgacatgtgggccttacgtgtttttttaattttttttgttaactaggatgccacgtcagcaaaactgggcaaaaaaaactaccgagggtcctccggtgaacggtttgagtgagtttaggggtacatatttctggttttgtggttaatgaacatcaagaaatctcgctgttaaggtgagggacctctggtgaacttattccgaaggggaatcatctcttccttatcgtcttcatcgcatcagttgagctgccagctgagctatggcttctctccgccacggccacctctctccctccggcgccactgcaccaccctcctccttcgcccaactccgccgcccttcctcctgcctcgccggaccacgacctctccgctctcgtctcacccgtatccttccttcatcctttctgctccccctcccattgtcccaatgctgactgcctgaatactactgcttgttcctttctttcttgcaggggtgtacgcgc

SEQ ID NO: 55377 - DNA, 1501 bp, Oryza sativa
ggcaatggaggacagtaagctggtgggtgcccggtgttcttggttgtccttgctgtatgtggaccgtgccattgatgccggtagggcagatcgctcgtctgctgtccatcgagagaagaaaagtctgtgacggaatcaaatgtaggtgtgtactgtaattagtactgctactttgccttttctcctgagataagctaggagtattgttcaaggctcatggtgatggcccatggggtggttggatcaagtatttcctgctcttcaactcagcaggagagatggaaatactaatgcaaacgagtgaatgaatgaatctgacctctttattacgagtactactagtactaatccatgtttgctgtttgcttctgaaccttttatcctcaacaaaaatgatgcgccatttttatacggatcaatcattcgactactccatgctgcccgttgctgtaccattacagtacacgtcgcagtttggattggcatttggcaagctgttcgaatctcacaggagccgggtttggcgccgtgtcaagagcttctatgcgttttcaatgcgcgggcgctcatcaatggggctcgctgctgtcggttgcgcgatggatacgacagtggcacgagggttttgtttactggagtgattagattggacagcagcaagtgtatggggggtttgtctcggccagcgcgtcgcctttcggttcaggcgctttggaggttggatttcgagttgttcgcatcgaagaggtcatgtggagatggaaaccagagcagtgttgtgttgcgaccgtgttttgagctgttgtttctacgatgccatctggggtctctggtgttccagatgcttgggatgggtttggttcggtgtaggagcccgtgctggagtgaccctgaagtctccgtggcacgccgtgctgtctctcggcgaatctgttgtgcttggcgccgctgcggaaccgagaaggcgttgtggtgtgggctgctcgttgaacatgggccgtgtctgttcggcgttgggctgagattgatccagaacgccatgcgggccatgttgtatgggccaccacaatggccaccggtgtcctgacacgaggtccagaactgggggaagatttctactgggccgagcaggcgatcacgcatgccgcggagctagctgagaccgcgacagcctctcccgcccgcgcgcgcgcacgaactccccgcatcgcgcgcctttcccctgcgaattcgtgcactcgcgagtcgcgagcgtctcgctcgctcttcaccggtccacggtcctctcgctgccatgcactgatgcaccgggcgcacgcagcgccgggccttgctcgcatcgcatcgcaggagtagtagtgtggtagacgacgcggattggttgggcgcgttcaatcaccaactgacaaaggctgcggcgagcctgccacacctttcgccgcgaatctttccgttcacgtcgcctccctttctcctcttcggctctccgcccctctccgca

SEQ ID NO: 55378 - DNA, 301 bp, Oryza sativa
ccgccaccaccgctgtgcccccgcgggtggccgatgatgctaggagaggcaccaccggcgggagaaggggaagaggcagaggaagagattgtttcttggtcgccggccacctccccctccctcccaaactcgctggccaccgcgctcgccccccgcatccgtgctcctccgctgcacgtaatggcatatatacatgtgagtgtgctcagccatatacacatgcttggctaatatatacggttgcatgttatcgggcggcaaaccaacaagaagctagctaggctatagctggttgtctcca

SEQ ID NO: 55379 - DNA, 1501 bp, Oryza sativa
ataatgaactcggttggatcaggattgccgattgggccgagaaagtagtggttttcatgcgataagctgggaatcgcaactaggttggagaggtgctacaaatccaaagcgaccgagaagaagagaacaataggagacaagagaaaatcaatctactcttgggaaaagggatttagccgatgagaacttacctcagcgtactcggctgatggcgcatcagatgggccggcggaagacgacatcgctgcgggcggaaatctcgtcggggaggaagtcgcctggaaatcgcctttgcgccggaggaatcgccggagaagagagaggaagaagttttgcttgagcggtgaaaacggaagtcacggcgtgagatttctcgaggggaacggttagtatttaaagcgctggaataacggtcaataatggcggagtgcgaaacttactcggagacggtacatgacaaattcggaacattaccaaatatcccggacttggggggcatgtgttaacaaccaaatttggtagtgtcagcatcggagaggaagatgggatcgaagcggaatcgaagatgaggattgtcgtggaaacagaatgagtatcggctggagtctagatcggctacggttaggatcggctaagtctgagtcagattgggttaagtgattcagccgattccgacaatacgacttgtatacgacattgggttcaaattaatgtacttcaatatgattgccacgcacggatagagtcctggaaaggcaattgtatctattaattaggatattttatgtaaattccttatagataaaggtgggcaaaagtcttccgcaaagacttatgatatcttagagtttgttagagataacagtcgtgtccggtatgggcatatcttgtaattctcgggtataaatagaccccgagacctatgtaatttttaacacacacgttcaatacaatttcggcacatcgccaccttttgctttaattttatttcgacgagttcttgctttcgggttgagctgcatcggtttcgatcttcaacaagagataaaacttgttatgatgacatgcgttctcgggattagtgcttccatctttacgatactctaatcttgtttatgtgattcgtcgagttatcgtatatcttacgtgatctctggcaatatcgtcatctaacctacaatcggctaacatctatcaaggaaggcagctgattaggttagatttcgatgttaattcagattatataagatatctaccaccctatgaaacatccagcggtttgattgtctagatattgtccttcttttcatacttaatgctgcatcagttgagtttgatctattaagtcgtgcttagaattacaatctctagcctgccttctggttgccgattagggtagtctcggagttttagccgatctaatctgattcgaccatatttgctttatatgcttcattgacatgttaaatctgccctttatattaagatcttgtcacatcta

SEQ ID NO: 55380 - DNA, 1501 bp, Oryza sativa
acgacgtgccgtatcgttaaggaggtttgagggagttatctgctttgagattgtgacaggacacgtgtcgcacaagagattaagtctttcgcaggagcgtaagacttcagtcttaccaaattttcttccccgacgagctggtcctccacgaagaagtacaccacgtcggggttcttggggtggacgagcgcgagcaccggggccttctccggcagcccagccgccttgtagctctcgctggcccagaggtcggcgaagctcacggcgtactcaagcgtccacaccttggtccctgcctccctggatcaaccagcgtgtgcatggagaccttggtagtagcaccggcaccgtcgcttgcagagcctatgtccacgcacctgaacttgccgtcgctcagccgcacgcagcggcgggagacgaacgctctctcggcgcagtagtcgcagccgtggcagtcctcgtcgtgttctggcgggagctcgaccctggggagcgggacgtactccatgtgcggctcgtcgacgaacgggtcgcagaagaggaggcccgccgcggtgtccacccagtagagcttgccggcgtaggaaccgacgtcgaagcatctccagatccagcggggcagggggttgttgacgggcttcttctcccacaggccggtctcggacgagaagcagaggagggtggccttgtcgccgccaacgatgaacttgaactcgacgaccaggtactttcccccacctcctggcgcggcgatgatgctcagatcgttgttgaagacgcatccctcagggtcggggaggtagtaggcggtgcgggcggcgatgtcgcagacgaagtagcgctgggtcggcatggtggtgacgtggtacgtgtgcaccttgccgtcggcgtcggtgaaggaccgcagctcaccgggaccaggtcctgggggcggcggcgcgaggaggaggacgagccccgcagaggggtcgatcgcgatgacgaaggacttccacttggcaaaggggctcaccttggccggcgtgatgcgccgggacacggcgagcttcgagacgcgcggcggcgcggcgagctcgagggcgaggtcggcgccctccggtagggggatcccgccgccgccgccgtcgccgtcgccgcacgcgtacacctcccggctcaggatcacccacgacgtcgacggcagaagaggaggccccattcgagctcgctcagatgacgccgcacagctgcttggtgcgagctccgggagatggggggagagagagagagagagagagagaggagaggagaggactaggactagtagaagaggcggaggagctagggtttttgaggagagaaggccaggaggaggagcggtgaccggcgagctttcgcgattgccgtttcgtggctgcgtgcggagaggggcggagagccgaagaggagaaagggaggcgacgtgaacggaaagattcgcggcgaaaggtgtggcaggctcgccgcagcctttgtcagttgg

SEQ ID NO: 55381 - DNA, 1501 bp, Oryza sativa
gccctccacctccacggtggccatctctgtgcccactgaacttgcatcaatgatgcaaacttaattgattaggagtttaaatcttgtaatcactattcactagtacattcataatcatattttttatacaatttttgtatgtaagcatatttcaacaactcttacatgcttacatctactttggtaatttctctatctcaatgcacaaagctagtgcaaagtctgaattctgaaatgtgtgtgcagctactaccagagtttcagatggaatttgatacattcattcatgagaatgtgtatcaattcatgatatcactcaagatggacgaaagacagagtatataatagtagttttcaactagcaaggaaacaatcagattgaagcaagaaagagagatcaacttacttcttctgtagaggtaaattaataagcaatggagccgaaactgaaactgcttttgctccttgtgatgcggtaattgttgatgagagaaatagagaggagaggaggaagatcgaaagagcgtgaggagtagggcaatgtgttttattggtgaaggacaacatatatggttgatgcaggcaggcaggggttaggttggagaaggagacaggagagaagaaaagagatgtggcacattcgagactgtcagatacacctaccactcccaaagtcccaaaccgctgcaactcaagaaaaaatgagacctaaattgctaatggatgggtaggtagcaatgttcaccaaacgcagtctcagcttaaaccgaagctaatcctagtttaacaagatttaatctgttaagagcagagtttctttttttttttttgaggtgaagttcttcggttccttccatatatgcaaagacgaggaaattaaaactgaatttgttaggacgtcctcgtcttatatcacttcggtggcgttttaaacagctaatgtaggtagcacgcttccgaaagtatgttttctcaaactttttaagcatggtttaaatagcttctttttcaaagttatttattagctttataatatttaatgtatttatgcgagtgacttcacaaaataatctatattctatatagtaatataaaaaagaggagttgtcccctccaatcgtacagtcaaataatctataccctatgctaccactgaagagcacatgtgcacatatttgatgggccgcctgatcatttgggcctaaactgatgctgggccgatgggcttcttcatgtaccgatgaaccaacccgggtggagaaattttttttatttttaattttttttattaaaagatttacaaaagtaattttgtgtttcaaaattttacaaaagtagtcgcccgccgccgtctgggagggcgattttttcttcccagagggcgattttcgtgacgtggctgaccaccgttagcgcacgcctaacggccgtctataggggggctgccattttgcaggaggccccctcgccgcccttacggagggcggtttactacggtgcg

SEQ ID NO: 55382 - DNA, 1258 bp, Oryza sativa
ggcttcgccgctccccttctcttcctcctcacccctccctctttctctttttctggattttgagtgaatataatgaaaattctgagagggggaaggggttttatactcggaggggtaaaaatcgccctccctaagggcggcaagggggccgcctgcaaaattccaggccgcctcgccgcccttttgcaggcggccccccggacacccatagagcggccttcgggagggcggcaagggggccgcctgcaaaaaaccaggccgcccttttgcaggcggccccccgcaccgtagtaaaccgccctccgtaagggcggcgagggggcctcctgcaaaatggcagcccccctatagacggccgttaggcgtgcgctaacggtggtcagccacgtcacgaaaatcgccctctgggaagaaaaaatcgccctcccagacggcggcgggcgactacttttgtaaaattttgaaacacaaaattacttttgtaaatcttttaataaaaaaaattaaaaataaaaaaaatttctccacccgggttggttcatcggtacatgaagaagcccatcggcccagcatcagtttaggcccaaatgatcaggcggcccatcaaatatgtgcacatgtgctcttcagtggtagcatagggtatagattatttgactgtacgattggaggggacaactcctcttttttatattactatatagaatatagattattttgtgaagtcactcgcataaatacattaaatattataaagctaataaataactttgaaaaagaagctatttaaaccatgcttaaaaagtttgagaaaacatactttcggaagcgtgctacctacattagctgtttaaaacgccaccgaagtgatataagacgaggacgtcctaacaaattcagttttaatttcctcgtctttgcatatatggaaggaaccgaagaacttcacctcaaaaaaaaaaaaagaaactctgctcttaacagattaaatcttgttaaactaggattagcttcggtttaagctgagactgcgtttggtgaacattgctacctacccatccattagcaatttaggtctcattttttcttgagttgcagcggtttgggactttgggagtggtaggtgtatctgacagtctcgaatgtgccacatctcttttcttctctcctgtctccttctccaacctaacccctgcctgcctgcatcaaccatatatgttgtccttcaccaataaaacacattgccctactcctcacg

SEQ ID NO: 55383 - DNA, 339 bp, Oryza sativa
acaacctgtatataaatgttgttagccttctgaacgattacatgaagagaagtgcaaactacgcaagaacaagttggatcaaaccttgctggcttggtctggagtttctggcattgtagctacacggcattgctgagcatttaggacttccatcagctcccagggttttgctttatcgggcctttcttctgaaattctaggctttatatcgatgcttctagatgctggatcaccaccattctattaaatccataattaagtcagattgtgtttcaattgctaacagtaaggtaagcaaagaggcattaaacagatgaaactttgggaaatctttcgtct

SEQ ID NO: 55384 - DNA, 1501 bp, Oryza sativa
gctctttacaagctttaagcaactcttttctatactcatcttcccacatgaatttctgacaagactgcagcatatggaatagcaaaaatgtaatcaacatagtatcaaaaaaatcaatcttgactaacattcgttcaccatacacttgaagaacgcatttccatcatttcttggatttcactttttgctagtctgctctataacgcgttcttttctgcatttggggcactagatcatgagcaaaccagaccacccagtcgtcacctctgtcattcctgaataaaccaaacaaagaaatctatattcagagaaaatgtttgaaaagacaagggccaacatctcaacatactctaataaatcatggagtatatatatttctactttagctggaatacatagcaaacaaattaaaagatatattgataaatctagatatattgataaatctagaaatactaacataacatataattttaaaatgtgttacctctttctagaaatttacactgctcttgaaggatgggatcaaactcatctcatgttaagcttagatggttgcactgctcaacctatgcacatatagctaatttcgcaagaaaacaaaaaattgagtaaaaacagatgcactattgaaatgataatattcattcaataattcagtttacattaaactataaacagaagtgagaaacacaaaaagttttgggttcataacacgatgtaacaaaagtaaacatcaccaaatccaaagacaatttatgggacagtttcatagaaggatcctttgttctgctaaaacataacagttcattagtcctctacacccgtactctacacacagttcattagcttcagttgcaggaaggcaggcgcagttcattgaggtgaccttggctgaaaaaaaacaaaagttcattagaaattgcagtatatgaagcaatgtatgccaactgtatgcacttacatgatacatgatgtactcacagcctggctcacagcagtcggggcagtcgtagtcgcactcatagaataaccctcctatttatgaaaaaagaatctcagcaatgctgatagaaaactagaaacatataaaggtaagtgaagtatggaccttcagcccttccttcatcaacatcttggactgaaacatatgaaatataagccgctattagaaacggggctgcatatggtcaactatattaaaacataagtgcattgaatgatgttcttacgcctgcaaatcctagtagaactgtttctgcagatgaaaatgaaatacagtagcacgaggattcatgacccagcaagcagcaagaatattcatgatccacaaagtggatttagcaagctgacttcagtgaaccgataagaaagcccaccctatctccaacagcagagattttaattgaaagactgagttgaatatagaagtcaaagtttcgatttagtaagcatcagtcagctaagcctaccttacttaccatactttgtgcattggcaa

SEQ ID NO: 55385 - DNA, 1501 bp, Oryza sativa
ttccacagtcaaattttttgacttcagtaacaggtttgtttatgacatcaggaaaccagtaattcaaaagcatgtgaaacacaagtgattctgaaaaccttaataaggctactaattttcaacattggagtagtatttaactaggaccaataagcatatttacaagaagagctttcaagtatactgctaattattctgtctctcaagcaaagaaatttagggccctcaatgtaccagacttctgaatgtatagtaatcttcaatttatagaagaattaatttgataagcagtaaaagagcatattcaatttatatgaatatattactcttaattaacttcaagtttaaatgtatagtaatcttttctttcaagggatatactaactccgtctagaaaaataatactataattattaactttgcacctagacaacctggacagtgtccatgtacatagccaaaattgtcttattttaagaacaggttgatacaagttttctaatgttagcgcatatttttttcttataaaaaatatatttaaattacacgtcttttttttgggtgggggagatatacgcgttttctaatgatggcactaatttctttcttctactaacttgcatgttttgttaggaaaactctgaatgacttcctaacaaattctctttttacctctgcaaaaataattctttttttatttctcaaaagaaaaagaagaaaagagattatgcggatatgcccttgcaaaccggggcagtggacgaaaatttctctggcaagtggactggcgagcacactctccaccagtagaaaaaaatgccaacctcaaaccaggtcaaaaaagcagatttgacagcatgcttctttggtgcctccaccgcctgcatgataaaaaaaattcctccagctaaagataaaaacaatttaaaaaatttactgtatatcacaacaacaaaaaaagtcacaaataatatccactttccctttttttttttccaaattctctctctctacagtctaacacacatgctgacaaaggagatctccacatcaaagaaacatgacatcataatcttggcaaacttccaaaccctacaacaacctttctccctcaaaaaaaaatcattttaatatattttaatcaaccaccaaaagtaaaaaaaaaacaaatcagcaccagcatagctgccacttgtcctgcacctgcaaaatctactaccccattattctcaatcaaatcagtgcatgatcagtagggacaggccccccttgagagagaaagtagagagagaaggagaaaagtgtgcactcctagagagagaaagagagaaaagtgtgtactgctggacctactagtagggtccaacaactaccattttagagagagaaaaagagttctctctcccataaaccttctccctctctctctctaaattctctctcctcctccactatttcttcctcccctttatctttccggggcgctgccggcctcaagtct

SEQ ID NO: 55386 - DNA, 1501 bp, Oryza sativa
gtgtgtggcggaaggagcggcggggactggagcatgctagcagtgcagagcggaacgagcggcgggtactccctactcctctctcccttccccttttcggcacgcggctggcggagagcggagcggccgaccgatagagtggggcgtgcggcgggcggagcggcaatggccatcggatgactgtgacaggcggggaaaagggcggcgcgcggcggccacagccgtatgaggaatcagcttggcggcggcggcgtgaacccgttgcgcgcgcgaaaggcgaccacggccgtgatcgtgccgtggctgttcgctgccctccgctcctctcaacttgacacctgtgatggctgccactgcttttcctcgttgtcgctcgatccaccgccaccagagaagggagggaaagacagggggagggagaggccgccgctggagatgggggaagccgacgaggcgagaggagaagggcagcctcgacagaggaggggtggatctgtcggcccatcccttgctcccatgctgccgccactgcttcatgggaggagaggaagagtggatctggccaccccgccgccatcgcctgccgttttatttgcgatggggaaaggaggaaaggagagaaaaagagaaagagagataaaaagtcaaaaagattatactaatatgacccactatagataacttgcacggtaaagtatgtggctaatgaggttcttcatttagttggtacgcgaagttcgctaaaatcgcaaggcgcgctgcccttagagcatccacaatggtaaagtaaggtgctctctataaaacatgtacatctcagcaatagattagattaatagtaaaccacctcaatagcatgtctacatgggtatctctagctatctaatctattgcctcgtttttctctagagactatctccaggttagtagatagctttgttctctctcttcatttaatctcttttaagtagaaaaatatattgacattgatatcttataaagagcctatagataaccattgcgggtgcccttagatcatcaggtgtcacggccaaatcacagagctctgtccttatatagatcacacgtgctgttctcagaacgatcacaaattaacggcccggattggcccaactggcgtctagcataagatccaacgacagagatccgtcgatcacgtttccctgaaaaaaaaaaaacgatgacacgaaacgcccccaccacggccgcatctctccactctccagactggccttctcgcgaactcgccttcttcttcctcccccaaggccccaagccgcgcgacccagagcaaaagccaaaagcccgagctccacaccccccaccgcccatccgccgcgaaggcgcgaagccccgtcaccgcgcgcgcgcgcgcgcacagccatgttcgccgccgcctcgtgatcccgaaggctccccgcatccacccacccactcacccctccctcgggggggagggattcttcggccatggcggcat

SEQ ID NO: 55387 - DNA, 1501 bp, Oryza sativa
aacattgctgccactcgtcgttgcagcagcagcaatgtcggacacctccttggcgacgccctccttcaacgacgccgccgcctggtgatccgcaagcggtccgatgacatccgttagagggagagcctgcgtacatgaagtcactatgcgctcccaataagacagaagtaaaggagtcaacgagtacactcacgttgatcccagcctcgtgttcgaccgtccccttctctcaaagggggacggggatgtcgctcgctgtcgtggggccgctgatcatcacttgaccgacgcggcgctccacggtttcgctattcaaacctgtaagatcgacaaacagaactcgataagtcaggaggaacatgcaaaggccgggtaggctcgggcctggagcggttggatccacctaccgatgaagtcggcagcaacttcataccccgacaaccctcgtactcggaggtcatcaataatgtcgattaaagactgaagggagggagttagggcgggtttggcggtccactctagaatcttgtctggttgctcctcaggaacaacagaggctggatccgagttctctatctgaagatagaaccaccttgcccgtcatttgctacgagaagaggggcactggaaggggatgtatcgcgacttcaggccatcccgaagtcggaaaccgagacatccagataccttttttggttccgtccagcgcaactcgtagtaaaagcgaaagagatcaagaaatgactctaccccaatgtaggcctcacaaaggtaggagaaaatgctaaggaatgcgatagaattggggttcagatgaagcaaggaaaggccgtagaaattcatgacaggaagaagaaactcggagggcggaggaagaaaaccacaaagaatgtaatcctcaaccgcaaccatgcggcccaggacaggttcgggttcagtacctcctagttcgctctccatgatcccgcgaccagggagggcaccgtcgtcctgcagcttcttcagggacgcgttggtggaggtggacttgtcgaaatccatcaccgccgaagatcgccggagaataagaccgagatgagcaaactagggttttttttgcgggagcggagaagacgaggggagcttgaaggctagaaagttttgcggcaaacggacttcaaaatggatccctaaaacccctttaaataagcgcactaccgacggtgcgaattccaaggaaaggagagagatggccgccgaaaatttctgggtccgttacgcgcagcagttttcggactacaatttaaatttactcatgaccgttgaacttcgtacaatgttatcgataactctatgtctctacggttctcataccgagatcgaccagttgagagcgataacgattccgacatccgaagtcgcgatcggtcacatgagttcatttaagcagaattcgggggttactgttagggttacggataaggtatacactctacccttggatgcatgttgtataccgata

SEQ ID NO: 55388 - DNA, 1501 bp, Oryza sativa
tgagcgagcgaggaggagggcggcgagggcgactcccggcggcgcagttgacagtgcttgccagcgccgcagagggcggacccctcttgctgccgccaccgttcgagcacttgtcgatctatcgatatccggccctgcgacgggcggcgtcgggtgaacgtcagctgggatgaggttggaggaggcgccggccgccgctgcttcggcacacgtaagccgctgctgccgacgatgcaacactcactcccatgaagagaaaccgaggagaaagagagagaacccaacatatgtaaggctacgtgcagctgatagcagagacaagcgggaacgaccctccaacaattttttcgacatagaattgcccaattaattaagataaataagtagaagtagtgtattataccctcttaagaattttagatccctcacatatctaaataataattccggtgtcctcaagatcactacagaggaattatgtgggactattgtcaaattgtcactgcccccatgctattatggcactattaaaataaaccgtagaaaattacatgttaacctctctagaagcaaaaataactctaaagacgtgaggaaaacggtatgggtaggagggttattaattgatgatgtggtttggttaaaatattattctgtacttggatttatcaagatgccattctcgattaggggagtttcttaacaacaaaataagagacttttgcatgattttaaatcttacattaacttttgcatatattcatttcgatgaagaatgggtatgatcctataaaattcctgtgaaatgcctcattcaataaaaaataaagacctgaaattttatttgtggtatctatctatcatccccttctcaaattttagtgttttattagtagctatccaaacggctattcctacgttaattttcatgttttgtaatgatctgttttgccattgaagtcttatgaatttttctttttttaaaaaaaaatcatcatgttcctgcgtgaaataaacaagccttagcaaatgtaaaatacaatggctattgattaggccttttattttacttgttactagtaagaaaaaacacaacacttgtgaaacatgcgaggcaaacatgaacgaggcagatgccatggcaacagaagaaaagagaagaaaccatgtgagtagccaacagacaaggaagaccaaagagtccaaaaccgatagagccaactgttgggaggaagcaaaaccaacaaccttggggagccttgtagcaaagaaacggcggcccacaagaagaaaccaaagcagcaggtggagtgaaacagacggcccgcccactggtttctcagtagccacagttttgctgacgttctcttttatctgtttgcttcctataaattctacgcgatagcttcccatttctcatcactgtctctcactctcactcccaaatcacatcctcaaattcagattcagagtcgtcgaaatcagtagtattcatcaggaa

SEQ ID NO: 55389 - DNA, 1501 bp, Oryza sativa
gcttttcctatctaatcagataaattgaggtgtacagatcagctaagttcctcctctctctcgctctctcttttccatttttactgattagtttatctttacagtgtcagaggagtaagattattaaggaatgtaagatcaggcaccattgtgcaatcatgcaaatacatgtgtattcggtaaaagaacaatgatcattggcatcattttccattacattacaagacattgtgcttaaggttcagcgctgtacatctaaccaacccctacatgagtctttttttcctttctatttaattagttattaaacttttttactaaattttacaactagagggctgctaccccatgagattccattcaaagtggtagtcacaggataattaaacaactgacagatttaatacacatctccttttccggtccgagccccacgcgattacacgacccccacctggctccgcgtccgcgtagatacatcacctgcggcaccacctggctcagcatcgcgccagcggcgcggagcaccactacaactagccgaagcagtagtgctctctccctccatgatcctcctaggtatcgcacttcctgcgtcttgaaccaatgcttgtggagacaatgacgttggttgcggcagtagtaagaaacaaggaccgatctgaggggaaggaagaagaggagaagagacgtgtggtgcttgatacttgatacctcacagccatcatgatacctgatacttcgcagccagccatgatacctcgcaggtaccgagtatcaggtttgatacctttagggtatcaaccatgataccataggtaccaagcatggtacctagtatcagccagccatgatacctcgcaggtaccaggtatcaggtttgatatatatgggtatcaaccatgataccacaggtactaagcatggtatctacaagtaccaggtatcaggtttgatatatatgggtaccaaccatgtgttgacagaaaacacgaggcctgggagatctgcttaactacagttcaggtccaaagctcgccttcggatgtatgagcgtgccagttgatttgatcctgcaatcaacaagaaacaaagacaaagaaaccgtagttaaatctataaatgatagcggatcggctgtttgccgatgacatatcatttatctctgagccgatatcgtatgtgaatcgatcggcgatcatcaataagtaacaaaacaccaaatctactagatcggctgtagatatcaacaatatataatctttatatcaatatacacttaaatcaagtgattggagtagatcggtcaccataccgagacagtataaatcacttaaatcgaaatatatattaataacgagattatatatatatgtttgtagcatagccgatcaaatagatctagcatgtatcggctaatactccgataccgctttatattaagatattgaagcagataaaatactcaagcagatgcttaatatacttagatgtgacaaga

SEQ ID NO: 55390 - DNA, 1501 bp, Oryza sativa
aagacttttaaaattatttctaaaaattccatttaaacaacaatttatatattttgaattttcagggtgtgacatagatgtacagtaccgataacactggaataaattttaaatgagaactattaaaagatattatgaagtgcatgtgccattagtttggtttaattaaaagagaaagggaggagaacagttctacttttccaatatttttagagggcttctatgagtaaccatttggcataacctagggtcaaggaggctctgataccaacttgtcacgcccataaccacgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattacagggttttagttggcacattaattaattaaccaatcacgattgaccatcgtgaactatcattaagctatcattaaataatagtgagtcataagttatcccaatagtgtgctaatgtttctaagcagggctaagcaattatatctaatatctagttgaaccaatatacatagcccaactagtcaagttataataacccaaggtatcaaggaataaagtaatcaagaacaaatgggctataacaatgaataggttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctcctgcggaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgacttatgacgcaataatgaattatttttgaaaaggaaaagaggatttattgcgtcagcggctagggtttcggtggaccgggcgcacggcggcggttcacgcgaacggacggccgagatcgacttgatccaaaacggacggctgagatcgatcggtccacgaccggctcacggcgaacggccccga

SEQ ID NO: 55391 - DNA, 1501 bp, Oryza sativa
tcctaagcatcaggaggcaatggtggagcttcggttctttgagacctgaagaggttggctcatcgtatcacataaacatgattttcaaaggctttctttctcgtattggtgccaatgagaactaggtcaggtgactgtagatgttacgcagtgtgcttcatcaaggcagtttgtagatgtgatcaagtttatctcggtgtcttgcattcacctgttgaagactgttattcttgtaggctgtagttctgttcattggttaaaacagcttgctgtttaacaggcaatgagccttgacggagggcagttcttagattgtttcggttctgtagaatagtgtagttatgcaataagtcaatacgtgtcgacgacaatatatttctagttgtgtttcatacttgctttgggcatcagaagaatacttgctgatgtaagtgatcgtcatctgaatgccgtctgttatatattcatccactgattgctcggtcaggcctgaagagtagttgatctatcttacaagttgaattgttgatgcgaatcacatctgataaatgaaatcttctcagaaataagctcaacattaatggctccattgtttcgcttatccttatacttagtcatagaaaaaaaacactcgtataaaaaacttttatttacatgtccttggtgatacaaaagcaaatgttgaaaataaatcacgattaaaaaaaatcacaaaatcaatttcaaaattaggttttaaaatttaaattctacttataagtataaacgaaacaatagtaagctgtttcttttgaatttaaatatgtttcatgtttgatcttttttggtgcttcgttaaaatttgagcatcaccataagcaaagtgttgctatcaacccaaaaaggtgttgagtgaggcaattaacagttgtttcctagtaacaagttaaaaaaaaagctatatttttttagtcgaaaattgcgagtacttgtttccaaacaaaacttgggttctaacaaaattttgaacactagacttgagacaggtgtttgcatttacagctatttattccttcagtaatagacattgtatttgggcatgttcggctgctatatgcagccgctacgctgctgcagctagaaatacaaaggggcaattgtgtttctgcccttgctttgcatctcaattgttattttacccctgctttttagggtttgtgattttgcccctgttttttttttaaacgaagcaaccacctgcccctactctgttaactaatggtaacggtgttaaatgtgtgatgaatagataaatatacccctggacatgttttggcttgcacaggatacatgtttcaagttaattttgtgcgaatttcatacgggacctaaatgtttaaaatttttataaaagttgacataacacaatattttggacaattttgatagaattttcgcaataatttgaacacagtttataaacgatgccagaacacaatatttttgacaaaattttgacagc

SEQ ID NO: 55392 - DNA, 1501 bp, Oryza sativa
tatatcattttatggacgtaactacacagctagtagctgatttgtctaaatcagctaccactttatctataagagacaccatctacctatacttcaaatacaattttctcttaaattactcatccgatctacgatccgattacaccgttgtgttcgtaagaattaaatctttacaacaagatctcacatcattatattttgataaaaaatcacaaattacttttatgatatgtctaaattacttttagatttcactaagttacttcttagatataaaagtaaattcagtaaagcctaaaagtaatttacatatattataaaagtaacttagaacaaaacgaaggtaactttagtttagagccgtcagagccgctggttctgttcaccggttttggttgatcatttaggcgatcccgtgtcatgtagaattgactcgttgagtcggtatctcgtgaggctcgcttgccagatcaattcaagccatcaaatcttagtcaactctcggtcgagattaatctcagccgctcaaaatcgatataaatcccctccttttcaatggcatattattcctttttaatatatatcatctaccaaatatgatctaatcttttccggaggttgctttaatcttttatctccgttataaatcatttgtaaatgatttaattaatttggaatagtcttttctttaataggtttaattggaattaaatcttgtaaaatttgtaattaattcataagaaatcggaatgaggtcgttcaagtctctaaattcatctaaatgtactgtttatttagtttttattagtctttttcctcgttttgcatgttagctcgtcgtttccgtcgtttcgaaggttcgcaagtgcgtcggaagtattcaagaagattaattgaaaaccgattattgcaaggcaagtcacacagatcccaaacacaattcctttgagcatgttgatcctatatttaaattctctatttatttcaactgtgcatttattttcgaatgtcaccgggtggtgtgaacctattcctttggtatggccactttgtattgattaccctattcttcgatacctttggttttaattggactagttgtacttatataatggttcaactagatgtattagacataattgcttagccacgcttagaaacattagcacgcaattaggataactaatgtttcactattacttaatgatgggtatttgatgatagctcacgatggttaatcgtgattggttaattaattaatttgccaactaaaacttgataatggtgggttgtgggcacatggttttgatggtcgtgctcatgacaattaaggaccagttcacgagtttcgattgtgaaacattaaacgtgccaaccacaagccagcatgggcaacggctttaccttctgtatagcatggttcattgcggagcaccagactgagaagtggtggagataagcccacgggggtcgctggggagtccatgccttgtttgtaagg

SEQ ID NO: 55393 - DNA, 1501 bp, Oryza sativa
gtcaccgggtggtgtgaacctattcctttggtatggccactttgtattgattaccctattcttcgatacctttggttttaattggactagttgtacttatataatggttcaactagatgtattagacataattgcttagccacgcttagaaacattagcacgcaattaggataactaatgtttcactattacttaatgatgggtatttgatgatagctcacgatggttaatcgtgattggttaattaattaatttgccaactaaaacttgataatggtgggttgtgggcacatggttttgatggtcgtgctcatgacaattaaggaccagttcacgagtttcgattgtgaaacattaaacgtgccaaccacaagccagcatgggcaacggctttaccttctgtatagcatggttcattgcggagcaccagactgagaagtggtggagataagcccacgggggtcgctggggagtccatgccttgtttgtaagggggtgattatgatccaggaacggtgcgctgtggtggattgtgttgtgcgaggggtactgtcacagctcctttctgagatacccgtggtggtatcgaggcgcatggtgacatgttgtggagctgtgtcttgtgggtacagtggtacacctctggccagagtaaaactattcgaatagccgtgcccgcggttatgggcgggtctaacaatgtctttcgtgattagtctcacacttcttaccataataaatgatgctataattggtaatactttgattagctcctggtttggaatggtacattcctggtttggagatagatccgtacagccgggtatgattgttcaggatggttggacctgtgcagcatgggtgtgttgttcagtgttgattaatattgatgattaattattctactgttttacaattctcaaatgtttgttaaatgccgttttcgcaaatgaaccctatattatgccattctttggtatccttgtgcacttgtatatttgttgtgtggcttgctgagtatgtcatatgctcaccttgcaataatcaatcaaacctcagtggaagaaaaaggatccagaataagaagacgtttggcttatacctcatttgagctgcctgtgggagtggagccggagcttcgctagaccgtaattctgctgctgtttttcttttcttttgtaagtatgtaacgttattattatgatgaatctgtatattatattgtcagtttgtgtacctcggctgattcctagacgaggatgtaatgcacaaataagttcggaaattactagtgaatttttgggcgtgacaaatatttcccctacttacttaattaatggattagtactacagtaaagtaagattcttcaagctaacacatatctagattctggataggcgtcgcttgttatgactaaatcaagagtggtctcgaattagattttgcgcatttttatctattcacatcatccaacctctccttcagaaaatgtgagagctt

SEQ ID NO: 55394 - DNA, 528 bp, Oryza sativa
tcctctcccctcccctcacctcacctcctctccctggccgccggccggaggcggctactgggcggtggcggcacaccccgacgcggtggtgcgcggcgtgtgctcgcccgatggcagctcccctccctccctcccagatctagccggagggggaggggggaggccggtagcggcgcggggtggatagcggcggggcgcggcgtgtgctcgcctagcgatggctcccctccctccctcccagatctggccagaggggggagggggaggccagtggccagcggcgcaggttggacggcggcggggcgcgtccgtgcggcggcatgcagcggcggattgtaggatcaaggaggccgactagagggggggtgaataggcggttttaaaacttaatggcacttaaacaaaactaacctaagttgctaggcaaggtgaggtgcaaggttaactaagtaactaagttaagttttgcaaacctaagtgatatgggctcaaatatgtctctatgaatgtaaatagcacaaatgtaaa

SEQ ID NO: 55395 - DNA, 1501 bp, Oryza sativa
ttcctagagagccatcggcagcacctttgatactcggctgagcggagccgtctagagcttgtttcccatctccatccttagaagaactggttccaggatcatcagcaacaacttttattttgtacttctgaacaagtgtccccttgcgggtctgcatgaatgagttcaagaactgatcccgtgcttgccgcaacattgcttcaaactctttcttctgctcaggtgtgaatttttctggatcgatcggcacgacgtttccttcattgacgtcagtcaatcccaacttcagcatcttttccttaacagagcctgggctagatggtggtggtggtggtttttcggccatgagggaggattgttggctgacttcttagttgtcccaccaggcgtgccaaaagcgtgttgacagaaaacacgaggcctgggagatctgcttaactccagtgcaggtccaaagctcgccttcgggtgtgctagcatgccagttgatttgatcctgtaaccaacaagaagtagaagcaaagaaatcgcggttaaatctaaaaatgatagccgatcggctagtgccgatgacatatcatttatctttgagccgatgtcatatatgcatcgatcggcagccattaataaataagaagggactaaatatactcgatcggttgcagatattactaatatataatctttatatcgatatatacttaaatcaagtgattgggatagatcggtcgccatgccgagacagtataaatcacttagatcaaaatatatattaataatgagactatatacgttcatagcatagccgatcagatagatctagcatgtatcggctaatactccgataccactttatattaagatattaaagcaagtagaatatactaaacaacagcctaatatacttaaatgcaggaagatcttaacgtaaagggcagatttaacatgtcaatcaagcatataagataaaaagtagttaaatcaggtaagatcggctgaaactccgatgctaccctaatcagcaaccgagaagcaggctagagattgagattctaatcacgactcataagatcaaacttaactgatgtaggtataagtatgaaaagaaggacaatatctagacaatcaagccgttagatgtgtcatagagtggtagatatcctatataatctaagtcaacatcggtatttaacttaatcggctgccttctattgacggacgttagccgattgtaggttagatatcaatattgccagggattatgtaggatatatgataactcgacgaattacataaacaagattagagtgtcataaagatggaagcactaatcccgagaacgcaagtcgtcataacaagttttacctcttgttgaagatcgaaaccgatgcagctcaacccgaaagcaagaactcgtcgaaataacactaaagcaaaaaagggtggcgatgcgccgagattgtattgaacgtgtgttcttaaagttacatagggctcgggg

SEQ ID NO: 55396 - DNA, 220 bp, Oryza sativa
cccaaaattgtatccagtttttgttggagaaaagaacatggcctaatatatactccttaagttgctttgaatttcatatgccgccaacaccgcctacatccggtcctctttactcatagctccggtggcaccacctcacctctccacattgtatcgtcttcatcgctgaccgccactagtttaccgactgctcaaggcctccatgtatatgtactttagc

SEQ ID NO: 55397 - DNA, 1501 bp, Oryza sativa
atacaattcattttcacttagttaatgctatttctctcttctctcattaagccatatctcctcaattgtttctagccctcaaatgattaatctatggttggaattacctccctcattttctcctctcataaagccacatcaaattacttttaaatttggaccatcattctatatactatttaaattatgataaaccacaataacttatgcaagtttctatcgtctaactatcttacatattatttttatttcttattattataccaaactcccgcagcaacgcgtggggtttcatctagtttataatagatgtattagcacacattgtacttgtttacccatatacactttgtatcattgtatgcatgcgttgtcctagcttagaaaataaacagagagatggacaagtaagtaacaatgcgatgcacatactcttggcattggcatggaactgctagtgctgcccagctgttcaggctcctgagataccttgtccttgagctctttgatgtacttggacgcatctacgaggattgatgtctcgtttgcctgcatataatcatacattcatgcatgctatgtttagattaatataattaaactctcactgctgcagaaaattctattactatcgattcataactggaagcgcacaagtttttgaaccaatagtgtgtttggcacagtatcgctgccggtagatttgggttttaagcccggtctttttaaaattccagtttaggagaaaagataggtgagggtgaaaacatatcgattattgcaataggaaaaattagaagtaaccaatgtagatagaagtcaatatagctcattttatatattctcaaattgatcgagagataccgaaccatgcatatgtagtaattataacatggatactaattaagttaattaaattacgtaccgcacttgactttgtaacagaacgtagagctcgagcttctcttctaaagctgctgctttcttttgatctttccctgacatctctccctagatctctctctctggggaaacacaaatcaagagagagaccagctgctagcttagctagtttgtaatgggcatctcgatcatatatatagatcgatcaatcagaagctcgcatggtcattatatatatacgaggggggactgaaatatatatatatatatatataacgagtgatatcgatgatatgcatgatgatcagtgggcagtacagtactttgctgtgtcgtacgtatggtattgataattgcaattgttggggtgtgcacatgatcgatctgcagtactggtgtgttgcctgacagcctgaggatggatcctaagacaaaactaatactctatcttgtttttccttgtctctttgccttcttcgttttgttctgcatgcacacgttccttactattttattttgattattgcaagaggatcatccactctgagcaatggagtttgagtagtacaagcgaagcgagaatcgtcgtcgtctcagc

SEQ ID NO: 55398 - DNA, 1501 bp, Oryza sativa
aaagtagatccgataatttatataatagggccatcagtttaagtgcacgtataaatttgttaatatagatattgtttatttgataggtacacgatataattgtgtaaaatttattttaaaatagtgcattatttgaaaataatagtacaaagtaaagagtacaccggtttaaattatatgatggtagattctttgtttgtaaaattattattatttaaaaaatatatccattatatatataaattgaaaaaagaagaaaaaaaggaaaaaaaaggggaggaatcgtatgtacagtacgcacgtatataatccacctgccaatgtgcgggaggaggataggtgggacccatagtatttagtttgttttaagatcaattttatctaacggtgtgtaatattggaccccgccaatttaatttaaaatcaagggatagatgttttgcttttttcttagaatttctaggattttctctattttattagagcgccacgtggtggcttgagaacgtctgtaggaagttttatggacttttagtatataatagatagatagataatagatagatagatagatagatagatgacgacgtttatggtgactttcgttcgcctcaaaatatacaccaatttttaaacgtatccatagaggataaggtgttcggattcgcctttacaaaggctaaagggtgaatgtacctatgtataagggcttgcatctctaaaaagaaaaaaacgctcttctttgacatacagggcatgtgccactttaccgctactttcaacataaccaaattttagtgttaccaaattttaattgggaaaaaaactaaacactaccttaacaacaccatcctaccaacatttggtagttccgaagattccctcataaaaatgctactaaattttggaaaaacatcaaactaaaccaacgctatcaaaatttggtacaaaagcctatagcgattggtgaaggttataggaaaaagaatatttcgacaaaaaacaaggggagtactaatcttctttgctgctacatgatggcattaagtgaaaagcgagcagacgaaagatttcatgtacaagaattttacatttcaaggcttacagcctctcgagataacaacgaaacgcgagctaaaaagcgaaatggataagtgaagcaagcccatagtcattgcccaggaaggcaaactaggccggcccattaattcctcctacgaatcgatctgggctgtgaccctagtacccgacgtgtatataacaacatcctctccatcgcttagggtttctcctcggacgcagccggcggcttagggttttgtagctgtcgccgatccaaggtacgcagcctccgagcgccgcctctctctcacacacacgagcgcttccttactcgagatctctcgcgcccctctccgcttcgattctctgtttgttgatcgattttggtttgttccgtcgccttcgccgcaggtccgaggagcgaggaggagatccgcca

SEQ ID NO: 55399 - DNA, 1501 bp, Oryza sativa
gccaagctcctcgaatgcttctagcaccgacgtcagcaactcaggctgactcttctccatcgacacattgattcgaaaacctctcttcttctctagctctaccgatgaaacactcacctgcatgcatccatacgtcttcaatgctgcattaagttctttttttttcccaacttgaaggaagagtcacattttatgctatgatgagctataaacttaaagtatcatgaggagcagttgtggagctatcaccaccgtcgaacccagacaactaatagtgtttttcagtgatcgactgatttttataggtattagcggctatctacagtggagacggtagcaacgtagcccaagcgtggacaccgtacaagacttgcccgcgagctatctccgttgctgaagaggagtgatccaaagctatattcttcataacttagttcgctccatcggtgaaggcttgtgttaattagactatatatatttatcttttttaaggaaaactaaatagatttgcattattgttgtactcagtccaatcttaaatatttcacgtttaaaatataatttggataaatcataaccacatcaataattctcgaaggtttttttaaaggtatgtatatatttgcttttttaaaaaaatactatcataatatcataaacttaattattagattccataaatttcttttgatgtaaatatattgatggtgaaatttaaaagtttgaatatcctatctttctataaagttaaggcccactatatcctaaagctcaacatacaaatatgccacatcatccactaacatttaatacatctcaaatctcatacgagcatgttaatttattaagttttagagctttaaaatacaagcatgttaattaaatatcatcccacataattcacataatatttcaatatatctctctatcactttttataatatcctatatgcctatatagtatatcctcacttaaattttaaattttagagctttaaaaaatccaagcatgttaaatcatcattccacataattctcaaaatatttcaatatatctctccatcattttgtataatatctatatacctatacaattcattttcacttagttaatgctatttctctcttctctcattaagccatatctcctcaattgtttctagccctcaaatgattaatctatggttggaattacctccctcattttctcctctcataaagccacatcaaattacttttaaatttggaccatcattctatatactatttaaattatgataaaccacaataacttatgcaagtttctatcgtctaactatcttacatattatttttatttcttattattataccaaactcccgcagcaacgcgtggggtttcatctagtttataatagatgtattagcacacattgtacttgtttacccatatacactttgtatcattgtatgcatgcgttgtcctagcttagaaaataaacagagagatggacaagtaagt

SEQ ID NO: 55400 - DNA, 1501 bp, Oryza sativa
gaggaaaagacagtattgtcccctcaactatattggtcaggtgttcctttccttggtaatatgcatagtattcatattaaaacagagttttcttgcgagaaaacgcataggacagcaaattttcatgccattttttttttcaaaacatatcacagttttttttaggaaatgcataacaaaatatcatgccaaaaattttcaaaacataggttattactctagttactatgtggctatgtatctgggctatcatccacaagctgggattgtgggatactattgcggagcaaattttcatgccatctttttttcaaaacatatcacagttttttttctcgcaaggaaatgcacaacaaaatatcatgccaaaaattttcaaaacataggttattactctagttactctgtggctatgtatctgggctatcatccacaagtcgggattatgggatactattgcagtggtatctcgacgtttggactaggtggcacgggatgcttttacccaagggtgacgatctagtctacggattgatagtcactagtacctatgtttcgtgatggggatttagttttgtccttttattggctgtgtgcattttatgcagaggtcgggatgggctcagttggaatgtatcatcttggtgttatttgactaagtcataataaagcttctattatcttaaaaaaaattcaaaacatatcacattgttttgttcttttcattttcaaagaagttgcaagatgaagattcatgaaccgaaaagaaaccactaagtataaagagagagcactttgagtcttcgacattgatcaataactctgctactactgctcccatatttatttgcatcgctagtaattcttaagtaaaatttaatatctacattctatgaacagactgtttttggtaaacggtagttggccttgggctaaatagacaattgtacgttgcgttccattaaaaggaaatcccatgctttctctaacttaattgacaaggcattctcttagtcccgtaggattaggactcaacttgaatgttctgaatgaccgactgttcactgtacattaatatgcacttcattttgtaacaaggacgtaaggccattttagtcaatgtactgaaacaaaaaagtgctaaatgcacctactacattcatgagttgcatattttgcattatcttttttttttctctctgtggagaacaaacgtgtactgaagaaagagagagagcaggagaattttaattcccctggctgtcttagttagcaaccaccactcattacaatacattagtccctgaaaacgaaatagccaacacaccatcctcctctctatccccctgtcgtcccaagcattcgtttttatagcctcaccacagctcaaaaacacaatgctagcgttgctgttcacgtcgttgccaagccacaaggagaaggaagaaggaagagaaggcagaaggaagcagcaggagaaggagaaggccagaagaaacaa

SEQ ID NO: 55401 - DNA, 1501 bp, Oryza sativa
tcgatgacagctagcgacggcacggcgtccgtcaacgacgacctcggagacgacggttgacgacggcgccgatgacggctggcgacggctcaatgacgacctcgcggatctggcaacggcacgacgacggctggcgacggcgacagcgccgacgacggctggtgacggcggcgtctggcaacgacgacctcgacagcaccagcgatggcatctcgacgacgacggttggcggagagagaaaggggagagggatgctgtcggcgtggggcccacgattggctaggctattttggttggtcaaatttggctagtggaaggaggactttggccagccggatggcttggccagctcgatagccagtctgttggagtgtgaaattgagccaaaattgctaaaatttaacttagagagggggataaggaggctgttggagatgctctaacttcatggccgagtttagttccaaactttttcttcaaacttccaacttttccatcacatcaaaactttcctacccacacaaacttccaacttttccgtcccatcgttccaattttagcgtgaactaaacacaccccatctcgtgtgaactgcacatgttcggacggatcgatcgatctttgcctgtaagtaaactgagcatatatatatagatttttgccaactaatatataccacgtgccggaaactcagacttaacggacatgtagatttttatcaacttcgaatgaatatttagaaatatacttaaataaatgcattgtctcctttagtgtcaaaatattagtgtttgcaccgtaagtttatgttaaccctaaatatctattgaaattgaactatgaagattaaaaattataagataaaagcataattatgtaaattatactaaatgagccataggtttaaaaagattgtaattcttggtggtggtagtgagtttgccaccaccaccaatattgacaagtggccatgatgcttgtttgtatatatactgcatatttctgtcgctttatctcgattaagaaaaaatctcacaaacttattagcatgtgatcgatctatatttaagtgctgatcgaaaaccaaacgtctatttctcacattagaaatgcaatcctaagcatggtattttttttatttcgttttcaagatgaaagatctcgtttcaaccaagtaaaagacagttttttcaacgagaacttaattttagctattttcaataatccattacaatgtatgggtatttggctagttatcttttagaaagaaacattaccttaaaaaaatgtacaccagccggcaagcatgtacatagctccaaagttcagaacatagagagagaacacctcctcaacaacactctcaggtcaatctcggccgacccaaacagacagaaaaacagattgaccgattcaccatgcatctctgcataattcctgaatctcaaggtcctgatcaactttgaatggagatttacaaatatatttaaatgtctgcatc

SEQ ID NO: 55402 - DNA, 1501 bp, Oryza sativa
aaatctagtctctgaatattatcggatataacacatccctcatctttcaaaacagatacaaatatagtcctatgataatattgaatgtggttttaggtgatgtggcactgacgtgacacaagaaacaaaattaaaaaataaaaaaccatgcaggatccacatgtaagtaaaacaacaatcttctttcctatcaccctctcattcaatcaggtgaaggtggtagagcaaggagcaaccttggccccgacaatggctgcgacctcaatgtcatcggcgactcattccggcggtacggttcgcggagggcaatgttcgctagctacgaggcgaaggggaacgtggtcaccgactcactgtcaacctcacctcctaccaaagtttaacgatgtaggacgaaaccacctccaaaaccatctgagaagtcgatttgcaatggttctagaagttagggaacgggttatacccggttttgcacttgagggatgcaatccaacagggacatgacttgtggaggcaaaatagacttattcctaaaatattctcactggcttagtttggagtgttaaacttttctcgcaggccaaattattaaacattttacgtggccaagttttcacgggccacacatggcctattaatgtatactggcagtctaaacttcagcctttaaaattttcgcatggcctatttacgataagaattttcacacctccatcctcatattccaaacctctcttgcaggaaaatttttccaaagacaggaatcctcaaatattcccaatgaggccttgattgcagttgcatatatcatgccttaatttgcaaaccatggtttttagctttttggtctcaacttcataaaaagcagcccttaatgctcccagatcaactccttttccatttaaacccaccataaatcccctgccggtaactcccattaccgcaatataataaataaaacaagaacaccaccattcactcatctccttcagtttccacattcttgacaccctctggctcacaatcccattcagccatgcaagaagataacatcagtaagaaagccaagctgcgaaaatccatacagctcttcctctcaagaaacctcaagaagatcccaccgattcacatccccagctcagccatccctgcgaagatcaccagcaaccgcctcctctccacctgcaggttccccagaaccccatcgctgcacggcggcggcggtggcggcggcgaccaccgcaccaccgacgacgacgacggcagcaacggcagagaccaggcggcgacgctctccgacgtcgaccgcttcctcttcgacaacttccggtccctctacatccacgacggcgacaaccatcagcagcggcgacaaccaccaccatctccggggaaattcacacagccagcagcggcagagacatcatcatcaaggtcagagtcggttgcagaagacgcaagaggaacaagctcgggtgatgaagacgacaacaacagtagt

SEQ ID NO: 55403 - DNA, 1501 bp, Oryza sativa
acaagaacaaattaaaggacaaaaatttaataccgttcattttaggttgaccactctacatataaacaaaataaattttaaggtacttaagaaagtacctatagaaagtacatgtaggtaacaaattttacactaaaattaaaaattttggtacctatagatattaagtacctaggaatatcatgttttatataaaaaaaatatgatatcccctatcttttcaaaggtgataaaattactcgcaaaatacagctgtatatatttacagaaatagaaacaaaggtatatatcaaattaatacagtattacttccaactaaatttagaccttggtccatgcaattttcttagcaaaatccagttagtttactaattaaatatagaaacttagacaacactcatgcatgatataacagaaatatggtgtctctagaagaaagtccatataaaagcatcaaccggcggaaacatatgaagcaggagaagacacgtcgaccgaggataagtagtctatagtgtacatgttgcggtacgcctatcttgtaaagtacatgcaactggacgtgcgaacgaaaaccatcacatactactactacataatagcagcagccggtggcacaggaattaaggtgaagctgttgaccatatagttaactaatctgcacatggaagctagtgttagaaaatacccccctcagttacatattgtaagttctaaaaaaagttccccatattgtaacatttatttagtttttttctgaattaaaagttctttaacttcaatcaaaatatagggaaaaaaaagtaagtaacatctacattcccaaatgaatacactatgcaagacatgtttcacagtagatttcagttaaacttgatattgtaaacgtttgcatattttatgtaaatttgatttaagttacaaaaattttacttataacacaaaactgaaactgatagatgttaagtacaatgattgattaatgtttgatagtaacagccatgagagacatcaaatgctcactctatcttaaaatataagcatttttaaaaataaagctaaatcaaatatttttaacttttgctatcaatagcaaaaaaaaaacaaccatgtatatggataatattactcgacttagcattaaacaaattaacatactatgcaactcttttcatttaaacaacttatttttataaatattattgatagcatctcaaagatcttgttaaagtaaaaaaaacacacacacatatataaaaatataatggatggagaaaaaaattgaacagaagaattgggccaagtccaaccaatgaggtgcttttcctaggtacagccaatatagcctggcacgatcgatggatgcattgggacgatgggtcgtcatcgtctatataaagatcaagccagtcgtccctgctgtgtccaagagatctactgttctccttgttgagaggaagccatccagccagctagctataagatagatagaagaagatca

SEQ ID NO: 55404 - DNA, 1501 bp, Oryza sativa
tccatcgctgctgtctcgtactacggacagccttcgacatgctatagtcatccgggcttgatggtggttggctccgctatattgtgttcctgttattttctaagaaattgttcttctatttgaatttgaatgtttgtacgctcacaagatgtttgaagtgccttttcccttggagaaaatttttttatgtttaaaaatacaagtatatataacttgccaggcatattaaatcttcgtttggaagtgcattcccttaacttttctacggcatgtaaaaagagacaaacgattaacgcatgattaatcgaatatttattattataaacataaaaaatgagtctatttgacttttaaagaaacttctatataaaacgtttttttaaaaaaatgccatttagccgtttgggagatatgctaatggaaaaggaagttgcatgtcggaaacgatgaaatgaatggggcctaaaccatatatatactccctccatttgtttttgtttgataggatggggtagtattatattaatgatcttagggttgaatgttgcaacatgcatatatatagtgtatatgtcttttgggttgcaattcatcacttgcatcaattgcaattcttctcgttcaaattaagatgcctgtggttttgtcggaaacttggaagaattgattctggggtcaaggattgcatgaagaccatacattccgatttccgagtcagccgtcaaggtactaaaaattgacgttaatttaacggaccaactattctgacctcacctggtttatcagctctaataaaaaagaggacagaaatgcaacccaacttacctaaccgtcaaggtacctttcttgcttgtatatcatatatatcagagaaaaatctaccccaccatctgtcttaaacactagcctaaagcccgtgcgtcgcaacagaaaacaaattaaggtttttgcttattaaattaattaataatcacttatttagtctaagtaatattatgatttttcttattgaacaagtgattttgaaatttaggaatctaatggtgaaataggggaggacttgttgaaaggtggtgtaataatatagattatagggcccagttttaatattgtggaaataaacaccatcgctagtcgcaatagtataaatatgaatcttagagggcatatagttaaacctcaaggtgcaaaggccgaaaaatattccatcatcttaaaaataaaaggttaaacctcaaaatctaaaaccactaatacagtttaaccttaaaaacggattcagaatgcagagccaaaatacagagattcacgtatcccttaattaagaaatggttgcttttttggacttataatcatacatgtgacctaatcaaagaattaatcttatggtaagactattgtacctacttctaattttagcgacccaaaagtcaaaacttgaaatattaggaaaaaaaatcccttaaataaatctaaaattaaatactaaaactcaagtttg

SEQ ID NO: 55405 - DNA, 1501 bp, Oryza sativa
ccatagcatgtgctcattctttgcttgccgtctggtggtgtgatgtctgtccggtctccaagcaccctactgcagcattgctcatctattacactccccaggtggattttgcggatatattagattcatattagctaagctaatcctggggctaacaatacaccgatctgagtctcaatagatgtgtctaaccgtttctaggtctaataccctgacaatgtagtgccagtccgcttgatgtaatagtagttcccttgtacatttctcagctaggaagaaatttgtcatacaaattttgagaagaggaacaatgcttattctgatataatttattgatcctttcatctgaaagctagctctttgtctaactattcttttgattattgtatcaagggagggaggttttccttcttctttcatttgtacaatttgccaatttcagtttgagtcagaaacaggcaaacagctaaaagttggaaattctattcccagttctggttcttcatgttgccatctgagaagcaggatatttctgaaattgcagttggcaatctttcaaaaccaaagtgtccagtatgagagattatcagtccgatgaagaatgtgatggtaaaggaaaaccggtacgttttccacggccgtcttgctttcagcttatcgagtacaagcattcaccggcgtcagttgcaggtcgtcaatgggggctcgaggcgggtcacatgccccatttgtagcttatgtacgccgctcgcatcatccccgttaaacgacaataacttgtgaaaggaagctggtgagtcgagcatctcgtgaaatctctctgacggatttagattcgcctttttgcccgttcattgtttcagttacccatttttggccaggtgccttttggtactgaatgaatcaaggcttctcaaacaggcgtcacaacataccgtgctatcgtagtggtccggaagacgatacctcacctgaggaaagttcggccatatcttgctgttctggtcaggttgagtgtaatacacacactacatttccacccagggaaggtaaccgctgccatttcactacgcccttcacgtgccccattttcacacaacagagtaaacaccgcccaggaccaaaacaatgtcgaatcttaagaccattagtttcgaaatatttttgatcctgaattgagggtacagtaatggactagttttttttttttgaaatttacagtaatggactagttcatatagttaatcctttgattcgaagtattttaagagcaaagtccgtatttaattgtttggttggtagaatgacgcctcaatccgcaccattctgtcgaataggaccaaggcacacgtgatgcgacgtgcatcatggtacaaagttggcaaaagcgcctggtagcggagagtgggaaagagctggctggcgtagtagactagcaggagtccacatcgtcccatcaacgctgcgacgccaccatttaattccacacccaaaacaagtc

SEQ ID NO: 55406 - DNA, 1501 bp, Oryza sativa
ccggagcaaacccttcacctgcggcaggaacacgaacggcgggctcaccaccacctctgcacccaaaaaaaattaaaataaataaacaaacccacagatcagcaccagatcgattcatgaatcgatccaactccaaacaacgccctcgggaggggacgacggctcaccgacgacgtcctcggagggcacctcggcctcgttgaggacggtgacgatcttcttcacgtcctcccctgtcccattctgcacgcagcaacagcgcagcgcatcgataaaacccaagcctcatcactcatcagcagcgtctccggctcatccggaatctggattgtgagacgactagtgctggggggaatacttacgcatttccagttgccgccgacgaagaacttcctggcagccatggatggatcgccgagacgagggtgcagcgagcgaaggaggcagagggttttcgtggagtggaagctgtgatggggggactcgagatggggcggttaaatcgaggaggggaaggaggaaacacgtggcacagcttcttggggcggaagaaagaaaaggcttcggtttcggctgtgtgctttgttgatgccgcaggcgcctacccgaaggcggaaaccgcggaggccgccggcgccgattgattcgggccaacctggtttctcgtcgatccgcgatgaaccgaatgaccaaaaggtgatagagaggcatagaaaggcgccgataggggtttagcttttcctaagggcatccacaatataaaagtagtctataaacaatagaatattccattcagccacctattatcattgtgcaactagtccatataaaaaaaatagcaaaaaatacccatatacatatggactacccatatgaaataaattatattatctatctctactcctctctcttctccttctcctaatgataccttgtatctatacattgtggacattatcatagggataaactatttatgtgggtcccatctatatagatcactttgccatatacattggtgatgctctaaacaaaaaacttcggccgagtttagttccaaaatttttcttcaaactttcaactttttcatcacatcaaaactcttacacacacaaacttccaatttttccatcacatcgttccaattttaaccaaacttccaattttagtgtgaacacacccttcttacatagtctaatttttcatacatattctgatatgtatagttactatagatatagaattagaatctagaaacatattccagtttctctaaattaagctcacccaaacagggccagtaatacagctgaatcatatcatacaactagcatcaagtaagaacgaacacaagcatatgattagcctctgcaacgttgttctaacagagcttcagcgagtacagaagatgctaaagaatttaaggaattgtcaacaaccaacaaacgaaacctgagctgctgtcaaaatggtttcttgactatctctggcaatgattttg

SEQ ID NO: 55407 - DNA, 232 bp, Oryza sativa
aattcctgcagccctttgctcatttgcatcaccatccagtatcccttagtataggctcggtgattttggtactcgcctgcaggcaggcatgcatgcatcctacttgggtattttcctctctacaagttcaacgaaagatctaaagagaaccagtgatcctagggaagacactgcttgattttctttgctgaaaacatctcaacacgtgccttaatttagcaccaattgcagg

SEQ ID NO: 55408 - DNA, 1501 bp, Oryza sativa
caaacgcctatgggcagacaaaaccaattttcttttccgtcttaggcgcgagttgacaccacaacttgcatgacggcattcttgtacatcctgctgcctccctactttcttcacgtgtacactgcacggagacgactcgagggaacattatgctgcaaacaaaattctcaacttggccttcacacaaacagtaccaccgctgtcacgccgtacataaaaaaaattataaaaactgatgcagttgcgagttttgtatatacccatctgatgcgaaccgaatccagttgagcagtataatacccagggcagacaccaaagtactactccctccgtcccataatataagtgattttgagttttttcttgcaacatttgaccactcgtcttattcaaaaaaaatttaaattattatttattttatttgtgacttactttattatctacagtgttttaagcacaacttttcgttttttatttttgaaaaaaaaattaaataaaacgagtggtcaaacgttataaacaaaaacttaaaatcacttatattatgggacggagggagtagtatatctttctgcttgatcgcattgttcatttcttcctgccaacatgtactgctgctagtcgtgttcagtgaacctgtattgagctgaacctgcacttgtggtgagtggtgacctagtgtgaacggtatatttttctttttttggaggggagcacggccacgtgtactcctcgtccgtagcggctgggtgtccgcggcttttatcatcttggtttagcgtcttggccgcgcacgacagatttgccgatttgttcgcgccaagccgccaatgtgtgtgacgagtgacgacgacctggcttgtctgtaattgtttatcgccgagctgggcggtaactttctgccgtgaccgatgcttcttgctgagttgctgtgctatgtttgcttcttatacgtggacgtgttgtgtggatgtgtctttgttgcgtttactgtagccacaggtttttgtgtgtgtgtgttactaccacggctggactctccctgcaggcagcatccatcgctgttgcacttttgagcggtagttcttccttgcaatgcaggcgcgtctagattcattgcaaagttggactgatcttatttttcctgctattcgtgacgagacagatcagcacgacgcatacggcaaaaaaatggctgctctaattttggcattttagaagatgcgccgtgattttcaggagagagtgatgcgcgtggcgggctatttcttccattccagcagtagctagtaggcgccagatcattcgtgtgatatggcaaacgcaacagttcacacgttgccgactatccttctatggataaacacattgcctatatgcgacacggcgctaatgcagtatcaagttgccatggtggcatacttgcctttcccaaccccagatgtaatgtaacagaacagatgccagccaattcaacaaacaggtcgaacaattcaacaag

SEQ ID NO: 55409 - DNA, 290 bp, Oryza sativa
ttccagtatttccataaaattgagatctatttaatggcactactaattagtctaaataggatctttcttttggtcttttgtttaggttttcgattgtttgcgtatagttgcggttaccggattttcgtcgatcgcgggttttctcgaagattcgtgaagcttcgtgcagaccttgagcaaggcaagtcaccctctgaccaattgctcctataattggaaaatcattattattttgtttgcaacttgcattattagaatcacacactcaacttgcttggcctcggtatgcg

SEQ ID NO: 55410 - DNA, 1501 bp, Oryza sativa
atctacattactttaagcacaatctttcgttttttatatttgcaaaaaaaaattgaataagacgagtgatcaaacattgcaagaaaaaactcaaaatcccttatattatgggacggagggagtatatgattgtcatccctttagtcattttaattaggggcaattacaaatttaccactactttaaattattattgcaaaactgacactagaaaattataaaaataccactggaactatcattcgagtggcatccttgcaatattaaaaaaatcgatggcgaatttacaaatgcaattaattgtccttgtttttttatcactatatatgtcacagtggtctccacgttttcttccatgacgggtagcaagcaagtaatttaatgagccttttacaagcaagattttcttctggaagataccgcaaaaaatgaaattagtattcattcattagtctatccgtgcatatattatcctattgttggtttggaaagtcaacatgtgcactggattagtggttaccaactacggagtattaattcttaaattccatcttaaaaataactactactatatgtctgttttttttggcaaaatttgctacatgatactcaaatattgtggcatttgctgtgagatacctaaaaatcgtgtatttgcttatggacactgtaaaaatatggtaattagctgctggacactcagggccggtcctgtggttttggggccccaggacaaaaacttatatggaggcccctatacataaactaatatatatatatttatatagtcttataaatacacaacatttaatattcgatgtgatagagaaatttaccagatgagatgaattggaggagtgtaggaccttgaaatcaaatgaataaatgaattggaggagagcagtgcaagcagcaggcagcaggggcagcgagtggtagcgagcagagaaggcaaccggcggacgatcgacacgagcgtggctgactactagcgagccccgatttgccgtttccgtttgcgagtcaccaagagcgcaggagcagcgagtggcgtgatgtgatcgaggtggcgcgacgtgagtggcgtgatgtgatcgaggcgaagcgacgggagtaagatgaaaatcgcttcggcttcactgaaacaggtctggcgatggactaaaattcattttctgtattgagctatttagctgtctaacttaatataggcctatagcccattgactaaaattattaagtacgtagtatatatacttatatgtgcaatagggggcccctagattttgggggcctcaggcggccgcacggcctgaccctccctagggccggccctgtggacactcgaggcattattttattattttcggtgaaaacagagagagaaagagtgttgaaagtaccaaaattcccttgacactgttcttctttctattttctttcttctctcttttcttctctctttcctgcccctgacacgggtcgcgtccttcgctgcagg

SEQ ID NO: 55411 - DNA, 608 bp, Oryza sativa
ccgcggtggcggccgctctagaactagtggatcccccattcgggattagtccctaagcctcacaagcaccgtctattataagaaaagaattaagaggagcagtaggacaactatttcttctatcaccaattttaaacctaagagagggctccatcgatctctaaaaccggtgatctcgaagccaaacataagtgcataaacactagtccataaagaaagaaaccgggagaagattgaagtggcttcagtggcatctcaaaacggttatagatcaaatttcacataagcaagaagtgatcatgttaggctaagattcaatttatataattagagacaacattgtggtatcagagcagaaacttagccattatgttcccatcattccgtttagatgccatatatgcctatgtcttgatgtaaattatcagtaaatgaagcaattagcttcggattaactcaggaaaaggagtttcgggataaagcaaaattttccagcaattcaattcagcaagtttgggaagattgggataaactagaatgaaattcccaagttttcccaaactcgtgaacctacgaccgaaaatccccaagttttcaaatggaacttg

SEQ ID NO: 55412 - DNA, 1501 bp, Oryza sativa
attatattgtacaagaaatatggttaacttctggtacctaatcaacacctggaaaatcactcatagaacaatatattagcagactattactatgtattgtaacaattaactgttccgaatggctacttccttattctccaagtgttttgtgtaaaaattttgtatgtaaaagttttttttaagaaatcaaataaagctatttttaaatttatactccctctgtttctaaatgtttgacaccgttgattttttagcacatatttgaccgttcgtcttattcaaaaacttttgtgaaatatgtaaaactatatgtatacatataagtatatttaacaatgaatcaaatgataggaaaaaaattaataattacttaaatttttttaataaaataaacagtcaaacatatttaaaaaagtcgacgacatgaaatgtttagaaacggagggagtaatagttaacgcttgatacatgcgctaatgtattatatcatttcgggtgccgccaaaaattaatctcagccgaaccaccaatcttcacgccttaaaaataatgacaaccttgacagcggttctttagattatggaaagaagttcaacataagtacacaagtactagaaattaaatgtgaaagttcttaccatccacacaagttctttatttctgagtaaatcgcacttcagctggctataaaatcccctattttcaaagtagagctgagctaaattgattcgtgcacccaagtcaacaagaaaacgtgacaaagataaccaaaacacacaaattaacaagtgcatattcgcattgcagcatgatctaattattatattgtatattcggcattctgcgtgttaattaagacatgagaaaaagataaaaggtggtcaaggtgacatgcaaacagaagagtagttgactttagccacactccgaagctatacacagctatatgcatgcatgggccccgctctcagtgtttgtgccttgcgagttgggaagatcgacctcgtgcccagttcattaaccaacaacgcaccaaataaagcttactaagctggccgagttgaaaaaaactcaaaaaaaaaaacttctgttcagaatcaccagaagcgtacagattaattaatcattttctcgatctcatcctcctgtcctctagtactattatatatagacaccttagacactcatctagcatcgatctcaaacacattcatagcccattagccgacgagagctctcagtgtacgtaagtcgagagctcgaggaggcatccatggctatctcctaccttctccgttcctccatcctcgccgtcgccgcgctactgctcttctccgtcaacctggccaagggcgacattagggaataccaattcgatgtgagtcgctgtcctctgtttcttctttgttttctttacgttcgatgcatgcatgatcgagagaaccaacttgcatgcatgcgtggcaatagtgtaatggtacgttaattgcgatgtgtttgt

SEQ ID NO: 55413 - DNA, 367 bp, Oryza sativa
ggctttttatgggacggaaggagtactcctcgaggatactgtttaatattcaatatgataggggagatttataagttctacaaaatgagcaaaagtgttatcaataattgcaagtgtattagagaattattaatcatagctcattaccatgattgtgatcttttctgtaagcaattagttatatgtaattgattgattgattttttttatggcaaaagcttataagttttatctacaacaatacaggctcttggtgatattgttgaatcttgtattggcgcagtgcttttagattcaggcttcaacctgaactatgtttggaaggtaatgcttatgcttctaaagccagtattgaccttcgccaaca

SEQ ID NO: 55414 - DNA, 1501 bp, Oryza sativa
taacgagtgcatggcaaagcttgaacaaaaataatggatgcattttgcaggcaatgaataaccaagctaagaggatcagtagcaggttatcctcaagttgaatttcaaccaaataaaatacccacagcagctgcccatatatataaattttagaatgatactttactacgcacaataaaaaacttgtccaattttcccttgagaatgtttgacatgttggttccaaactgcatgcaggagccaggaggagcataggtaagggaggaagggaaggtgttggattagggcgtaccaaaatcattgccttgaccttgagcagctccgcaggtgacgattaacaggagtaggagaaaggaagcgactttgaaatccatcgcctctttctggctgcaattgacctgcaattgagtatgtgtgtgaagaacaattggggattaataacagatagggcggccaaatcgagagattgaggaatcaaatcgcgacgattctaatctaggagagaagaggaaaaagaaagggccaggccgggaatccaatccacacaagagaggaagcagcagagggaacaagcaagcaactcgagctagttgacgataggggaaggaagagaggagggggaatcgaaaggggaaagacaactcacaaatcgcaagcggcggcgcgtgaatcctttctgctttgttggtttgtaaaaaatcgatcttgccgctgcaattatagagtgcttctcttgcaggatcgattgtaataacaaggggatcgaagaagcagagaggaaatcctagtcgtatcggggtgtggtgtggtttccgttgcgtggagggtatgaattcgtggaggaaaaggagaaaaaaaacagattagaacgccgaacagtgattggattagctcatgcggttggaagttggatttcgacacaactgtgggcttcagctgtatgaaatgagatgcggcccaatagaaattaaggccggcccactcaaggagtgagtaaaaaacaaaggcccattgatactgaaggaataaaaagattaaggaaaaagtacaccgaaggtccctcaacttgtcatcgaattacaaaatcgtcccacaaccacaaaactagatatataacgtcccttaacttacaaaaccggcgggtgagtcagcgtgagacccacattggccccatatgtcaggacgccacgtcatcatctctttctttcccctcctctcccttcctcctcctctctctctctcactcatctcctctgggcaagccggccggcggtggggaggaggtcaccgggacaaggaggtcggacagccggccagcgatgcggcgacagcaactcggcggcggcgacacgggagaaggggagggaggcgacggcagaagcacgaggtgctaaagcagcctccattaaaatcgagcagacgaagccgaggcggatttcgcatgagctagcgcaagcgtcggccatggaggaggtcgtcgtcggcaaggagcgctagcgcc

SEQ ID NO: 55415 - DNA, 195 bp, Oryza sativa
atggtaattgcagaagaaaatgctaagggaacaaaattgtaccttcagtttagaaagtgtttcttgtgcagcaaactttctagcggcttttgaattccgatttgctgcagtacaaatgataattttgctctttatgttaacttctactttgacatggtactctccatcagctttcataggtttcggaaggcctaa

SEQ ID NO: 55416 - DNA, 1501 bp, Oryza sativa
cttcaaacaaaaaatgagcactttacattcctactttcaagcttgattaacttttatagtgtctggtcttttgcaccggtgcattttttttattcatataaacatgacagatgaactaagaagttgtttaatgagaaaatatggtaattgttcttttactgcaatgagcacagctggccttgtcctttgcattggactttataattcatttgagataatcacaattcatatccacctagcaagctttcatatttccactatatgacaagataggtgaaaagtataaaatattgacctccaacactgtacatcagaagagcgtaaaagtaacagtaagctgctatctttgagtgccaaaagtaaactataaaagtctaggaaataattaattccaatgaagttagtgcaagtttgattatgaaagtgagttaaaagcttgcatttatttggtttcagccagtggacttcgatccagattcgttgaggactcaattgcccaaagcagtcgcatcactagaatgggctatatcggaaggcaaagggcgtgtctatgtccattgcactgctggacttgggagagcacctgcagttgcaattgcttacatgttttggttcgagaatatgaatgtaggtttcatcttcttgaattcttaacttgtcagggttataagccaggccacattcttagcatttatcttttgcttgcagcttaagacagcttatgagaaactaacttctaaaaggccctgtggacccaataagagagcgatccgtgctgcaacttatgatcttgctaagaatgatccacataaagagtcttttgacagtctgccagagcatgcttttgagggcattgctgactcgagaggaggttaattcaagaacgggtccgtgctcttcgggaggcttgagaagtaaatgaaaacttctccatatccttctattcaagcctacaggtcaggaaatgcagtaaacatatgatagaactaaataaacaaatctgcgcaaattgaattcattatggaacagacaacagcagaaccttagctcctctagtagtattcttctttgctgccagattgctagctggtgcagatgaaaaggttttgattcacctatcctcagaataaagctcagacaagatctaatttagtaggtatctgataataataagaatgacaaaataaggaggtgccagaagatggcattgctggtctggatgatcttggttcttggttgcaattgcgtagtcttaatggcgaccagttgtgtaattgggaaacccacacgcacatagtgccttgtaaattcagagtatcgaataaggccgtcttgagactgtcactttgctcatgtgtacggctattgctgttgaaagtgaaacacatactattgctgaaagtgaaaattcatcatatcatcgccaaatgtgatgtatgcatgttcagaggttgactgcggatgtttaagtttactgatatttatgttttcctgtcaattt

SEQ ID NO: 55417 - DNA, 1501 bp, Oryza sativa
tagcaacacccaaaacagtaggaggatgtctagaattatgagcataaggatcaaaacctaaaccatgattgtgtgtgctaaccttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcctccatgtgtttaacacgccctaaagcatctttcaacttcatctcattcaaaacacactttgaacaatcttcagaaatcaaaacaccattgttttgttttgccttatttgcacatgaagcattcgccaaagaacttgcacaaaaagcaactttgtattttttcaaaacattctttgtcaaaatcaactcatcaacaacacaagcatgtaaagcaaacccaagagcaaaagaagattccaattttttagatttttcaatctcaaattctaattttttgcaattaacagaattgacatctcgcaaagcattaatttcagaaaataaaacttcacaagactgacaattatcatcatcaggaatcgaagattttaatctatcaatttcagcatttaaaatctcaatagtgtgatccttctcatcaagcacaatagaacatgtttaaagtttttttagcaaatttgtaagcagcaagttctaattgatcataactatgcttttcttcattatcatcatcagattcatcaacatgagaactttcattacgagcaataaaagctagatcaacaaattgcttacatttgccctcatcttcatctttagatccataaaaaacttttatgagttcttgaattaaccactgcatgcaatgcttcttcttctccttctccttcatgttcttcttcttgttcacgtcatcctctttaactctaccatcatcttccttcttgcctctcccaagcttaggacaatacgagcgaagatgatcaagtgcaccacacacaaaacaacgattcggttctcctcttttcctgttcctaacattttccatagctcgagaaaatttgttagatagcaaaaccaagtcgtcctcctcgaactgttcgagttgatcatcggacatggcattaaataaagcaagaacaaaagacttcgatgaagaagtaccaacattcaaagaagttgaagacgaaaccaaagcactagacttagaatcacctttacgagaacgaatattcatctcatgagttttcagttttgtgtaaagcgaatccaaagtcaaagtagacatgttcacaaactcctgaataggtgtaactttcatctcccaaatagacatgtcaagaccaatcaaaaagtgacgagaaatctcagattgtggataattagcatcataagaagaatcaaaagatctaagatcactctaaattttattaaacctagaaagatagtcatccaaagctt

SEQ ID NO: 55418 - DNA, 490 bp, Oryza sativa
agcagattgagttgaagctgcaactatctaggaggaaatggatccatgcagccgtgatgtcaaattaaacagtaacaatccttgaaaatatatagttacatgaaaataggaagttgtatacttaaaaaaagaatgctaataaaccgaaaaattataatcactgctctgagaaaacgctccctgggtttgacaatatttccctcaaattgctcaagctgagaagctgcattccaacaccatggaaaatgagaaacgaagcttcatgccaaccatggcaccatcaccccctcctcccccgcctatcccgaagaagccgtgagctcagcgaagctccatacgcccgctccaatctctccacgcatatgtaaagggggggatttacacgtagctcaacaacaaattaaacgcctcacctccttaagaatcgattcgaaccatccgggtgtgaagcaggacggacacgaaatcggacgggggaatcagatcgaaa

SEQ ID NO: 55419 - DNA, 1501 bp, Oryza sativa
gaaaagaatggtgaagtattgtagttctccctatgtgtataactaaaagtgagtacatgtttgttcttctcttaatttaagagtatagtatttacatagtagtgtattacaagtcggtgaaaagaatatataaaaataggattcatctcctacaccaagaaagaaataaggctgccagttaagatcttgtttataaatgcaatatttggatatcatcatatttttaagtgtatcatactaccatggtcctaaatattattttaattatattaacatccatagtattaatgtattataacacctattgagtaattaagcacatgctttctaaaagtgtacacaaaatgttcactttccattgttaaatcaaagtgtttgtcaaatactatgggttgctttcaagaaagagagtctagtatttagttttattgtccagtatattgtcctaggttttgaaatggaaccatttgttatattagaattgccaccttgcctatcacacactcatagtttcttcaacatgaagttttctcatgctcatgaaagtgtctctttttttattgtggtatgtgttttctatagagaaagcttatgcttacaattagcactatcaataagcaaaagcaaaccaaaatgaaataaaatttaggtagtgatgttgtgaaatcgtgtggctgcacactaaaaacatatatcaacgatataatcgattataaatgtatacataagaagattatactcttttgattacttagatacacatagtatgcactaacgatataatcaaacctaaactagttatgagagggaacctatttaaagacaactttttggtgcgtatcagagatattatccttcaggcaggattagtaaagatcggaatggagaagggggagctcaggagtccggatgtagccatggcaaaaaccctagcttagccttcgggttgccttgccccctctttttgtttttcttgtcttatttgcctttctattttttgtcttctcttcttgcaaagcatgggatagagcatctagacgcaactccatcttacctcttcccatttatggtcttgacatgaaaacgaatggagggttaagataaaataaggtaaaataaatggatggttaagattaaacgtttttccaatgaaccgtatgagacaatgctcatctcatcgaatatatctaaaaaaggattacatcctggaataaaaaaaagagaaaaaaaagagtgactacataaggttaaactatagcaagtgcttctctttggcaaacatcaacattgtcacattctctttgatttttgcaaaaaggctagacaacaaggttctcttctcctggtgctcaaacgctctttgatttcttgcttttcagatacctacgtgattaataagacgagtgtgcatcgtcccaagtcgccgggatccagaagccgcgccaaatccgccgggaatcccaccaccaccaccaccaccaccggccggtctcctttctgc

SEQ ID NO: 55420 - DNA, 1501 bp, Oryza sativa
gccattattagaccacgcagatcgaacccccccaagtcatgaagaagattattcttcatacaaggtaccgttttatccacaaacaggccgtctggcacaatcagcttcgtcaaaatcttgtttctttgcagaatccaagataattaaaataagtagtgagtggctttgatgctgcaaatacaatacaaggcaaggcactgaatattctttgaaagagatggctgccatttcctttgctttgctttcgtttctgcttgtgctcaccactcaccaccagcccaactgctcccactctgcatcttacttctgtgtatgcatgcagtcgagtcaacatacatcaattggctggcaagcaccatccatgcaaggattgagcacaattttctgagtcactagtctttggatgcggcttgtgaaagataccaccatattctgcagttgtatgcaaatgcaaatatcaattcgaatgaacggataggtaacagaagcagttgaaaacaccattgacatccggaggaaaagctcctccaaattgaacaacgaaaatattcgacaatcaagagaaacttccaaagtttggggggtttgcatacatggaatgtaggattggttaatgatactcctctatcttcctaatagttaattattttcatgttttaaaataaaagaaaggagatcacactgctaaaagtgacttaaggtgcacaatttgttgacaaagtatctccggctaatgaattagttcacacctaaagttatgacccaactgatcatgcctaaagtacatatattatctcaatgcagccactctaatttgtggactactacagctatttgttgatatcatagttcgagttttcaataaccattagcaaacattttacccaatagtttaaaccacaacagttttggctaggttgtactacaaactacaacaacgatattgtagaagaacaagtcaacctgaacaataagaaataacaagttcagtgataactgataagatcattcacctaccatccagcagaaattcattttttttgtcactcgagtcagaacaccacaaattcaattttctccactacaaaacacctccattatacgattacactattaattttgtcaccataaaataggttaacattcttttgtacagaaagaggtacaaaaccacacaatcttgtttatactaaaagggagcaaacatatgtgcattcatggataatatttacctcgagtctccagagctatccatttggtttttcagtaattcttctagatggttacatcttagtggagggatcaaaagaccaaaccacaaagggtatcttgtcatgttggcatgcccccatctgatcctctccacttgcatgcactttctgactgtagagttttccattaattagcctgatacaaaaaaaaggaagatcaactaacaaaatgcaaagaattacaaagccacaataatatacatatgacaaattgagcacgtgcacagaat

SEQ ID NO: 55421 - DNA, 1501 bp, Oryza sativa
aatagagatgcaattacgaggggataggttatgggtaggtagcaccaacgaggtgtgctaacgagtgatggagcacgtggtagatggcatgatatcgttgcatacattggttaagcttctcgagttgatctaccaacttaccaagaaacaatgaaagagcgtgagaagaagaatgcagacatatctagaggttagtagaccaagatttataatctttgtacttcaattctcacaaatcaaggtccatatgtgacttataacaaggtaggtaaattatactccctccgtctcataatataagggattttaaaaaaaaattatgacacatcctagtactactagttagacatagatagcctatctagatttatagtactagaatgtgtcacgtccttttaaaatctcttacattttttttatctcatctaagcaatagccggttttagttgtctttaaaaccagcttagaaactgaatttattgcttgattgcatttgcatagtgtataattaacctccatatgtataagaacatctgaaacttcagtatattaaaatccgttttcacgattttgatgaacgcctagtctgtaaggatataaatgttcctgatcgtgtatgatgaaatttataacaaatatggttgtgggttaccggaccaaagtttataatctttgcgcttaaaaaaccgataggtttgcatgtagtgggatgtgcatctgtacgccttacctctagtagccaaatcttttcagatgcaactccttatcatgtgtcttttatcttgacaagaatgcatgatggaacttagtattagccttgttgcccaatctccatcttttgattgttgaccagtctctttacatcttaacagctctttaacttttgttaatgatgtcttgtcaagctaagtagcttaactagctagcacactgtaggccattgacttgttaatatactgtagatgcatggtctctgttttccttctgcagtatactagagtactagacatgcatgcagatttggtcttgtttgatcagccaaaacctccattgattgcggtccaaaagcagataaacccactacctgcatgatcgaatgcattcggcagccatgtagcactgaattcggttgactaagattgtgtttagttcacgagaagaaaattttttgaatgtcacatcggatgtttaatcggatatcggaaaagatttttggacacgaatgaaaaaattaatttcataactcgtctgaaaaccgcgagacgaatttttgagcctaattaagccgtcattagcatatatgggttactatagcacttataactaatcatgaactaattagactcaaaaattcgtctcgtgatttccatgtaaactgtgcaattagttttaatttttatctataatatattatatactacaagaaacaagctagacgtcttgtcatggttaattagctaggtaggtagttccagaaaaggtttcttgccaaagtgcagcc

SEQ ID NO: 55422 - DNA, 1501 bp, Oryza sativa
tatttgatttagctttatttttaaaaatgcttatattttaagatagagtgagcatttgatgtctctcatggctgttactatcaaacattaatcaatcattgtacttaacatctatcagtttcagttttgtgttataagtaaaatttttgtaacttaaatcaaatttacataaaatatgcaaacgtttacaatatcaagtttaactgaaatctactgtgaaacatgtcttgcatagtgtattcatttgggaatgtagatgttacttacttttttttccctatattttgattgaagttaaagaacttttaattcagaaaaaaactaaataaatgttacaatatggggaactttttttagaacttacaatatgtaactgaggggggtattttctaacactagcttccatgtgcagattagttaactatatggtcaacagcttcaccttaattcctgtgccaccggctgctgctattatgtagtagtagtatgtgatggttttcgttcgcacgtccagttgcatgtactttacaagataggcgtaccgcaacatgtacactatagactacttatcctcggtcgacgtgtcttctcctgcttcatatgtttccgccggttgatgcttttatatggactttcttctagagacaccatatttctgttatatcatgcatgagtgttgtctaagtttctatatttaattagtaaactaactggattttgctaagaaaattgcatggaccaaggtctaaatttagttggaagtaatactgtattaatttgatatatacctttgtttctatttctgtaaatatatacagctgtattttgcgagtaattttatcacctttgaaaagataggggatatcatattttttttatataaaacatgatattcctaggtacttaatatctataggtaccaaaatttttaattttagtgtaaaatttgttacctacatgtactttctataggtactttcttaagtaccttaaaatttattttgtttatatgtagagtggtcaacctaaaatgaacggtattaaatttttgtcctttaatttgttcttgttaacgtattaatttggtggattttaggagtagtgtacttttggtcttttttttaacaaatactataaacttacaaatggttagaatatgtcgaatatactagtcctactagaagttggatttgaagttagaataggtgtaggatacagagttagaatcggattcctgtcatatgttttctttaaatagaggggagcaccacaatgtaaccatgtcgactacaatgtgcgtagacacgtcatggactcataatggcttagttgccatgttgattggggagaagcatccataatcagagctctggagatatgggcttcggttgaacctcgttgacaaatatcgtgagttcttgtgtcttcatgtaatgtgtcttgggtgatcaatgactgaagtgattgagaatgttagtcgttgttccgctatatcaactaa

SEQ ID NO: 55423 - DNA, 1501 bp, Oryza sativa
gtgggtaaaccatgcccgacctgaaaattttttagcccatatatatttttcaggccttaaatagttttatctcctcacatggcctaatagtccatttgacccctttgtatgcaatatatatattcactaaatgaaaccctagcatagaaatccccaaatcacaaaccttatactcctcactgctatctctcactccctcagtcttctactcttctccagtgtctacactaggcggcggcggtggtgcacgggaagggagcttggccacatgacgtggaggtgcaagggcgcaagcgacggctggcggtgcggtgatggctagcgacgtggcagcacacgggactaggaggtggctggcaacgcgaacccatcgggcatgccgacatggggttttgtccaatagactttgcggcgtgagtcgagcgtgggcacgtgggtctcaggccgggcttggattcactctgctaagtatgtttcatatttttatattcccaattagagttgtaagaaaattatatggcacgataattagtagtagtacccaactcgaggaggtggagaaggtgcgagtgttattcaaaatcggagggagcagctaaattgaaaaaaaaaatcatgcgactaaacaataatactactaccagtaaacaattcagtagtctagaacctctggctgacctcagcttgagttcggggaggaatcgccggcggatcgccgacgtgcagccatccgccgcgacgagcaaatccccggcgacctccaccgtctccccggtgcgcagcacgcgggccgtcaccacgaccccgccatctccgtccccttccggcgccatctcgaacgacacgaactggtggccccagagcacggtcacgccggccggcagcgcctcgtgcagccgccggtgcaggtcgccccagtgcgccgccctgaagccgaacccctcgtccctcgtcagcgtcctccccgccttcgtctcgccgtccgtcgccctgttctgcgcgcgcgccgcgctcacgggtgggtcaaggcaaggggaagggaggaggaggaggccggcggatttacaggggggagcttagcttaccaggtcgacggcgagcggcagcgtggcggcgtcgaggcgcccggggatccagcgggcgagcgtctccatggactgcgcgtcgagccccagcccggcgcccgtgccgttcccggcccccggcgccgccgccttctccaccaccaccgcctcccaccccgcctccgccaccgcgtgcgcgcatgccagccccgccacgctccctcccaccaccaccgccactcgcttccccaccatctcgagactcgagagagaggcacacacacaaacacctacccttctctcccgtgaggctgtgactttccgctctctatataggaaaagattccccccccacgtcttggccgcgtcgcgtcgccgccacccaccccgcgcgatggcaatggcggcggcgaggaggggccacgggatgccgctct

SEQ ID NO: 55424 - DNA, 1501 bp, Oryza sativa
ccaaattttggaaattttcgtcccaaagatttttcaatcattagggaaaaattatacataactaacctcaggaagcaagcagagaagtccacatatcaatgcgcagtaatctaaacccgcggagctgagggaggactctgctggccgccgccagatggcgcaaacagtttaatcggaggcggcggagctcgggacgtagcagggggagctacggcgaacagctgaactcgcggaggtagggaaaaagagaactaacggacacggccgagatggaggcgtggagcctcaccgcaggcggcgccgacgagggcaaggaggcagaggaagctgtggagggggagaggggaggtttcggctaggtcgatgggacaagaatttgggaatgtagccagataaggaagggaaagggaggagagatccaacggttgctggagtgccatgtaagtggaggcccatgtaagatctgtaatgacaaaagaccatgtaagatctggtcgtgtaagagttctcgccgtgcgtattaactaagccgtgtaatcggaaattgacttttccaactttacggctgggggctaggatcagtgcttattcaaccaaggcaggtcaagggtccaagagccttatcctccgagaatgattctccgatgacaaggctgggggctagggagagtgtatgactctacaaactgactgatcggagtcggtaagagagaagacactcatatacaaaacactggtctgtacattcaattcattagtctgtcatattataatatgtcaccctttgagcattcgcttgggggctatttctatctaatattcttttctgagtattgatttcaggaaaattatattcgacattgacgaaggctccatgtctctatggttctacaccaagatcgactaaggcgagtacgaccaatgttgacaaggctctgtcgcagactctacgccttctcgatcgctcgagaacgattgctggatctcgacaaggaatgcggaatgaagaaatgatgtacccgccgagataaaatttcttgactttaatccaaattctcgattacagcaagacgggaaacttagtcgtacgctctgtactttctcggtcaacatcaaagattgacttagacaaaccctttcggtgcccgcacgaagctgacaaaggaagtctaacgttatatctgaactcaccgaaaacgttcacatgagctcgataatagttactccaaagtctgcgcgcaattgagaatatgaattcgttcatttgcattgaagtcgggggctactgtcagggttatggataccacatacctaatagtagttgactaaatctcggcaggacccaccacataccatgtcctatacggaaacagcctacggatataggagggagttccggataaggaaagacaaccagagttctatatggaaacgacaaggactactcggattgtattcatattggtttccctagttctacttggacaaggggacacctatg

SEQ ID NO: 55425 - DNA, 1501 bp, Oryza sativa
ccccttgccttgacccacccgtgagcgcggcgcgcgcgcagaacagggcgacggacggcgagacgaaggcggggaggacgctgacgagggacgaggggttcggcttcagggcggcgcactggggcgacctgcaccggcggctgcacgaggcgctgccggccggcgtgaccgtgctctggggccaccagttcgtgtcgttcgagatggcgccggaaggggacggagatggcggggtcgtggtgacggcccgcgtgctgcgcaccggggagacggtggaggtcgccggggatttgctcgtcgcggcggatggctgcacgtcggcgatccgccggcgattcctccccgaactcaagctgaggtcagccagaggttctagactactgaattgtttactggtagtagtattattgtttagtcgcatgattttttttttcaatttagctgctccctccgattttgaataacactcgcaccttctccacctcctcgagttgggtactactactaattatcgtgccatataattttcttacaactctaattgggaatataaaaatatgaaacatacttagcagagtgaatccaagcccggcctgagacccacgtgcccacgctcgactcacgccgcaaagtctattggacaaaaccccatgtcggcatgcccgatgggttcgcgttgccagccacctcctagtcccgtgtgctgccacgtcgctagccatcaccgcaccgccagccgtcgcttgcgcccttgcacctccacgtcatgtggccaagctcccttcccgtgcaccaccgccgccgcctagtgtagacactggagaagagtagaagactgagggagtgagagatagcagtgaggagtataaggtttgtgatttggggatttctatgctagggtttcatttagtgaatatatatattgcatacaaaggggtcaaatggactattaggccatgtgaggagataaaactatttaaggcctgaaaaatatatatgggctaaaaaattttcaggtcgggcatggtttacccacaggaaaaacccgcgcgcgcctactaagttcgcgggtatcggatcgggcgtgcccacaggcaaaaaaaaaaaaagttatccgcggatacccaaacctatgagcaatactgccattcctaagattttgggtgtgtttgagagaagagatttttttaaaaaagtatataaaatgggatgagccattatcatatgattaattaagtattaattttttaaaacttaaaaaataggttaatatatttttttttaaaaaataactttttaaaattatcttttttaaaaaaacgtatgatttagtggttcggaaaacgtaacgagggatttcttctctctttcatcctaaggaacagccttagtgatattaaggatttacgattgcctttcatctctttcaacgtgtgttttcgggcgcattcgtggacgatagtgtggtgcatgagtcgtgatggtgtgtgcgtgtgttttt

SEQ ID NO: 55426 - DNA, 1501 bp, Oryza sativa
ccttaactacctatctactatggtgcgacatgtttagaaaaagttaaatcttatactataattccatttcttacacattaaattatatatacttataatataattttcaaattatatagtgcactattcacattttatatgagaaatatggaaaagtgatttattatctatttaattatgagagaaaaatattagtccaaattaacataaacatatagaaaataaaaaaacaacaaaagaattacggaattactccgcacactaactctctctccctccattttctttttccctctaacagttagtgatcgctagatccagcaataaacaacccagatctagcatctccgttttttgtaaggttggttcatgcctccctaagtctttgcaagcccaacaatcccaacctcaacgacgacgatgacaatagtgtgcatggcgataggggaggagaaaagacatggctataactatagggtgcagctacgcatgcaaaggcggagaggagaaacggtggtggctcatagagaaagagcgctggtggtggtgcgtggagctgtagttagtggtcgcgggtggtctgagaagtttgttgtcgacacaatctctaactgagtttgttaatgtttttctgatatatgggccaccagtcatcataaaaaatagcatagtaaggccctgtttagatacctggcaaaattttacgccctatcatatcgaatgtttggacatatgtatggagcattaaatatagaaaaaactaattatacagattacatgtaaattgcgagacgaatcttctaagcctaattgtgtcatgatttgacaatatggtgctacagtaaacatttgctaatgacagattaattaggcttaataaattcgtctcgcggtttacaggtggattctataatttgttttattattagactgtgtttaatactttaaatgtgtgtccgtatatccgatgtaatacgccaaaactttacatctggatctaaacacagcctaaaaatattgagatatacgtggaatatcagtatatgccactcaattcgcggccctatgatccaattcgtgtgtaactttggaacctgccacgggagagcgaattccttcgtttcactccatccatccgtctgcccatccgttttacgctcgtccgcgaccgccgccgccgccgccacctctaccaccgtacccgagctcgtccgccgccgtctccattagcgtcgtccaccagctcggccgccgtccccgagctcgcgtcgtcctggtgagcctctttctgattcatctctctctctcccaccccaccgggacaatttctgtctgcaatttgctcacgttcgttcgttaaccctagcttctcttctagatctggaagaagctatttcagagccttaaccttaatacaagtaacagtttattgtttgtttcccccaaaatttgggggttcccaagttggatccgccccctgcttcgtcgcaagagaaattct

SEQ ID NO: 55427 - DNA, 1501 bp, Oryza sativa
ccgtcttcgtccacatctcctacggcgtcctgctggccatctctgctggcacattcgccggccccatcgccggattcgccgtcatgcacctcgcgacaggctggacggccggcctgctcgggtacgccttcgccgagcacctgcagcacattggcaaggagaaaacggccatgcgcatggctccccccaccttctcgaccgaggaggagaagagttccttcgagatacatcgtagtggcgttgtgaccttcttcgccgtcttctctatgcttgtggctacggccatggctctgctagtgaaggtgcctcctcgtgatctgtccctgctcgtgatcaatctctcggttctggaaggcacagccatctactgctgggcggttttcgttgcaaagtttgcgctgttcgaagccctcgtcacggtcgatcagcttggctacatgatgttctacattggcgcgtatctgttggtgagcttccttgtatgcctcatgagctatcttgttttggctggcgatgccattgtcggggctatgtttttctggttcctgatgatggccatggctggattgattggctacatgctctccgtgcgtgctcagtacaaccagatggtcctgtcaaggtaaacagcaaaactaattgcatgtgtttgcaaacaatctgtttataaaaggacgcttctcgaataaatcggatggccgcgcaagacgtcgctgggtaagactaagatcgaaaggcctctctacgaggaaggagaaactggttgcaataggaattattcgactagtaattttgttacaagagaagcaatacgagaggtgggctgggaacgatagtagtatttttttagaagtactgggaacggctgagaagaagggaaaaaacggaacggagagaggagcgggcctgcaagggaggaaacggaaaaaagggaaaaggggattaattcgggaaactattcttaccccttgaggggatgttccctcgtttgcttaaaaaccatctaaacggttataaaaaattctgaacaaatttgacaacattcatacaacacatatatacaactccacaaaatcttaagtccaaactcaactcacacgtcgagatataaaaaatacaaattcagcgtatgaatagtagcgtactgtttatatctaaatttgtcttttttatttctcgatgtgtagatcgaatttgaacatgaattttggtggactagtaggtatcattatactctacattatcaatttttttcagaatttttcacaactatttgcatcaaatttggaagaaaaagatatacaaggggatatcccctcgagggattagaatccacactcgattaatcctaacgcgcagcgaattagcgttaccgtattttttttcctttactttcctttttcctctttcctgttcctttgcacgcctttcctttttcctttttgggtaatccgaatcctctccttccgccccgctacccgctacgggcagctcctcctcc

SEQ ID NO: 55428 - DNA, 1501 bp, Oryza sativa
tcaactgctggtgtacggacgcactatgaacgcacagtgcctaggatgcgtgatccgcttctttgcttcgcccagatctcttacggtaatttttatttttcttcctcacgtcgacgagtcgatcagatagatctccgatgtggcaaaaacacaacgttcgcctacgtacgtacacgttcgctgaaagttcggacgcacgccgtacgtacgtgcgacagagcttcgggcaaaatgttcagcatggacagatagtctatacagccatacaggtggcttgagtcagatatgatactgttgaagcagtccacagtataacaatacgagtagatagtctacagctcgtttatagtagcattatgtactctccccactattacaccgtgtttagttccgaaatatttctttaaacttttaactttttcatcacatcaaaacttttctacacacgtaaacttctaattttttcgccacatcgtttcaattttaaccaaatttttaattttaacgtgaactaaacacactcttaaatgggtgatgcaatgatgcatgtggagcaatttgcttccgtaaattctgaacaaaataattgcgtgtatgtgatcaagccacggtaacgtagaatacagggaaaggaaagtaggtgacgggcaaggggcagcaaatatctgtctgccatattgccttcgatgtgtcaggtcagcccgatgacacgtacgcatatgcacatacgatcgcgtacgacgcagttcaagaatcagcagttgatagagttgtttattttgataatattatattactatctaagtgtaaaaagattacaaagattcaacaatataaatctatttgcttacttaatattagttttaatttttttatcgaaattgctacaaatagaattactgaggttgttcaaaaagtaattagcccaactcaaactttcatacctgagaaaaatatcatggaaatcttagcaacaaaggctggaaaataattgagaaaaacttagtagttaaatgattattacatatcatatcacgtttcttttggcaaggagatgaacataaaaagaaatatagtcttgcatgatgggatattatatgtctgacaaaaaatcagggtggacttggagtttataattgaaaattcaaaaccaatgtttattgaacaaatggttgtttaagctaataaattagcaatgtgtttggcaagatttattgaaaaaaatatacttcgataatctatcaacaaatcaagttgagaggaaagaaggggtttcctattttttgtcgggacttatgaaagttaagagtacattcttaaatatgggttcctagataattaataatagtgaacaagtcagattctgcaagaataagtggataggaaatacctcctttaaagataggtacctgcctttgtattctatagtttgaaggagatactcttcgattgcaaatgttatgagttctgttccgctgaatgttttttaaagagctttagt

SEQ ID NO: 55429 - DNA, 477 bp, Oryza sativa
gcccgccgccgccgccgcccaacgtcgtcgtcgtcgtctccatggcttgctctgactttggtcgcgctcgctcggctcgcccgctcgcgtttgtgatgcgtttgctgcctgcgagcggccgcgggtgcgtggtttttaagcgtgcatgggagtgtgaggaggtgggcgatgggtgggccgtagcgcgtgtgcgcgcgcgcgggcggcagggggaggcgtagctagcgtggggatcgtgtcgcgttgcggtcaaggggagcgtacgtttcgacgttttcgtgaggacgggaggagtcgcgtgccgcccctgtgccgtgcgccgcgtagatcaccacggcgagtggcgtgatccatccatgcgtgcatgcatcgtcgtcggtactccaatcgatggatcaagggcgtacgtgcccattgtgaagtgaaatgaaaagcaatttttcactcgtgaaaagggccttttccttcgtgtacgcg

SEQ ID NO: 55430 - DNA, 1501 bp, Oryza sativa
atgcgtagctagaggctaaccacgcgcgactcgcctcacccaatcgggctccggtgagcagtggcagcgtgagcgtcgtcgtcgtcgggtgtccctgactagataggacatggattgactttgatcggcgacaaatcttcaagagagatccgaatacccggaaaaccgttcgccctgatccgacttaaaaacttcgacggccggccggttgggcaaatcaaaacaccggagcaggttaaccgcgagcgagccaacgctagcgcgaaaccacaaagatccaaagcccgtgctggttagttgccgtggtgcagtgcaggcgcaggtagacgccggtggaaggcgacgcgagacatccgcgtcaaagaaatcctagaattccgggcacgtagcgcaacggtgcgtgtgccatgatcaggagattgtcaaaaaaaaaaaaaaagacaacacttgagagctgttgagcagctgctggaacagacattctgaacggataaaaataataacgggcacgagaagcatgagtacaacgaagttttctgggcccaacatatattttttccttggttgattagcaccgtgaaatagtgcatagaggatcgatcagaaaaaaacaggccagtgcaaatgtgtgcatgttgttggtatgcatgctcaacagggatgcaagtgggtaatccactacccgtataaaaactcgcttgttagtatatttttcgtatgatagtttaaaatttagaagaaaaaattaactaaaagtgagataagcgggaaaaaaagcgcgcttgcccgccccacttgcatccctaatgctcaaggattctagaggtgaaaattagggatgacaattgtgcccgtttgcccgtttatccatgggtaaaaaccctattagggttgggtttgttctccattttatacccatgggtatcttattgggtcaaaagctatgcccgatgggtaaattggcatgggaatgggtaatcactacccatgcccgctttgcccatttacccgcaaaatctaacttacatgtaggctaggagcaaaatccactagaatacataagccacgtttttattttctacggtttcccttttatttcccttattatttctctccctttactctatcgccgctagaagagagacgacaccgaggcggagaatatttgatgttttaagttcaattcgaacttagaagcttgtagactttttgttccactgcttttgttgtggcgggtaaacgggcacgcccgcgggcataagacgcccgcgggcaatgggcaaccatccttacccgtcatgtagtaattgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaa

SEQ ID NO: 55431 - DNA, 1501 bp, Oryza sativa
aaggattgttgcgggaacaaagtaagaatcggctggagtccagatcggctacgactagaatcggctaaatctgaatcagactgggttaggtgatacaaccgattccggcaatacgacttggtgtacaacatcgggttgagtcgatatgcttcaagatgatttccgcacatggatagagtcctgagaaggcaattatatctattaattaggatgttttacgtaatttccttagagatatgcttagggcaaaagtctgccgtaaagacttatggtatcttagagtttgttagagataatagtcgcgtctggtatggacatatcttgtaattcttgggtataaatagaccccgagccctatgtaactttaagaacacacgttcaatacaatctcggcgcatcgccacccttttttgctttagtgttatttcgacgagttcttgctttcgggttgagctgcatcggtttcgatcttcaacaagaggtaaaacttgttatgacgacttgcgttctcgggattagtgcttccatctttatgacactctaatcttgtttatgtaattcgtcgagttatcatatatcctacataatccctggcaatattgatatctaacctacaatcggctaacgtccgtcaatagaaggcagccgattaagttaaataccgatgttgacttagattatataggatatctaccactctatgacacatctaacggcttgattgtctagatattgtccttcttttcatacttatacctacatcagttaagtttgatcttatgagtcgtgattagaatctcaatctctagcctgcttctcggttgctgattagggtagcatcggagtttcagccgatcttacctgatttaactactttttatcttatatgcttgattgacatgttaaatctgccctttacgttaagatcttcctgcatttaagtatattaggctgttgtttagtatattctacttgctttaatatcttaatataaagtggtatcggagtattagccgatacatgctagatctatctgatcggctatgctatgaacgtatatagtctcattattaatatatattttgatctaagtgatttatactgtctcggcatggcgaccgatctatcccaatcacttgatttaagtatatatcgatataaagattatatattagtaatatctgcaaccgatcgagtatatttagtcccttcttatttattaatggctgccgatcgatgcatatatgacatcggctcaaagataaatgatatgtcatcggcactagccgatcggctatcatttttagatttaaccgcgatttctttgcttctacttcttgttggttacaggatcaaatcaactggcatgctagcacacccgaaggcgagctttggacctgcactggagttaagcagatctcccaggcctcgtgttttctgtcaacacgcttttggcacgcctggtgggacaactaagaagtcagccaacaatcctccctca

SEQ ID NO: 55432 - DNA, 249 bp, Oryza sativa
gccgctttcatgatattgaagtctgttcttagcccgcttccgctttctagttgcccgcttttctctctattctgacgctagtcgaaaaccaacgctttaagacgctatcggagactagcgatttctattgctgcgatgctaatatgcccgcaacttctattgctgcaatgatgattggaaattgcaagtggtagtaacttacacagcaaaagaataggaaatgcagcaaagataataactagcttgcac

SEQ ID NO: 55433 - DNA, 1501 bp, Oryza sativa
ggcccttgattaaacgaaaaggcattgatggtgtttgaccagaagtaagaagcagctgccatcaggggttcatctttggccgagtttgctatagtgaggtcaagtgcttggccgattccaatttcgtcccagtgaacccttttgcttgctgacacacgtttgaaccatgtggtccaacttttctcgggtggaactttctctagagatggccaagatttaaaggtgttattccaatgacctagatctgggttggttagtctgaagggaatcctattggtttcaccaatgataaactcagtgggatcaggattgccgactgggccgagaaagtagtagttttcgtgtgataagcttggaatcgcgattcagttagagagatgctacaaatccaagacaaccgagagaaagagagcgatataagataggagaaaatcgatctgctgctaagaaaggggatctagccagtggagacttacctcagcatactcggccgatggcacatcagatggattggtggaagacgacatcgctgcaggcggaggtctcgctggagatgaagtcacccgggagtcgcttttgcgtcggaggaatcgccggagagagagagaggataaagtttcgcttgagcggtgaaaacagaagtcacggtgtgagatttctcgagggtgacggttagtatttcaagcacggcaataacggtcggaaaacagcaaagtgcgaaacttgctcgaagtcagtacacggcaaatccggaacattaccaaatatcccggacttggggggcatgtgttaacaaccgaatttggtaatatcagcgtcggaggtgaagatgggatcgaagcggagttggagataaggattgttgcgggaacagagtaagaatcggctggagtccagatcagctacgactagaatcggctaaatctgaatcagactgggttacgtgatacaaccaattccggcaatacgacttggtgtacaacatcgggttgagtcgatatgcttcaagatgattgccgcacatggatagagttctgagaaggcaattgtatctattaattaggatgttttacgtaatttccttagagatatgcttagggcaaaagtctgccgcaaagaacgtatatgctataaacgtatatagtttcattattaatatatatttcgatctaagtgatttatactgtctcggcatggcgaccgatctatcccaatcacttgatttaagtatatatcgatataaagattatatattggtaatatatgcagccgatcgagtatatttagtcccttcttatttattaatggttgccgattgatgtatatatgacatcggctcaaagataaatgatatgtcatcggcacctagccgatcggctatcatttatagatttaaccgcgatttctttgcttctacttcttgttggttacaggatcaaatcaactggcacgctagcacacccgaaggcgagctttggacctgcactggagttaagcagat

SEQ ID NO: 55434 - DNA, 156 bp, Oryza sativa
caactaatttgagattatctccacgagtttggttgaattggacgcgggatcggggtggcgtcacgtgttggctggctctggctcgactggagcttgaagaagctactgtagtgatagggacataatcagacttctgctgggacttcttttcgtagg

SEQ ID NO: 55435 - DNA, 1501 bp, Oryza sativa; identical to SEQ ID NO: 25003

SEQ ID NO: 55436 - DNA, 930 bp, Oryza sativa
cgaacgccgtcacgttgaagcacgcctgctgcagcagcgcggcctcgaacgcctcggcctcctcctggctctcgaacgaacacccggagaacaccgcggcggccgcgccgccattgccgccgcacgcaagcacaaacaagagcaacagaagcagcgcgccggtggacgccattgtcgcggtcgcaagcagcagtttgctggcgagcgaggagtgtgtctcgccatggccgcgaggtgtgccagtatatagagtggcaagcgtgcgtgctctggtcttggtgcaaatggaggcaaggtatagtttgctgcagaagaaaggtcgtgtgcagcatcgaagcctttatcaacaactccttttcgccttcgaggaaagggacacggatttgagcccaatgattggcttaatttaactaacttcgtgtgattgtgcagcacggctagcgttattgtcaaaggcaaagtctagtgattgcggtaacctaagtagcatcctaagatattgaattcaaatctctatataagcgaattttagattgtgttatttaagtggctatggttctaatttaaaaagagcgaattttggattgtgttgttttaggagctaagttttcaattttaaaatactgtacatatctaattagatgtagaggacgggtaaaaaatactcctgtaaataaaagcgtgactgtcaccggcttcgctgctgaagaagaagaagaagaagaagaagaaaactaaatatggatagcacaaaactcggctgaggtcgtcagaggtcaaacgaaacgaacgattttggacaaatatttgatatttgaccatgacattctagagtacaagataacaatgcgaccagtatcgatcactaactattgctgttgtgtactgacagtttgttgttaggacatgttggtagctagtgtcggtcga

SEQ ID NO: 55437 - DNA, 586 bp, Oryza sativa
ttcctgcacccctccaaaacacaactttaacttcttgtttctacaaaaatatttattaaaaagtgatatatgtatacttttatgaaagtatttttcaagacaaatctatacatatattttttacattttcaaactcaagagagttattcatgatttatattcctaaggtttgactaaacgacttcctttatgagtatggagggagtagtttttaacaaatttgtagacatttcattttatcataatgtatttcattaattttgttttgtattatatatagtcttagatcattaattacaaactagatgacatttccgatttagtgttggattccaatgtagcgatatgacatttttcaccaaattttaataagttttgatatagttttgtcgtgaattctcaaaaaacattcaaaactccgctcagaatatacttttcgtcccacgtcgaaacatcaaaattacatgatttttggtgggttttggtcgaaaacataaaccctggttaatactgaccccggtgaccatttatcctggcttcgcccctccgtatacgtatattggactgttggactggaggggcgcgc

SEQ ID NO: 55438 - DNA, 1501 bp, Oryza sativa
aaggatatacatggactaaaaaaaattaatttttggctcaagctgtcaagcatgggttacccgcgagtgaagtataaaacccgtatgcttctaataaattcgcaggtatcgggtgggatatgcccaatgataaaaataggtacccactcccatatccattggttcgagtatcatgaatacgcgaacctacattggattgcactttgcacccttggctgttcggaactgcgaaggtcacattggtgtgtttcaaacggagtctcttttcgaattaattttgcccgtccgtgcttgggctcgtgacctgagaaattgtgtccaatgggctgtcgcccacgctcttcgccagcttggtccatgggctctctctctctctctctctctctctctctctctctctctctctctctctcattcatcctggaggaatggcactaattcgatcaagccaatctatgtaaccgcataaacccatttgcataaccactcggaatcgatggactcactgggggggcaggcagtgtgtgtgatgatgcgaatccaggaggagcctgcagcggcaagcaatgcaaaaacgaagcgaataaccaaccttgagtgtccgtgctgctgccaccgcccactgaagtggctgctcgtctctacggagtaggagtatgtgggatgtggcctacgcctatggtttttttggtcggtccagctagcctagctcatatgccctcgtccacccatgtaaaccgcgacggaagcatggcacaatccggcacaccaactcgtcgattcttccggcaaattcttgcttgcgtgaggcccgatcgagcatcgaccgacactagctaccaacatgtcctaacaacaaactgtcagtacacaacagcaatagttagtgatcgatactggtcgcattgttatcttgtactctagaatgtcatggtcaaatatcaaatatttgtccaaaatcgttcgtttcgtttgacctctgacgacctcagccgagttttgtgctatccatatttagttttcttcttcttcttcttcttcttcttcagcagcgaagccggtgacagtcacgcttttatttacaggagtattttttacccgtcctctacatctaattagatatgtacagtattttaaaattgaaaacttagctcctaaaacaacacaatccaaaattcgctctttttaaattagaaccatagccacttaaataacacaatctaaaattcgcttatatagagatttgaattcaatatcttaggatgctacttaggttaccgcaatcactagactttgcctttgacaataacgctagccgtgctgcacaatcacacgaagttagttaaattaagccaatcattgggctcaaatccgtgtccctttcctcgaaggcgaaaaggagttgttgataaaggcttcgatgctgcacacgacctttcttctgcagcaaactataccttgcctccatttgcaccaagaccagagcacgcacgcttgccac

SEQ ID NO: 55439 - DNA, 531 bp, Oryza sativa
tgtgcgatttgataaagtacgattgttttagtcttttagctttgtattgactaggaaaaaaatgcccgtgcgttacaacgggtgaatgttattttaatgttattattgttatatggtaggttgagttaagatgatattcactgtagaaattcgcttggatatatattttttctaaaaaatcatgagctgcaattaggagtccgatcatctcaatcaagttagcatgcgatatttttaaagagatactagtatcttatacaactctttccgtatttccaaaagcaaacgaatttaaaacccgacttaaatacaaatatgtatttttaaatcaaacgaacttaaaaaccgattcatacacgaatgatgtaccaaagtattaataaaaatatcttcaatttttataagagatgtgcttctatacttcttaaaaaaaaattgcacgaaaatcaaagcacataagtggctgagattaaaagtgggttaacagtctaatcctcattagtgaggggtactttcgtcttcgtccataga

SEQ ID NO: 55440 - DNA, 1501 bp, Oryza sativa
aagtttattttttaaaaaaattagcaacatataataccaaattagtttcattaaaactaatatttaatatattttgacaatacgtttggtttatgttcaaaatgttgctatatttttctattcttggtcaagcttaaaaaagtttaactagaaacaaagtaaaaaagacttataatatgaaacggaggtagtattaaatagcgacttctccccatacctctcagccagatatatcttctcaactcctcctcatcttagtcattgatccctcccgccttgaggtgcgacggtgatggcaacggcgaccgcgtcaacgacagcgctggcgatgggaggcggatccggtggcgggatgggaggaggccaatggccggcggtggcgcaacagagggagcagcggcggtgaccctgccctcccctctcccagatccgatggcaggatgggaggaggccggcggcggcggtagcatcaatacagggagcgacagcggcagctttacaatcccctctcgtcccagatccagcctccaggtgcatgctcttggcaacagtggctccctctagcctcgaggtgctctcggcgacagcgatgggaggcggatccgatggtgggatgggaggagactggtgatggcagaagcaaaagagggggcactggcaacggcttcccactcccctcccctctcctctccaaaatcaggggtggtggtcgcggctatagtagagggggtggctctggtggcggctcgtccacggtggctgtctagggttcttgtaaattgaagggggctatgcttgggagctagggttgaagtggtgaatttttatgtgtttgttcttcccttttgcagatccatttgatgtagtgacaatgtaaacgatttgatttgtattttttgtttgttatgtggaaatgggtagctgcatgcatatggtatttttattttattaccaaaattcatctatgttggtggacctgtaaaaagtcaaacttccatagatggccagcttaacctagctccttgcgaaaaccatttccgctggcggctaggcaaggttacctgctagtgaaaatggtgcattttcattggttattgatcattgacggcagcgctggccaccgtagaaaacacaaggctgttaggaaaaatccatttagtaatagtgggataaatatcctcattaatttatatgtacacttgttgccacctcccatattttagcatcaaccgcacagtcccctttcatcaaattaaatcaaaaaaataatttacgaataataatggtcattatgtcgctagctataagtaatgttgtcatcataaaagtatatgctggttataagttactccgtaacatagaagcatgtcagcaaatcaagcttggctcattcttacgaagaaaatgggctgaatgttccctctagctcattgaggcctaatgcccatgtacggcagcagatttgtggactgctaccagcagatctatggagcttgtgtac

SEQ ID NO: 55441 - DNA, 1501 bp, Oryza sativa
ttcagaaaatagtggtcagtttataaaactcaccttaatccgcaaatagcttctcctctaatttccgtattgccctctggtggctagccatttgatcttcagacatgttgcttgtatccttacttaatagagtattgtacacatcgaacatctttgcttccttctgctccttagcggccaacaatgttgcatttgatatctgaatctgtgcttcggtggccttttcacgatccaccctccggtcttcgtggacctttataattttctggacattgtcccctaggaggacaatgccttccataacattttctttcttgcgctttccattgcgctcagactttgctgcttctctaccaataggacgtgactgctgttctggaacagcatccatttcgctcttgtctttctctgattcaaactgagcacaccatttgggctcatctttgagtatcttccaccaatggaccaacgcaaaaggttttccaaacctgtttgcatacagcctctgtgcctctttctcaagcatgtcgtcggagtatccgcttgtatgcatttgagtaaccgtactccaatagtcattgaactcagagatcgctgacttcaaccttgaccagtgaaccttcagttggttaatttccctcctacgttttccattccctttcttgttaaattcatcagtgacttccttccaaaatgtatcacctttcttatcattcccatgaattgagtctttagaagcattcaaccaagcactggcctacaagaatcagttaatgacctgtcaagtattagtcaaaacaaagacatatggaaatgtaaaagtatccgatgaataccagtctctcttcctcttcatgagtccatcttttctttgctgccctactgtcatcattgttgtcctcttcatcaatcataatgtttgttgaagtgccttggttcgtagcttggggtgttggtgttccgtaggcacttggtggctgtggagatattgggttgaatcccatattgtgaccaacgaaatgaaaattttcaccttgctgttgtggctgcggcggacaattttgttgaataaaattgacaaaccctcctggaggataacccctgaccaaactgtaacagagacaaaaaagttgtattaaaatgagcatatcaggtgtactgtttttgtgcatagcaagaactaaaatggattgcctactgctgactgaggtttggaaattccaaactatcgaattgcttttgcaaattccaaacagactattttcaggtttgtcaatttacacatattgcatagcaagacagtacctttacaactgagatgggtgaaaattcattccctgttacatatattaaggatcagaagcaaactattttttacaaatgcactgcacccaccaaccaagcagaacatatggacagacaaggtgcagaatttgatactacagaattaatccaaggggtgccttttcacccatctctctttcacaactgagatagctaa

SEQ ID NO: 55442 - DNA, 1501 bp, Oryza sativa
ttcacttaaattagtgggtccaatattatacaccgttagataaaattgatcttaaaacaaaccaaataatatgggtcccacctctcctttttctcccgcgtgcataggtataggtcacgtacgtacatgcatgtggacctgttgttcgtacgcctccctccatttttttcctttttttcttcttttttccatttatacaatttgatatatatttgtttaaataataataatttagaaaaaaagaaaataccatcatataactctttataaacacaggtaactaaattagctatgcagactttgaaaataaaatttacaccatattatatgttaattagctctaaaatcaataatgtaagataatttactaaatactattattttcatataatgcactattttaaaataaagcttacacaatattatattgtgtacctatcaaataaacaatttaagatctatattaactaatatatacatgtacttaaacagatagacccattatttaaatcatcggatctattttttattactttggattattattctcaaataattcagtgttttaaaataaaatctacaccatcaccataatgttgtgtacccattaaattaacaatttaatatatatatatatatatatatatatatatatatatatatatatatacacacatatatattaactaagttacatttacactaaaaccggtggacccattatttaaatcatcggatctattgttaataatgtctaaagttctctttttggcccactccacaatgcacatctgcacctttgcctttcgcacatgtgacagagtgtcgtgtttgaggcatcttgggtgatcacgaccgctgcagtgctaccgttgttattaatagcatgaaaataaaattaaagatgtgatgtagcgagagaagaattaagtaccgtggaacacttaactctgtttaagctgaaatcgagagttgattaaataataattataatgtattgtgttatgttgtatttgcattttgtattatttgttcgtacagttgaaagaaatcattatgttataattgtgagcacaatattaacgaatatcaacagaactcttactaggataagagtgttataagggagtttaaggccctattttttccctgattccatcttttgaattttcgtttgcacgctccatgctttcaaagttactaaatggtgcttttcttaaacaactttttaacttttcagaagtcaattcattcgtttataatctcaaatagctatcacataaatcagataattcatcaatttcagttgtcatatcccctaaagtacatatttttttcatgcgagtcatggtgataagtaaattggtgatcaacgcataatcaaagtcataagataaatctgttagaacaactatgaccaattgtaaataggtgtcaaaattaattgctattaattaaacaactaatggcttgctagcaacatatttaatttttctctaca

SEQ ID NO: 55443 - DNA, 1501 bp, Oryza sativa
tttgcgagggtgtgagtgtagcgctacgtgtatagtggtgtgtctgcgtgtgcgtctatcatgcaaacagaaaaaaaaaaagatgttatggcatttcaatcatgtatttgttttccttgtttctgtgtgcttcagaatcttgagttccaaaaaaaagcccaagagtcttctcatgattatgacaacaaatcaaataaaaatctaacttgatcaaactcgctaaacattaagaaaaaagtacggcgaattctgaaaattaaataaacctaacagcctctgaaatagaaagatattttagctcaaagatagggaacaacactcccaaaaatatttttggaaggatcgatgagaggttcaactgaaatgcatacgagaaagagataaagagtgaatccacgtagacatgacaggaaaagcatatctctctgaagttctgtcacgaccgagaactgaacgctgaacagtcaccgtatagtgtctgggtgtgtttagtcggggaaaaaggaaattttttgctgtcacatcgaacgtttgactggatgtcggaaggggtttttggacacggatgaaaaaactaattttagaattcgcctggaaaccgcgagacgaatcttttgagactaattaagccgtcattagcacatgtgggttactgtagcacttatggctaatcacggactaattaggcttaaaagattcgtctcgcgatttcctctataactgtgtaattagtttttttatctatatttaatgcttcatgcatgtgtccaaagatttgatgtgatgtttttgagaaaaaaatttggggaactaagcgggcccctagacgacctagaaaagctttggctcttttccttttgtttttgcacaaccccaaggctggctgcgtgtgttgatttgatttaggaccaaacttcctgggagcaagctccaaaatggaggacgacatgaacaaactaggttagcttcgcctttaccactttacataattacatgtagatgagcatgcagctcactcagcagttgggggcctggggctagttttttttgcatgcataaaacaagcatgggtcatatgggtgagtgaagtgagtgagtgagcagcatgcaggtggtacagagattgtagaggaggggatcagacgttggtgggccgaatcactccgcacgaactgaaaattattccaccatcaaaagaccccagtcaactcatcatcgacgctctcaactctagatgggctccctttctcgtacgcttgtcggggccacgggacagtgacaccctctggagcaaaatttgtacggcatcgatctgtggagcaaactttggagttaccacgcatttcggccgttggtaatccgatgcaagtttgggtcttgctatttgctactccctctatcgtaaaatataactagtggtaaccttaaatattaaagacagaatattaaagacagggataaaaaaactttgttgccttttcaaaataggtgaggcttaagt

SEQ ID NO: 55444 - DNA, 1501 bp, Oryza sativa
aaaataggacccacatgtcagtggcacaaccttaattcagttacctcttttagcacagcctgcacctgcaatgtcgtcgaaaacacagcgcactagcgagcagttcatgctgatacttaacgaccgattgagtgaggatacaacctccgttattaagaaaagaaaccttctagatatggcttctttgccaattttttttattatacgaatgcgtatttgaagtattgaacgtaaactaataacaaaataaattacagattccgtctataaactgcgagacgaatttattaagcctaattaatccgtcattagcaaatgtttgttgtagcatcacattgtcaaatcatggcacaattaggctcaaaaagtttcatctcgcaatttacatgcaaactgtgaaattgtttttttcgtccacatttaatgctacatgcgtgtgtccaaatatttaatgtgacatttttggccaaaaatttttgggatctaaacgcaccctatgtcgaaatatataactagaatttaggactgttttggtttgctgcaaaaatttcctctaacaaatagttggcacttaaaatagtaccttgtagatgtttggattgatgccaaaatttaccaaaggcaatataactcctataattcaactctactaaaaatattggcaatgccaaatcttgcccataatttgacactaccaatgatttggtagggcaccaaaccaaatgagccctcattatctttttaaaaaagagggagtaggcaaaactattggtagttcatatgtaacggggtaagtgtagcgtcttgcttgaaaaaaaaaaacaggtggaagtgacctaaatatatgcagacccgaaatgactagtactaccacaataaacaagatgcgacatatttcgtattttattttttatgggacgaatatagagaactccctctgtccttaaaaaaaaaggcaaacttaaatttccatgccaacgtttgactgtccgtcttatataaatttttttttataattagtattttcattgttgttggatgataaaatatgattaatactttaagtgacttatctttttaatttttttcataagttttttaaataagatggacggtcaaatgttggacacggaaaacagagtttgtctttttttttttgggacggaaggagtacatgctaaggcgcgctatatagtctctagtgttaacaatgattgatttaaggtatggtggtaggtgacaacattcaaccacatatcctgattcctgacattaaacaggagctatttttccaactagactgaatgagctgccggttgaacacgtctagtttcttcatagctccatttcaccaagtacatgaaacggtagagatggtcggttggtcacgttgatctgaaaaaattagcacgagtgggattattcaaggtcctagagatggtcagttgagcgccggctgcgcgcggccaccgcccggaggtcattccatgccggcacttgg

SEQ ID NO: 55445 - DNA, 1501 bp, Oryza sativa
cttcgcaccgcacggtcgcacgcacgcaccgcgagccgttaggggttcaaacttccggcccacaacggtaactgtcgacgtttgcgaccgcggccccttctggcatctagaacccgaaccggggcactcgcaacccgacggcgccgtcaactaaccatggcacgaccgtcgcgtccgctacacgtttcctttcgtctccaactcgtattgctcctctttttttttgtattccacccctctatttccgtaaatcatactatcccatgtgttactgtactactatacggtaggggaaatctcgtttttttcatgcattttgcattgtactaacagcacaattgtgagagttcgtgctgaacatgtccagggttcatattcctaatggaaatcacgattttcatgaaaatagaccgattttcatggaaatagaatatttggggttggttccataacaaaaaccattcgatttcatggttaagcttttcaaacaatcaaactaaaatttaattattttgataacatttttctcatttttgtcttttttgttagtttaccggtagttttcgtgaaaactggatatactgctcgtgctagagaaagttttcagtccgataaagggattgtgaagcctgccctaaacacatgaaaaatgtaaaattcaactttgatttttttgcaagaatccttttccttttttttgggtgcttttcttttgtatagcactgtaccgtatacaacactgaatacaacaatgtaggccgagtttagttccaaacttttttttcaacttccaattttttcatcacatcaaaactttcttacacacataaactttcaactttttcatcacataattacaatttcaaccaaattttcaattttagcttgaactaaacacacccgcaatattagaaatttttttctcgcctccttatctaataaggacaaatctgagggacctattcggaaaaaagagatgggttaataatttattcctctcgctcgtcttccccttccccatcgcttcaacgggcgaggttttttgaaagcatcatcctctctctctcctcccccatcgactacccccgacacccaacggaagccgtagaaggagagagaggggaaaagcttgctattttataccctcatctagggttccgagcccaccggctctctccccccttgctggcttcgcgccatctctcccgccaccgcctccccccctccccccctccgcctccgatagattcgcgctcgccctcctgacccacggattcggttcccacgaaaccgctcgatctgggggatctgctagattcgtaaggcggcgtttcgatcgatctgttcgggggtttctgccgtggggaattttgatctataaagttagttttttgattttgtttcttttttgctttttggtggcggtttcgctgtgttaggtttgtggtggtggtggtggtggtgaggatgtgcttgtgccgttagatgggggccatggcga

SEQ ID NO: 55446 - DNA, 1501 bp, Oryza sativa
actctaaaatcaattatgacttctgcatagctagaatgcacgctgcctacaataaaaaaataaataaattgcttcaaaattaaaaaggatgacatgacagcaaatattatatcgcagcaaactgcacccaaaagtactttaagctcacgtcgagataatttaggtgcctagtttattctcagtaaaaagttgtcttttttcttttcaaatttggtcctatttggctggggaatagtgtattaccacctccgtaaaaaaaatacaattctaacaatacacctagtattaagggaaaattaatgatgtcataattaaagaacagtgcgaatgcaactgatgtccttgtattatgtcatcaaggcaacatgtcatggtcaaacccaactcttctcccaaactgatcaagaaaattttcgttatctgctcgagctacgtgccccggacaactccgagaccgaagctgcaggaaagccaagtcaaaggcgacatctccaagccccatctaacctcgctcgtggtcaatatgctactttctgctatccccaggaaaaaaaaattgcaaagcaaagcacccttaaagcttggggcatacgagtacactgcaccgggacgctgtttggtgcgcctaattaaacaattcttacatggctgcttagcccacaagacagtcggcggtcagctgacggtcagtgattagcgattaattatatagaacgggtttgtgctttgttagtgcgatgtttcatggatgcatagaaaatagaaatgattgtttaaatcaaggcagtttcttcactcacagtctcacacctgcatgcaaggacctgcagcaaccatggtaccaaactaccaggaaggtgcttaggcttcttccaccacaagataacgaaacacatgcaacgaaattattgagactaacctgatcaggtttcactgtttgtttcaggacactggcaccaacgctttattagcaacatactttatcattactggatcgccaattagcgtttagcgatgacagcatgatctgaagcaggtagatcagaaacattaatttatgttttggataacgtgataattaaacagatccgaaagtacaaacaacgagtgcacttgtacgctgtcacagcatcagaacttcacaggaagtcaagaagaacagagcgctatatgaccagatttttctgacttctgacggcgaccgtagttgcatgcatgatcgaccagtccttgctggattatggacattgagcatgtcatttcgtacgtgctgtagtatacagtatactcgtgtggtctacagagtatatcagttcgattgagatcgatggatatatcagagagatcaagacttaaaaccgcagctagcaaagtctggtttcccggccagctagctgatcaaactaaatgacgacatcaactaaaattaagtgacgtttttctgatggctgatgcatggcgttatatataaaatatactcagtgggcacatgacagactaa

SEQ ID NO: 55447 - DNA, 1501 bp, Oryza sativa
tgagctgtctgccacagttaggggatggccatggatggaccgatgccttgttttctatcgacgtcacgatttatatctctgcgactatgatcacatacggatgctaatgtatgtacagtacgtaaggatggtcacatgtacaggttataatatggagcaatccatgtcgagtcatcggtattctatatgccaattggtaaattaagtagtacggagtagtagttagtcagtcactcagtcttattgcttagttgcttaagacattttgtgtggagttagctgattaattaaatatctcttgccaagggaacagcgaattgatcatcgaccaaatacttggttatttgctagctactcaaatacactcaatacttgatcacaacgtacgtctacacttgtactcttcgtctacgctcgtctcccgagtttatagtgcagacaactaagtttcaaaaaaaaaaaaaaaccaagttcgtctagaattggcctttcgatgtgtaaaataaatatgcgcatgacctatatacttcaacctgaacgtgtcagaaagaacatagattgaacacgcaagctagtgggtgttaatggcgtgcatatttcatcaaattcagtgaggctatccattttacatttccccgctaaaaaagataagggtatgaatagagttacaaagtctagcattttagcgacccacttactctctcctagaataattagatattttattactaaaaccaaggagaaataaaacttcgaccgtaagctacttggttgcatacatgtacgtgggttgctctcgctattattaacgacacgacgaaattaaatgctgcatgcatgtcctccattcaattaaacaccgcatgtatattttcccattcgtaagatgctcttttttttctccttatacactcatcatccttgtatagacttaaaaaggttaacaattcttaccctaccaatcatctgttagactatttggctctgtaggttgggatcttctactcactcgtttttcacagacacatttctcgaacggttaaatgatatgtgttttgcaaatattttctataggaaagttgttctaaaaattatattagtccattttcaaggttttttttcttcaaatacttgattaattatgggctaccttatttttcgtgcagaagaaataggttgaacacactttcgaacacaaccttaattttgaatagtacctgctacctatatgaattgaaaccaattcttgccaattcgatagagttgaaacaatacaacactaccaaaattttgatagtaccaaaacttatttaaaatttagtgcggcaagtttttgatacaacttcaaaccaaaaacaaccctttctatcaaactgatgccaaatttgatatgtttgcagctgcacgctgctatcacacccatctggctagagtcaccaagctgctcaatcagtcaaaccgtcaaagtatcgaccaccacaacaaacgtccccggtgatga

SEQ ID NO: 55448 - DNA, 1241 bp, Oryza sativa
tgatactactggagtatcactgggatactcagaaggatatccatgtatgaagagaaaactcaagataaaatcaacgtaaataatttcaatgctagaaaatcatatgtttatcaagagagggctcaataaaaaccaataagggaaatcgattccagaaaaaagtcgtcatagctgtagaaacacccatagaacatgtagaaaaacctaaatcaaaccccaaagcaagccaaggcaggagcttgagggtcatgaacccagatcttggtctacatatctacaccacaaaagggcattgtccttgatggtagtgacctcgttgacgatggctgcatcttggaacgtggtgagcagctccacctccgtcatgtgctcggacacctaccccacaaacaacttcgtgatctcctcctctactcagtttacacctccaccaacagcaacggcggcgatcaagacggcaacttcctcgacgcccgacgcgccaccctgcatgaccagctgccgtcattgcctccgtgctcatgtgggtggtagagagagagaaagagtgtggggaggggaaggggaagagattaaggagaggataagattaaataggtggtgtgagtagtggtgctggatatttactagtagtatcccgtgtctacgggactccgttctctagattttctgattttttaaagatttttgtcaatgattagtagcggaataaatgttttacatatacctagatgtgattaattgtacaaactagaaaggtatcaatccctatattttccgagaagattttatataggttcatgcccccattcaaggaaatacccctacggcccactaggatatatatacaaagtataaaaagtacatatatgacactaatgtagactagtaatctgcccgtgctaactctacggtgttataatacatttttgttaacgaattacacgttatttcctccgtttcatattatagaactttctagcattgcccacattcatatagatgttaatgaatctagacacataatgtgaaatggaggaagtagtaaaaatatgtttcctagaatccacccaattgagctttattttgatctaggtcagatattaaggcaaagtacagtgatattatattatctaaaatattaattcaaaaccatcaataatcatatttaatcacttcaataccaatatattagacaatgcacatccacacttccacaaaaaatggttgagaataaatta

SEQ ID NO: 55449 - DNA, 1501 bp, Oryza sativa
ctagcgccgtatccggtgtaaatgaacgacgtcgacacgcgcatattgcgccattcttatcaggactaagaatacatcttcgttgtcgtcgtcaactcgtcacaactgtatgtacggctacagtacatctttaccacgtcgtcccgttccgctcccttaattggttaaattttctttttcacaacctaactaagaacgatttttgaacgcttttgagcatgggcgtaagtttaatcagtgcactatggtcaacttgtcactaaaaccgtgccatccatatcgcaaaatctaaaccgagagcgctctcgatttagtgttaaaagagcgacgcactcattcgtgagagaatgtccagtgctactagtacgtgagagaagatcctgtgctgccagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttaaaaaaaaaaggtgtctctctttagcactatccagatatcactctcggtgtaaatgtgtccctatgtcgcaaaatctaatgcaagccagtgaaagaagggtagagctggtggaa

SEQ ID NO: 55450 - DNA, 982 bp, Oryza sativa
attcctgcagcccggaacaatcaacaaaatcaccggggtctagtttttctgttcgctggggtcatagatggtaaaataaagagaggtacgagaggttcgtgaaacatcgtcggggtcaactgacccctatgaatggctgtagcttcgcccctgcgtatacgtatgtgtataacagtatatatatatatatatgtcagggttatagataccacatatacctaatagtagttgactaaatatcggcaggatacactacataccatgtcttatacggaaactgacctcgagggagttctggataaggaaagataaccagagttctacatggaaacgacaagtactactcagattgtatccatattggtttccctagttctacttggacaaggggacacctataggtataaatacaagccctcctaggaggacagggggagagacaaccaccatgaaagtgaaagacacccatgacaatcaacacacgcctaccagaagccacaacatacaagcctacatacgccaagacacgccgccggatatcgacttgaaggataggcatggctattcccctacggtgtctccggataccgtcaggagatacgaaagcgctatctctgatctcgccgggcacagattcgaggaggaagactaccctgttgtcgactacgagtcagaccttcagaccgacatgtccacaacagttagataggctacccacatattgtactggtgtgattatggtgaataaaagcaataccggcttcggccaacaggatgtagggttattacctgacaattcaggggcccgaacctgtataaaaatctttgtctccatctcttttacctcagtctcgtgtatatcctagtaccgacgatccccatactgtccaaataccatagtcgagacatcaaacgtcgacagtggcgcgccaggtagggggattttggtgctctaggatttcgacgagataggtttaagaga

SEQ ID NO: 55451 - DNA, 349 bp, Oryza sativa
tggaagtagtgggagaaacgctacatcactagtcgagaaccaggcagtagtcgtaactcgaccacttgaagtggagatagtgggagaaacactacatcgctggtcgaggaccaggcagtagtcgtaactcgaccactgaaagtggaagtagttggagagacgctacatcgctggtcgaggaccaggcagtagttgtaactcgaccactagaagtgaaagtagtgggagaaacgttatatcgctggtcgagaactaggcagtagtcgtaactcgaccactagaagtgaaagtagtgggagaaacgttacatcgctggtcgaggaccaggcagtagtcgtaactcgaccac

SEQ ID NO: 55452 - DNA, 1501 bp, Oryza sativa
ggctagaaaatcagatagcaacattaaacatgaaacaactaaatgttatttgaaacatcggaactagcaatctagctgcaatggtttgaaactggagtggattttgatccctggagtggatatcccctcgttgtttgcatatcactcaaatagttatgaaatttttttaaaaaataaaaaagatgtattaacatgttatatataactctacaaacatgcaagttcaaattcaacttctacatctcgtaacgaagaaaaacaaatttgattgtgaatatacgttaactagctatagtttaatttgtttttttcgttacgagatatagaagttgaatttgaatttgcatgttgttgagtgatatatcacatgttaatacatcttctctaatttttttttaaatttttttcgtaaccatttgagtgacatgcaaataacgaggggacatctcctcgagatatcaaaattgtttcataacaatgtagtaaaactaaacatgcttacatggatattgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggctgggtgtgccggtcagaccggcgtgtattgcgcagtcagaccggcgcagcccgcggtctgaccggtcgacgctgtgtcagtttcggtttcgggttgtttctttggatatccgtgattgtttcatggttatggcttctagatggatattatacgtatgtaatactgttgtttgctactaatgagtcaagttggagatagcttagtctcggaatatggtttctttgtttgtttcatgtgtaggtgactcgatgcctcgggagagtatttgcggtgatggaccgggagtcggcttggtggtaagacgatgtccgtggtggtcaaatatcatgcgggatactaaggctagagttgatgcacgtggttgatggagattccatatggcatatgatggaggtattgtatgcgtatgggatgcggagtcgaatttggaaggagtcaaatttggtacgattggttatgtaaaggttctttcttgtactagagggtttcctaaggtgtttaggactcttagtatgagtttgattcgtggctttaggctgcctacctcatgtataaatagagggggagcgtgagtcttccctgcatcgctttgtatcgcttttgtattgcttttgagagctagtttagttagggttttgagtttagtcgagatttttgtaaggagt

SEQ ID NO: 55453 - DNA, 592 bp, Oryza sativa
tgcaaaacaacaattcctcatttggcaccatgtacagtgtcttgcttcagttaaattaggctactcaatccttgtgggactcctgttgataatccatccatccatggctgatgaacaggtatctaaattgtaataagctacagaggttccctactgttgtcgctaacatacaatacaaaggtcttttttttttcaaaaaaaaaaatacaatggccatttggttcgtgtctaacctagacatgcaaaggtttagtcatgtctagtcacactttcttagcctgatgacctgcacacttcaaaccttagggagttggtggatttttacaactcgagtgcatgcacactttgtttgcttcccacttctcaaataccaatcaaaagagttacaaaataaaaaacactttatgtaatagacatatatcttcttgcgaaatttcaagtacaattctcagtttatacaacaggcatggcaaagcgggacaacttccaagtgtaccaatatatccggttgttagtggatcatgcagaacttcacaaggaataaggaaagcaaaatggcaagatggcgataacatagaaaaagaataatata

SEQ ID NO: 55454 - DNA, 1501 bp, Oryza sativa
cgtacttataccaaagctgacaacattcccaatatgagacaaaaataagcaattttttttcgcactgcctcatctaggtttccatattattgtccagataacccagctgaatgtttgtcacctggaagaagatgaagaaggtgccaaatttatttaatcctagttcattgagaaagcaggcctatataagcctacaccagcaaaaattaagtactgtaatacctggatagctgcttatggttggtttggtttgttaccatgccaaaatattgacactatcaaaacctgtcaagttttggctttgtcaagattttggcaacacatgtgtaattggcatatttgttgccatgacaaacaattcgtttatgctaattatatttgactgggccccaatttaacaaggcgacacaagcatgtcaagttaaatccatatcggaaaagccgcttggccaacagccttctgttcacttgatttggatgactggatgaaatgaatcatatatagaaaaaaacataaaaaaagaatgttctggctccacttcaacaacttgcacacaagctccaagcaacgtaacggcactatttagttcctttctttttccttttttctttttgttccgacaacaatctcccaaaaaacaaattcttgagaaacaaagaactagaggaaaaggttgatgaagttttatagaattgacctggagggccatgcatggttagcttcaaaggctcacaaataaaaaggcgcatgcaaggtaatgcagcggaagttgatctaagataagaaaggtgacaaataatgttgttttttacaagcaggaagcatgacctcctaaagcaagcctttcatgatccaattaggaattgatatttcaccttctatgccttctgtgaaaattaactggctctcaaagtcatatattattatgcttttttcatcaaaaagttatataggtatgcttcatagggaggacaacacactatactactagataacagcaccaatcttaacattgcagcttattacacacgcctcttggtttctttttccaaaaaaaaaacaccagaatatgttttagttaattaatatagtagtccattgtaaatcactaaattagtgtggtcatcgcatactcgcatggatgtagcaatacatctgaaaattagctgccttgccgaaaactgcaattcgatatactcaatagacagcaagcaggccctctgcactccctagccaggtgcacaaagcaggagcaaagagtggcccaatagcagtttttttctatggactcctaccaactcggccaaccactaccacgctgtgacctcccaccatgcagggcacgaacccatgatgatcccctatatagagagcccgtactcatttctcgccaagtgcaccacttcactcttgcttccaagtgcaaccacaaaaccagttcaaaagctgcgccccggcagccgcacggcttgggctgggcatccgaaatgggcactcccc

SEQ ID NO: 55455 - DNA, 272 bp, Oryza sativa
caccaaagctaagaatcctagcattcctactactattaacaactatttcctggggccgttgatttgattaaataaaactagaaaaagatactcctctagtacaacttattgttgcgttgcgtggtgtaggtgcgtgggtcgcctggcgtgtaatcttgagtgacagtgccatcctatatacggcttggcttattagtgtgcctgcctgcctatcatgcttagacgcaacagggatcgacttgcaaactaaactagccagtggcttatgcagc

SEQ ID NO: 55456 - DNA, 1501 bp, Oryza sativa
gccaccaagtgcctacggaacaccaacaccccaagctacgaaccaaggcacttcaacaaacattatgattgatgaagaggacaacaatgatgacagtagggcagcaaagaaaagatggactcatgaagaggaagagagactggtattcatcggatacttttacatttccatatgtctttgttttgactaatacttgacaggtcattaactgattcttgtaggccagtgcttggttgaatgcttctaaagactcaattcatgggaatgataagaaaggtgatacattttggaaggaagtcactgatgaatttaacaagaaagggaatggaaaacgtaggagggaaattaaccaactgaaggttcactggtcaaggttgaagtcagcgatctctgagttcaatgactattggagtacggttactcaaatgcatacaagcggatactccgacgacatgcttgagaaagaggcacagaggctgtatgcaaacaggtttggaaaaccttttgcgttggtccattggtggaagatactcaaagatgagcccaaatggtgtgctcagtttgaatcagagaaagacaagagcgaaatggatgctgttccagaacagcagtcacgtcctattggtagagaagcagcaaagtctgagcgcaatggaaagcgcaagaaagaaaatgttatggaaggcattgtcctcctaggggacaatgtccagaaaattataaaggtccacgaagaccggagggtggatcgtgaaaaggccaccgaagcacagattcagatatcaaatgcaacattgttggccgctaaggagcagaaggaagcaaagatgttcgatgtgtacaatactctattaagtaaggatacaagcaacatgtctgaagatcaaatggctagccaccagagggcaatacggaaattagaggagaagctatttgcggattaaggtgagttttataaactgaccactattttctgaaatgtatgaattctgaaatttatatacaattgtgtaaacatggaaaattagataatgtatgcatgatgcacaacatgtgcgtgcagcactatttaatggcagtttcacaagtgtgaaaactgaccactatagtactattgtggtgtgaaaactgaccactactattgtggtgtgaatgctactgtggtgtgaaaactgaccactatagtttcacattcctggatgcagccctcctctatatatatagatacagtcctcatctcttcctggcatacacacagccctcttctctaattcctggacgcagtcctcatctcttcctggcatagacgcagcccttctctcttcctgtttagttcaacaacattgaggtgatctgcctttctttgaagtttctatcttttttcactgctgtgaatgattatttctctgctgtgaatgattatttctccaatcttcctttgttcaccttctctctttctctgctgtgaagatgtctggaaatgaaaatcagattcctgtgt

SEQ ID NO: 55457 - DNA, 581 bp, Oryza sativa
cagaggggaaaagtctgttgtcttgctgctggtcctccctagcatcgccctctcccttcttgtgctgatggggagtacagggagatcaagagaggcaccacctgctgctgctgtgccacatgagagagaaaaggtggaggagaggaggctgctggctgcaatagaggagagaaaggataggatgatggtgtatgcttgctgcatcgtgcacaaggagagaagaaaggtggaggagaggagccgtgctgcacaatgggggagagagatctagatgaaggtgaggtggcggctgctgggagggaagctgttgggtaaggttaaaatgttgtttgctaggtcaaaagagcaaagtatttggactaagctaggtaagtgctactattgggctgggctgtgatgaatggagtaccccattagtatttttaggcgccatattacttaatactttcttatttttcaatgcacttaagccgtcgccaccccatacgtcttatcgctattgcggtaaggcggtgctgggttggcatacttcgccatacccgcttaataacacgggtcactgctcacttctgcttctttca

SEQ ID NO: 55458 - DNA, 1141 bp, Oryza sativa
atcccccattttccagataggctcgccgtatattcactataacatgaacataatgtaaaataggtactcatatactcggaaaatatttcaataccataaatgtatatagaagagtattctaataaaagtacaaagcttacaaaagagaagagaaaagctactagagccatacccgaactcttccgaaggcttccggactcctgatttctactctattcctattccaccagctagatactaccaaactaaattgagagaaatgagagagctattgcttgaggtgtgtgagtgaagtgagaaggtaaggggtttatatagcctcccaatgacgattgtgatggttggaatggtcggaaataccctccaaccatcattgggagctaatccacatcgtccagaagaaaccctgcatccagcggcgatgagggaggttcggtcgaaccccctggttgggccgaacctggggccggcccaaccagcccatggtttggctggcggcctcctctgttattcttctccagacttttgaattttggcctagtttgtcgtgtcaattctgagttcttggcccattcatacataagtctggttctcgacatcgtccgattgatttatcgtttgaattgatgtcgattctcctccatttaatgattattctctacaaaaggttagtgaacctaatactagtggaatattattattctaacatggatatgcattacaagcaaaactagttctcctctatttcggtaatattgacggaagaaactgatcgctaatgaccatcaacagcagcataggcagcattgctggcgcgtcctcctggaggcctccagttcgacgtctttgtgggttatgaagggtgggaccatggcgatgatggtgtgggtggggaggatgctgtcattgcgggcggtggtagcggcggtggtagtggaggctgttggtatttcttaacgacattactagaaatataatttccagcaatgccgcagaaatacttctggtatattatggttagagagttcatccgcaagcgcacggatataccattgtagcatttcacccgagagtattccaagggtatcatatttattttatcccgtgaaaagatcatgtagagagaactcaactaataatt

SEQ ID NO: 55459 - DNA, 163 bp, Oryza sativa
atatgagagaaagaggtcttctagaaaatacatgggttttggtctgctagaaaacacatgggttttcatctatttaatgcaaaatgtcgctatataagtcaatgttgttttttgctgtattgaaactgtggcaacttgacattcttgttgtatttggtgtaga

SEQ ID NO: 55460 - DNA, 1356 bp, Oryza sativa
tgatttggcattgtccatcgtcacaatcgtgtaattagatagaacattcgttcgataagtttaggggttttcgggggggtttttacctcggaatcggtgtgttgtgttgttttcagtgggcttgaatagaatgtttggattctctggattctttgattgttggataagtattgggatattttctttagttgtccaccttcgcttggacacgttgctgtcaaactttctcggggtaatagaggtttaagggtgttttgcttttgctcgttcttctttgtgaatttttgttctcaaattggtttaattttaaatgtttttcatcaacttataaccaatactcctggttggacatttaatttacagggttcttatcgtgtcaatttttaagggattttgtatagttacatcctattgattgctgaaattttgagatgagtgcactttcagtgctggacagggtattgactcgtagggtgcttgtttgatgttcctgtatggaaaatactccctccgacgcagttgatttttttttatacatgtttaaccgttcgtcttattcaaaaacttttgtgaaatatgtaaaactatatgtatacataaaattatatttaacaatgaatcaaatgataggaaaagaattaataattacttaaattttttgaacatgacgaacggtcaaacatgtttaaaaaagtcaacggcgtcaaatatttagggacggggggagtacaatgttttgttcatctgcgctaatattaaactgaggaatgtagagtcatcaggtttaggcgcttgggttttgttggagtcttatcaaagttttgaacttattatgtttcatggatgggctacccgtttcaagccttcaaggaacgtgaaagtttgttcatactctgatatacctgaaggactttctaccgtcattatcattgtcattgactagcatgatgtattggtgttatgccttctgtttattttatttgctcctgctttatcagtataattggcagttctcctgcctgttcattcaaaataataagaaaatattgacatagcaatagcaccaaggggatatccttgattgcatatttaattatctctctatacacatgcactgtacatgtattgttcgttattgttattgtttttcataattgtctactgtttttttaatgttattgaatgctagtttcatgttgattgaaatttgagaagtacacgcaatttctactttagcattagtttctactttagcattagttttctgtagctttacatatattgctcttctgacttctgacagtacaattggcagttttactggccagatataattttggttacttgttgtgtagg

SEQ ID NO: 55461 - DNA, 389 bp, Oryza sativa
cctgcaccccctagtgaaaccacaaacctgcattgcaaattcttggtatcaggatcatttcaagtttgacataaagatacaccatctggatgatgcccactaataaggaaataaatcaccagcatgaacgcatatttctatatatcatattttggactatgaatatgcacataacagtggtgttccccatatttctaaccatatattgtagccaattaacttacccgacaagcagcaaaacgaatgccacaacccacaaaacatattggtatgctttgtatttgggaggctgattagtttggggcaactcatgtcgttccatccaaccaaactgtggccttgccaacaaaacaaatcccaaaaggaagcccgtcacaaatccaccgata

SEQ ID NO: 55462 - DNA, 523 bp, Oryza sativa
gtaccgtgcggatctggtgaaagtagccactacacagtatgtttcgctttcctcgggtctacggcggcatgaacccggctcacgggattagacccgcgggcgcggtgagttggacgtgtggtcctcgtggaccgggtctagcgacggtggggctcgatccctcgagaaggtggggccaccaccaagctagctcctgctcgccccaccaccacatcgaaatcaaaaactattacttctattttctagtatttttttttgtttctctcgagttcctccctcctcgctcgccacaatctctctcccggcttcgttcctcctctcgccccgcgactcccgctctgctcctcctcgtcgccgccgccgccgccgccgccgccgccgccgccgctgtgtgtacgactacgacggcgaagagccaggcggggaggaccgatccgccggaggaggaggaggagggagtgggggggcggggagatgggggagggggggcgatgacagcgggcgcggctcggcgcgggcggga

SEQ ID NO: 55463 - DNA, 1501 bp, Oryza sativa
gtttgaagttaaaacatttatatctttgactatcaatatttagatattaatatgatttaacattacaatatttatcttttttcatcatgacaagtatttttcataaataatattacaattcatatgttgttaagctatataatttttttaaagattgatagtaaaaaagataacatcttttacttaggacaaagctaaaaagataggtaattgaaaaaaagagtatttaaattagtttaactttagacgcatcagattgtgacaagttagcaagcaaacatcccctagctagtgagcctgagtgtttgctcaggtggttagtgtcgccggtgggcacactacctgcgagcgttcgaaccctacgttcgatggctcgtgctctcctggggaggttttgttttccctttttttcccgagactgacttcggttggttccggttaggtataagggtaaacatacacgtgagcgttcactggtactgcacgtttccggtgcctccaatttcattcttagcgtgtgttagggatacgcaaacgtgtgtgcgtgtggcgtggacttgtggtgtatgtgtggtgtgtgttcatgtgcatcctgaattttacttccctctaaaaacacatcccctagctagtagctgctggtaaactaccgtcctgagcaacagagaagcaaagcaatgagttgacgcgaccgaatccgcgacgccgccctcgcaccgcaagggccacgccaatttggtgctcgatcgatcggaacgcgcgcggcgctccacggccatgtcccaccgcacgaaccgcgcggccgcccgccaaccgagctagcgcgcggccccggccgccgccatgctaacacacacccgatgcgttgcattgcatggccgctccacgacgcctcccgcccgcctcgcgccaccacggccacgcggtgcaccagctatagctagctagctaggcgcatggggagacgctccacgacgcccactgcactcccgacacgtttcccccaaccaaccaccacgcaccaacccaaaaccatccatccatccagccagccaagccaatctcccggctccctccgctacgcgccccacgacctttttcccatcacccgcccgcgcgcgcggtcgagcgcaacgcaacgcaactccaccgtaccaaccgcggcgcggccgatcgatcgacgcgaatcccgcatgcgtatacgtactattctacgtgaagtatatgtgtagccgatcgagccgtctcccaccgcgcgctccctccctgcccccgcgacagcgacgccgagcgagcgagagcgcgcagctagccacagcctccagagctatagctacagcgcgatcgagagagaaggggggagacagtgaggccgagagcgagagggccagccacgcacgcacgcacgccaccgcgctccattggccaccccctcgccatcgccacgattaaactactctcttgctactccccctccatccatccacacactccaccattt

SEQ ID NO: 55464 - DNA, 274 bp, Oryza sativa
tttctaattatttgacgtaaagcaaaaatcttgcttatgggtaccttgacttacttttattaatcttgcctcgggatttctggcgaagtaatttctgatatatgcatgcaattgagttctgatggtctaaaactatcgtgtcccttgcataagtctcttttgttagtctaggcttgcaatgtccaatgaatcatttctgttcttttgacatgttccttcacagtcctttcctgttccattttggttttaatgcgcggtatgtttgttcctccca

SEQ ID NO: 55465 - DNA, 1501 bp, Oryza sativa
ctgaacaccctgtctggaaaccacggcgagaaggtgagcgggagagcggtttgcaattgcattcggcggcggcggcggcgtacgaaccgtagctgtaggaggcggggaacatggcgcgctcggggacggcgccgcggaacgtgagcgtggtcgggccggcgcactcccagtcggagccgtcgccgcgctccgcctcgcgcgcgttcaccggccgcagccgcaccgacaccacgatccgctccggccgctcctcccccgccatctccgcctcctccccttcctgcaccaccaagcacgtacgcagtcgcgctcatgtcatcatgatgaaaaaaaaatagcaaaatgccggccggcgcgcggccgcctcgccgccaccgatccatccatccgtcgccggaggttgtcacgtactaacgacggcgaagctacatgcaccaacgacgacgacaacaacaaaagagaaaaggtttccctccatgcgcgcgtgcatggctaccaagcgaattcgcggcgagagagagagagaaatcgatcgatgaggagctcgtttacctctcacgcggggacgacgaaacggtgggggagaggagtcgaggagaggttgcccgcctccgcgcgcgcgcggctgcctccttcctctcctcgaaagaagaagaagaagaaaaaggagagagggaggaggaagaggaggaaggggacgacgggactattcacaatggggcaggtgaatttcccctttcgttttactcgcttttttttaccgcgaaaaaggcagcagagtggacggtggttggggctaactcccacggggcccacctgtctgccatgtgaagctcacggaatggttaaaaaaaagacttggtaagaaaaggaaaagaaaaaggagagaccggaccaaaaataaccgttttgaccggtggccgcgccaggaaggcgatggccctaatatggaggcggcggcggccaccggagagcagcagtagaaaccacgggaagagtacgatctttctggttggcaatggcgattgagggggggcacacgagacgagagcgccatgaatgctgtccctgtgggggcgagctaggctttgctttgctccggcagatcgctcgccgtccatgtccatgagtgacattattgcttttgccattgctctgcttcagagcccgtcgcacgtacagtactgtgtcgcagatgtcgcattatattggcagtgaactagtgaaggcagaagaatgcagatgggtacccggccaagtactggtgccaacctacctaccaaacattcagcctctcgcttttaactttcacctgtctacaatcagtgcctcatcgtccagtctggggtgcgatatactcccaccatcacagaaaaaatccaacttaataggggatgtgatctctcctaagactataagggcccctttaaatcgtaggaatgaaaaaacagaggaataggaaaaacacaggattctgacaggaataccattgtaaaacaga

SEQ ID NO: 55466 - DNA, 1501 bp, Oryza sativa
cgtctgcgatgagggagttcttgatgaaggagagtcgcctgtgctctacctccatgtagatgctgtccgtctgatcgcccttgaagaggaggaagaagtaggtccggtgtacgatcgagacgttgcagtcatgccacagctcgatgatctcctgctgctttctctcgaaatcgatgtgccatttcgaaagggagaccgtggcaacttctttagcaattttcggctgcatgaatcaatagtagacagacagtacaccagagtgaaatcggcttgacaagagaaatgtaaatgttgcagtcaatggtttttatggagagagaattctcaagagagatttcccatttttactgtacctggtgttgctctgaagattggggtgcatggttcatttctgtcttctgcttcacttctgtgacgcagccgatgtcattcacagcagtctcttcttcagcattgcaggtgctcttgtcttcttcagcgttgcccgtgctcttgtctgcgatctcatcaggactcaggcttttcctcaccttctctggccttctggtagaatatctgaaggtttcggacgacggcgtcgtgctcgccgagtcatcgaaccagctgttcggaatgaccatgaagctagctctgcagcttctactcctagtaagcgcactgtccctggagctaaccacacacctcttcagggcaagagattcttcagtttcaggcttctcgagatcaaatgacggctcaaaatcacacgcatatagcttgatggcattttctgctgaatttgacatgctttcgctatgcttttgatcatcagtgtgtgtcttcttttcaggtgtttggaagaattcttggcttctcctgctcctgagcttgtttgtctcgatgcactgcacttccttgcagtgctcctcagggggctcagattcagctcgatgagctactctctgtgcttcgtgttcctctgtgatgtcagaaatttggctgcttggtggaaacgagtgaggtactgacagttcatccattgtttgatcttgatagtcaatgtcttgagtatctgaagatgaaaatgcaccttctgacacaatgcgcggaatcgagtctgaagaccgactctgtgaagaacatcagagtaaggttaaattagttggatactaaaacactgttgcgttgttaattttttttagataacacattagtgcataagagaagtacccatcgccttgctaagtgattgttgatatccccgtcgctcgcaactttgcggaaattatcaagctgagattgaacggtgtccttttgctccatcagttccttcaactgttcttccagctgaaaattcaccccccaaaaaaaagaacttcagtacttttcttggggacatttgaaagtgaagaactgtaaattatcatcgatgtgaagatcaaaacagaaggatccaagagcagtacacacattcttaattagttcatccttttctctgagaatctctgcatgagaagtgcaa

SEQ ID NO: 55467 - DNA, 1501 bp, Oryza sativa
tgatttgtaggaaaaatgtaggaattttggaggatttcaatcctatggaaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgttttttctgtggtccaatcaaacagccattcctgtgtttttcctgtgttttgcaatcctctgttttacaatggtattcctgtcagaatcctgtgtttttcctattcctctgttttttcattcctacgatttaaaggggcccttatagtcttaggagagatcacatcccctattaagttggattttttctgtgatggtgggagtatatcgcaccccagactggacgatgaggcactgattgtagacaggtgaaagttaaaagcgagaggctgaatgtttggtaggtaggttggcaccagtacttggccgggtacccatctgcattcttctgccttcactagttcactgccaatataatgcgacatctgcgacacagtactgtacgtgcgacgggctctgaagcagagcaatggcaaaagcaataatgtcactcatggacatggacggcgagcgatctgccggagcaaagcaaagcctagctcgcccccacagggacagcattcatggcgctctcgtctcgtgtgccccccctcaatcgccattgccaaccagaaagatcgtactcttcccgtggtttctactgctgctctccggtggccgccgccgcctccatattagggccatcgccttcctggcgcggccaccggtcaaaacggttatttttggtccggtctctcctttttcttttccttttcttaccaagtcttttttttaaccattccgtgagcttcacatggcagacaggtgggccccgtgggagttagccccaaccaccgtccactctgctgcctttttcgcggtaaaaaaaagcgagtaaaacgaaaggggaaattcacctgccccattgtgaatagtcccgtcgtccccttcctcctcttcctcctccctctctcctttttcttcttcttcttctttcgaggagaggaaggaggcagccgcgcgcgcgcggaggcgggcaacctctcctcgactcctctcccccaccgtttcgtcgtccccgcgtgagaggtaaacgagctcctcatcgatcgatttctctctctctctcgccgcgaattcgcttggtagccatgcacgcgcgcatggagggaaaccttttctcttttgttgttgtcgtcgtcgttggtgcatgtagcttcgccgtcgttagtacgtgacaacctccggcgacggatggatggatcggtggcggcgaggcggccgcgcgccggccggcattttgctatttttttttcatcatgatgacatgagcgcgactgcgtacgtgcttggtggtgcaggaagggg

SEQ ID NO: 55468 - DNA, 216 bp, Oryza sativa
taatttggagcattctcgaactgaaaggaaaggagttgttaatcataataataagatatatagtgcagcatttggaagctccatttcttgtacagatggaggtattactagtttaaagattgcataggcgttgattgagtacggcattttaacttgtacgagagtcgtcgtgacaagagaagaagaagaagatgtacacacgagatgagagagata

SEQ ID NO: 55469 - DNA, 1501 bp, Oryza sativa
tctctgcttacccccagcagcagcagccgccgcccgacgccgcctcctgcatctacaccaccgccttgccgctcatcgccgacccgcctgacatcctcgtgagctgcctcctcctcctccttccttgcacactagctaatccgcatgcatgtatccatggaatggattttcctctaatcgctctttctcttacccatggttcatgcatctgctctctctctctctctctttctctcatcacatcacacgtatgaagatatgaaatgaatgaagaaaaacagtcgctttctcttgttcctatttctttctgttttttcttgctccgttatgattaagatggcttgttggtccatgtactatctatgccaacaaaagccctcaataattcaccccttcactttcctcttttaagcaaagcaaccacaacatgtatgtacctcagacatttcatgagtgagatgactaatcgaatcgatccatccatcatccttaattgctgctgttgctttcctaatttctcttcaaacgcaaacgcttagctagcttcctaaacagagcaactaaaaattcactcactcacctttgagatttcttttcttcttccaccactactctactacatacatggcgtggcgaatgaatgaatgaattaattaaaattcatactctcacctttccttttcgcactcagctaataagcagctaagccaccgcgcgagtggtgcaagcaactggtcatgttggctgcaacttttcctttcctttttgtctttttcattcacatctttcttcctttttcatacttttttttctacttttctgcgcgcgcgcgcgcacacacatatattggtacatacatgcatcgcgcatgggttcagtctttgagatatttagtttagtggcagggaggggggatctaattaggttgagtcttaatagagcttttttggccaggatttctgatgcccctcctgtccatcagtatatgctctcggagcatgacagggacctgtaagttgacatgtactgcaccatcaacatactacatgcttgtagtcgtagatgtacccaaaaaaaaacaaaaaaacaagagagaggcatagcactacttgcaaatgcatccatatatactcacttttaattacttgccagccacactccacacacacactttgttattgcctcgcgcactgcttcctctcttctgcaatcttcccctcccctccccattgagagaggctacacttttctctactcaaattccctaggagtactttttttttctcgtcactctccttgccttaatttggagggaaaagaatatctacttactgctgtcgactcatgtagacaaaacaaaacaaagcacagtcattaatctgaccttaatatcttttggccttctctactttttttcccatagtaaaaataaattatgttttcactcctgaaacaaaaagtaaaatctactgaccagaaaatagaatgcttgttagtaaca

SEQ ID NO: 55470 - DNA, 660 bp, Oryza sativa
aacttggaccataaaacatgtagttttgtgaaatttactcttgaaattacaatagttacgtgcagcagggcttgagcgacttacgtgatgcaaaatccttcaaatcccgtatatatgcagccgtatatatgataggaagcatgcagagagcgtagcgtaggagatgacgacttgtttattaattccgggtcgatcgagttccaaattagatggcgagtctctggtgctgcataagccactggctagtttagtttgcaagtcgatccctgttgcgtctaagcatgataggcaggcaggcacactaataagccaagccgtatataggatggcactgtcactcaagattacacgccaggcgacccacgcacctacaccacgcaacgcaacaataagttgtactagaggagtatctttttctagttttatttaatcaaatcaacggccccaggaaatagttgttaatagtagtaggaatgctaggattcttagctttggtgccagctgagctgatggagtaatcaatctgtccctcttgtagtagtaggattttgttttatactattatcaggagtatgctgtagcacgtacgtcacgcacggaacgaggaggatcggagaatgtcgatataacaagcatcttgattgcaggatcgatcatcaa

SEQ ID NO: 55471 - DNA, 1501 bp, Oryza sativa
ccgtaaagcccttttatcatctaacttttttttttgccggcgtctccaccgtccgccgtcgccggcgttgccgatcaagcttgccattgctcgccgtcgctgcgcctgctttgcgaccggcacatagtgatgctttcaggaagcatacgttacgtacgtgcgcgcacacagtacatcccggtagaactaaagttttttatccgctgctgaagtgttgattactgaagtcgtagaaatggtttcatttcctgtgctgtgctggcgtgctgctgatgcatcgaaatggtagctccgttcagttgttcgcagatgatgtaccagaaattaggtgttcactttttttcttagtttaacttttataagtttgatcaagtttatatattaaaaaaaatagcagcatctaaaacaccaaaattagttcattgaatctaacattggatatattttgataatatgtttgtgttatgttgaaaatgatagtatgcatttttttataaattttatcaaatctaaagaagtttgacttaaaaaaaagtcaaagcgcttatgatatgaaacggagagagtacaactagaatgcaacaatggtcccagcaatggccactggttacttcttttctgtctcagtccatacccagatctgaatatacaatgtggccatccttttgatccaaccatccaggacaatgtcaaatggaaaacaggagaaaggtaactgatcatggggtctaccagatcaatccaatgattaaaggctgagcgcaaagagaatggtaaaaaggctatgcgagtgtgataattcccagagaaaagcatatgcatctttgcagatctctcccacatgcagaaaggtacgaagtttccttggatggatacatatggtggagtcctgacaagctgtcattttacaatgatcaggtttggagggaggatctaccggtacattatacctgatgaaaatgaaagcaaacaatgccatgccgacagtctgccttgtctctctgcactattcagtctatggatttcatcatagagaaaacagcccatacaaaagaagtcttcaccactactgaaacttattacattatattgtgaccagtaagaaaaaatattgataaaagaaaataaacagaaaataaaagcactagaatgtgaggtatcatattcaaagaacagtaagtatctacttttgactccaacgattcaattatcacatttccatcacatattcagtttggaatgtagctcaattgatcatgtgaagtgtggtcttaactgaatcagaacacgcttcagaggtacatatctatatcaaacttattatggcgaagagtaaagtttaaattatgcacagttctgaaccaattatcgacgaagagcggtatatagtcgccatcacctctcacgctttctcttcataggcagcaaggttttcggtttctctgaccgtacgttcactgatccttcatcttcaatcaggcgtctaccaaggtgtgatgat

SEQ ID NO: 55472 - DNA, 1501 bp, Oryza sativa
gcagaagatatgcaaaatcagaacaaacttccttgatgcctttaaatgggatgattctctgtgatgctttttttaatggccgtaaaataccgccagcgagatgacgtgggccgtaataacaacttactatcatgccctttccctgtgtttcttaatgggctggaacgtgcatccagggatgacaaatgggccgtaaagcccttttatctgtctttcttagtgggctggaacgtgcatccagtgagatgttgatgggccgtaaagcccttttatcatctaacttttttttttgccggcgtctccaccgtccgccgtcgccggcgttgccgatcaagcttgccattgctcgccgtcgctgcgcctgctttgcgaccggcacatagtgatgctttcaggaagcatacgttacgtacgtgcgcgcacacagtacatcccggtagaactaaagttttttatccgctgctgaagtgttgattactgaagtcgtagaaatggtttcatttcctgtgctgtgctggcgtgctgctgatgcatcgaaatggtagctccgttcagttgttcgcagatgatgtaccagaaattaggtgttcactttttttcttagtttaacttttataagtttgatcaagtttatatattaaaaaaaatagcagcatctaaaacaccaaaattagttcattgaatctaacattggatatattttgataatatgtttgtgttatgttgaaaatgatagtatgcatttttttataaattttatcaaatctaaagaagtttgacttaaaaaaaagtcaaagcgcttatgatatgaaacggagagagtacaactagaatgcaacaatggtcccagcaatggccactggttacttcttttctgtctcagtccatacccagatctgaatatacaatgtggccatccttttgatccaaccatccaggacaatgtcaaatggaaaacaggagaaaggtaactgatcatggggtctaccagatcaatccaatgattaaaggctgagcgcaaagagaatggtaaaaaggctatgcgagtgtgataattcccagagaaaagcatatgcatctttgcagatctctcccacatgcagaaaggtacgaagtttccttggatggatacatatggtggagtcctgacaagctgtcattttacaatgatcaggtttggagggaggatctaccggtacattatacctgatgaaaatgaaagcaaacaatgccatgccgacagtctgccttgtctctctgcactattcagtctatggatttcatcatagagaaaacagcccatacaaaagaagtcttcaccactactgaaacttattacattatattgtgaccagtaagaaaaaatattgataaaagaaaataaacagaaaataaaagcactagaatgtgaggtatcatattcaaagaacagtaagtatctacttttgactccaacgattcaattatcacatttccatcacatattcagtttggaatgtag

SEQ ID NO: 55473 - DNA, 660 bp, Oryza sativa
aactatctttttttctctcttttcttgtacggtgtgatatagcagcaatgcatatcattatcacctaagttagctagcatatcctgtggccttttcattccaaattaaaccaggcaactattttagccagctagcaagacatatttgtctggtcacttcaaatggcaccgtgtatacatacatacacgtagctgccctagctagcttcaccaagaaaacgataaaaatgtaatagaaatgcttaaggaattggaataagcaaaagttaaaatgaatatgggatggggaaaaagttagtacttgatcttctcgtcgtaacggctaacgagaagaaaaatcttcttatgggaagtgttcccatccatcgagctcttatatggtcaattaacgagattgatattgttttttctataatgtactaatgattttattggttgttctacaataaatcattggtttagattttttctaagactagaaaaaatacatgtgcgttgcaacaggtgaagtctattttaatcttattattgttcttattattgttatatagtttagttaagatgaaattcattgtaggagttcgcttggagatatatatatataatatattgttatatggtttagttaagatgaaattcactgtaggagttcgcttggaga

SEQ ID NO: 55474 - DNA, 1501 bp, Oryza sativa
agcacatgtttgaccgttcgacttattaaaaaaatttatgaaatatgtaaaactatatgtgtacatgaaagtatatttaacaatgaatcaaatgatatgaaaagaataaataattacttaaattttttgaataagacgaatggtcaaacacgtactaaaaagtcaacggtgttaaatattttgaaacggagggagtatatcgctattcaggtaagttttgtgagggagatttgttcaatccctctcttgatgttcttctcctcccaacgtaagtctcctcaactctagcagcactatcctccggctgtgcttatgtcatagcgttggaccatgacacaggacttagtaaagccttatatgtaagtacgtgccatgggggtccggtgtaaaatcatggggctgtttcaaccaacattcactgcacgactaccaaaattcagcagcatatagtaactccttttaccctcatgacagccatgcatgatctctgcaccacacaactgtgaaacgctgcagtataaccaccaccgccgagcctcctgattcacacttgccgctatgactgtcagtagcctttttaccggccaacctttcttgttctggctgcagatcgatggacggatgcccggacgactttcgatcaggggcgtcaaactgtcataaacctgaaaaagcattggtcattggctcctgttaggactgagatgttccgacatgtttgttacccgcggttatcaccatttatcaatagaagttattactacatccgtctcaaaataagtacatctagtatatagcacatcttatataaattcgtagtattaagatatatcacatccaacattagatgtgtttattttgtgacgaaggaaatatcaaacttgcataaagttaatccctaaaatctgtcacatcttagcaaaacaagactgtttggaaagctattgattatgagaagctggtgaatagctggttggtaaaaatctgaaaaaacttgatttcttagtttctaatttctagtttattttttgaattttatagctacattttttttgaaaaatgtggattgtttagagagctcgagcctgaagattatagaagaagttgcagtaactagaagcttctctaactatggcccaaaagaattttgccatatatacatgtaggatcaaatttattaaaagaaatttttgttataactctgactataactagatagttgtctaagttaatcaaacttgactactattaaagctctaagaatgtagcctttggctaaatcttattaacaaatattgtatgtttctatacctgtctgagttgatcaatggtcaaagtgatcgagaaggttagtagtcaagtgatcgagaaagttagttgccgctttactatatcggctactccctctgtttcgtattataaaatacttttgactttgtcttaaagtattgctatgcttgttgaaaatattgttatatttgtttataaacttaattaaata

SEQ ID NO: 55475 - DNA, 1501 bp, Oryza sativa
aaaaatggggttgcaatagaagcaaacatgtgaagaattaatgatgtgcggtaattacaacattatctaacaactaaaaagccgccaaatctatgtgcaggtaggcaatcctgatacatagtttcaggtagctgtgcatagcaagcaatcattttcccaataaaatgatactaaaaaaggactaaactttattgttgtgatgatagatgcattcagaattggcggcaaacaacgtaacggcatgcaagcagcaaattcctttgtagagattattagaacctttttacacaacaaattcctttttttttctcttgttttagatttcagaatttacaaaccatttagccatcaaaatagtcagaccgactactctataatagaagccgaaaccttttgcctagagcctaccaatgatagtgaaatattagcctaaccagagattaattcaatctaacatatcatataaaccatgctacaccatctaactttaaagaaaacaaagaatcaatatgatcttgtagattcacatatgaaaattactagttcccatcttacgacattgaggctttatcaggaaatgaggaatggtttcatttttatgtattcatttcaaacaaacatctaccattggaacaattcaaaactacaagcctgcaacttctcctaccatttccttggacaggttaatagtacagcgtggcagggaaaacacaaggccggccctgagtcagggcagtcagggccccagaccacacacgtattgtttggaagcccaagcctcattagcagatgtccaacaagcatatcagtctgcgcaggtcacgaagcatcgaagctatctcattcccctcgacccttatctattcccgaaactacgctgggttagctagcatgactaaagcctaattaagtgtgtcatttgctgcatgtaatcccgtcattcagccactgcatatgtcgtactctttaagttttttagatctcactcctttgcttcagggttgaataacaccccaaagaagattgacaaaaaaaagatggaactttgatttcttttggttctaaagattgccattagagttgattggttatgaattcctcattcctgtgagttgttcataataattagtttctctagttagtcagcaagatctccttgagttgagtggttggttggtttatctcatagctttgcactgattttctatagttggtgtgtgtgtgtgttttccctttttaggagtcctctaacagattatacccttgaggagattggcttccacgagttcttgatgatatttcggtttctacaagatcacaaaaatccaggtgattctgctccctattattcagagtttcagacttataactgataatatctggatctgtaattcaaacatgagggatatttgcaatttattaagattactgatgatgatacattcaaataaaaggcctctgattttttctcgccctgaaccccaaaagttcaggacaacaa

SEQ ID NO: 55476 - DNA, 1501 bp, Oryza sativa
tatcaatatatatccaaaatatttcactcaacaaatcaacaaatcataggatcattcatctttgcttcatttgggattgtagcattgtgctgacctagcttcgtggctagaggcaggcgacagcatgaagaaggctggaggcagcgtgctcatcaatggctggaggcggcgggcggcgtgacgacggttggaggcagcaagccacgcgacaacgggtcgacgactggaggtggccggcggcgtgacggcgtctggaggcggccagcgatgcgacgagggctggagacggcgcgctcgtcgatggttggaggcgaccggcggcacggcgtcggccaaaggcgtcgggaccccgcccacgcaaggggacgcggtggcgcacggcacgcgcgtctagagcagcggcagcgtcagcggcggcgctgtggagtggaggactctaatggtgtgtgctgtgtggtggagtggggattggggaatggaagggctgactagggttagaaactatatatatatatatatatatatatatatatagacacacacacacttttgttgttgggcttcaattttatggaccaaaacgattataaagtctaaaatagctccctagctacagtaaatgctggtcacctcgggggatggggacggtgaatggagcaccgtctccgcccccgccatccccgatagtgataggttctggaccattagattcaccatgggtggtagatatcaatcatccccgtcccctaatgtgtgaaatcaccgcggggaatcggtgatcgggtctccattgtcatctctagtcttggggacgacgcattcccttcctcctctcatcccctccctcacacgccgcgacgcctcctcctctttccaatgagcagccaaaccctagcaccgtgcaatcctcactccacggcgccgcgcaatcctctacgtcgcctccatgtcctccttgccggcgctggcggcagcgcgggatcacgccacgtgagagctcaagcggtgccgccgcacgtcacttcggcagcgctgggggggaaggatggggacgccggaggtgacggcgacggagcgaggcggctggtgaacatggatgcccagaagcagatcaggatgggtgattcgctaccaattgtgccgtcggtggcattcatcagggttcatccgcaggctgaggtaagaaatctgtgttctcgcggttgtttatcatgcagattggatgggaaaatgacctctttccctatggcatggatcccttcagataatcagattgctcatattgtttccctgtgtttgattcttcatacctttttttttgtttctttttgtcagcagtgaaagcaaaccaggggactatatgtgcattggagggtgaagcttggtgagatgcattcatctgtattaggacgtgcgtgttccctttgtgtttgttacagtagtttatataggatttggaataaaaaaggggacagttttatgtgcaggggtgcttttggct

SEQ ID NO: 55477 - DNA, 1501 bp, Oryza sativa
ttacagcttccagcctgcaaaacagagaggggatttgacatgtaagcatgcttggctttgcaaaaaataacagggaaaatttggatcacaggtagcatttaacttacatgcctagactccttgttgaccaatctcacctcacgaaaaccagaaaaggggcgaaaaatatctgcagaagaaagagttaagggcaaaagcacctaggaggtgtaatatgaattacgtcgcaaaagatacctagactaattatagctaggaaaatgtgattttagtttacaagcatagaaaaggatacgtgcaacctctctctttgtgcagttcgaaggtagtccttccacatagagagttcttgattcagttcttgtagcgccatggattccactgtccatgcccactgaatatctggccatcccaccaagtggaatcgcactttggttagtaccagcaacataagacatctgcaactggaagataattactatgttggtaaaaaagttgctagcctcaaatcaacaaacttataatcaatatgctacctgatcattcaagtgatggctatagagggggctcattcattcatggaagaggccatttccctgttccagaaggcatatctacaaacaaacgtgtaaagtgctaaaatatttaaatgcacattccacttggagaaaatacattaggcagaaattagtgaacagtctcgtcaatatttttctgagggcaaaagcaccaacgaggtgcaatatgaattacatcgcaaaagatatatttttacctagactaattataggcaaatatgatcttagtttagcagcacagaaaaggagcaatccatgtgaattgaaaaacacattcctagatatcagatgcactaaatttgcaaaaatacagtaatagaaatgtttacatgaaaggacacgtcaatcctctctcctcgagcaatgctaaactagtgtacatcccacttggagaaaatgcattaggcagaaactagtgtaaagtgtcattaacatttttttccctttccatttaagaagttacaataaatgggagtgcaacagaaacaaacatgtgaacagtcccctcaagcgagaggggaaacggaaagagaaaccttaacggagaaacaaaaaaccacagaacccccacttcagctcacaccactgatgaatcctgcaagactgcaacaccaccagcgagcagatcaaccaccagccagccagccagtaagacgcaccagattactagagaattagggaaatctctgacaggttgatcctatattttgtacatagcagttaccatggcatctatttataaaaattgacgggttcaccaatataattttgtgaaacaactaaaaaaagcaaagaaaaaaaatacaagagaaatttctttgtctgggttatgaaatcaggcaattgaggtaaccattcattttaaagaacaacaaagattgaaagccattagtgagaaatgttagtgttgtactggggaattg

SEQ ID NO: 55478 - DNA, 1501 bp, Oryza sativa
tatttaatgctccatgtatatattcaaatatttttttagactgatgtgtccaaacatttgatgtaacagaaaagttggaagtctgaatgtaactaaacacagccatgaactgtaacggaacgaatagtaaagatcaagattatttccagagagagcgtgagcaaactgaccggccggacagtaggtaagccggccagtaggcaagcgagtcgggtgaagtttgaaccatcgatcagtaagtaggctgccttgtttttctgcatcttatccctcccaagtcccatcgctatgctccagtgcgtcgctataggctaggagtaggagtttagggagtgtttacgcatggtttagttctcaactttttttttaaacttttaacttttttatcacaccaaaacttttctacacacaaacttttaacttttccgtcacatcgttacaatttcaatcaaacttataattttgaagtgaactaaacacacccttagttcactccaaaattaaaagtttgattgaaattgaaacgatgtgactgaaaagttagaagtttgtgtgtaggaaagttttgatgtgatggaaaaattgaaagtttgaagaaaaagtttggaactaaactcggccttagttgattggccaaaattttctccagtgcgccgctacaaaataaattatagattctacttgtaaactgcgagacaaatctattaagcctaattaattcatcattagtaaatatttactgtagcaccatattgttaaatcatggcataattaggctcaaaagatttatctcgcaatttacatgtaaactgtgcaattggtttttttcgtccatatttaatgctccatacatgagtcaaacatttgatgtgacggaatttttggaagtttgaagataacttccaaacacagccgcatcattgctggacacgtctatcaatattgaacctgcatatctacggccgtgtttagtttcctcctattcccaactttccatcacatcatatcacataaaaacttttctacacacgtaaacttctaacttttttttcaaacgcccaactttcttcaaactttcaacttttttcaggaactaaactcaccctgcattgcagggaacgacgacctttctactcgtatcctatcgatctcatcaccgcctacacacgttactttcactcttgtactccctccgtccaagaaaaagacaatctatgaggagaatgacccctctatatgaatctggataaccctctgtcacattttcttctaggttgttttttttacggagggagtagttcgggtaagagtacagtacacacgttacttctactcctgcaggagtatgtgatggtacgtgtatttttttttctttttgtgtgtgcctacttataatatgaaaaaaaaggggaaaggcctattaatttagaccatatagtgtgcgtatataagcaatatagaagagagtagtgtgggaaaattgtaaaatgaaaagtaataa

SEQ ID NO: 55479 - DNA, 1501 bp, Oryza sativa
tatatttctgcaaaagtgtttgcatcccgaatattcctgagaaaaaattaaatgaacagtatattttcaaatttaaatcgtttttctgtctgctgaccgaggctactgtgtggtaaaaattgttattctcctctcccagagtgcagaatccgatcctggccgttctttgccattttagtttgatgtgccaatttaattatttattcaatgtgtttaaaaaccttttgcctcagacaaaactctaggtttgtcaggcttctccatttctcaatcttatcaagatattcaagagtgcatttgtttgctgacaacagggttggcaagcttcgttttcttctgttccaggccttggccctagctcttaatcttcttagtttatggttgaatttcgtgattgctctcattggtcttgtaccttgaacccagctttcttccactcagctgacaaaatctggtaattgtagccagaaattttccaaacgaaaaatatcggaatgtgtttgagttgtttgagcactcggccagaatagggatatgatccgaagttgtcgccactagggctctggcagatgaggttgcgaacgattggttccagcttgtgtcgacaagaatcctgtcaagcttcaccagtgtgggatttcttcttttgttagaccaagtgaaacttctgttgggaatgtcaatgtctacaaggccttcttcatttatccaacagttgaaacccaccattcctcttgtgtttaagttgtcgttgttttcctcaaaagggtatctgtagatattaaaattcccaatgcagcaccatagctctttgtttgcaattctgagcgttgaaagttgattaaagaagattagcttttcatcttccgaatggggggcgtatacattagtgacccagaacttggtttggtctgttctcgagtggaaagtgcaggagatggagtcgctgttttcgtgaaccagagtggttggcagctctctggagtcccaagctgttagcaagcccccagctgagccgagagcaggctgccaatgaaaatctcgtaggaaaacaggaagaagagctggcattgtgaatctgtctatggatgcaagcttggtctcttgcaagcaaactatgtctggcctatgttcaatcagagtggacagaagtagagattttttttctttttgtctcctaagcctatgatattccaggatagaattctcatgctgagagattaggcgacggaagaaccaaaacagaacagaggatccaaaaacaggaaaagagccagaggagcaaaatatccccctcgaaaacgcaatgaaaaacaagttgtcgccaaaacctaagccgcggtttaggagaagacaaggaaaaaggattgggatggagggcacaggcggggagacgtgaaacgagtaaaaggacgaggcgataacgggaagacagtgaacagcgggaaagaaaacgattggaagtaaagaaactgctggtactcggcttacaacattcagg

SEQ ID NO: 55480 - DNA, 1501 bp, Oryza sativa
atcttgatgagttattcaactttgttgttgatgactttttcaattgaaatcgtttagtatttgaaaatgttgttgaatttgttatattttcaaattcaaattcaaagtgttcaaaaaaaatgttatatagaaaaatgaccaaactaaaagttgtaaatcttgataagttatacaactttgttgttgacattttttctatttgaaatcatttactacccgtaaaattattttgactcataaaataaattattatactgcatttaattattttgctatagttcaacttacaaatataaacatttcatatgaaaaatgaaaaaatagtcatcggtgacgggctttagttaatgcccgatagagattaagtatatagcccgtcactgatgagtcatctgtgacaggcctagttgctatctcaaacgggcctcaagttggtgcacgtcacggatgatggtcatctgtaacgggctacaacttgaggcccgtttaagatatgaaatgttatctcaatcgggtctaaagttggcgtccgttggttatctgtgacgggccacaactttaggctcgtttgagatatggaatgttatctcaatcgggtctaaactacggcccgtcactgataggtgtcatccgtgacgggcttaagttttatgcccatctaatttgtctgtgcgaccataactcaatcgggcactttttgacccgattgagatgacttccttatgacggcccgctatttctaggcatattagagcttgtcacagatagaaggatctctagtagtgtcggcgttcaccgtggcggccgcaactggagctccggctggcgcggcctctagcgcccgcggcatctaatttcttcaggggaatgagcccatctatctatccaagtgaaaggtgaattctgctttgatcgtagaataagccacgccatctgttgaataatgaccgttcgatgcaacacaaatttaatatgtaccgttggatatagtcatccgcagcaccgtccaatccacatctcgctataaacacctggagaaaaaagtgaggtctggacgagcacttcccgaggaaaaaaaatatgaattagctaggaaattaaaaaaacatattccctccattcacaattaatcatcctattattaaaataaaaaaaagaattgatcgtcccataacatgtggagccagcggaattcctattttctcatgtgcatgcattcaagaattcagcgaggagagattactggttggatgcaagcatatgatttgaatgcacagtaattagtgggtgattagtttgtcatttggcatgcgctgctagcgtgcatgcgtgggccatccaaccgacattacggcgttatggttttctgaaagttaactgtctctcaatttatttttttccttagtactgttgcacaaacacaatgtgaccatcaattgcgaatggagggagtactggcatccctatctgcctgttatcgccatctgccttgcacaacaga

SEQ ID NO: 55481 - DNA, 1501 bp, Oryza sativa
tctggtattacatgtatttggctagcaattaattaaccgatactttgatgcgtccaattgatatttgatatatattttaattttttcttgtagaacggccgccatttaaagtacgtgaagaaattactctacttatctgaagcagcaaaagaccaaaaagcagagagctacatagtgcaatttttataagagtgaattgcactttgggccatgttttattaccaaagttttattttggaccacctgtacttaatatttttactttggactaggtaaccttacctttgttgcacaatagactacccaaactcttttcgcttgtgatgtctagcgtctctttcgacaaaagtatgtcatgtatataggtatgaaagtttgttggcatgtcgttaacaatttgctcgaagtcatcgaagaaataaaaatgtgttttggggtggtccattgtgcaacaaaggtaaagttacctagtccaaagtaaaaagattagataaagggtggtccaaagtgaaactttggcaataaaacatggcccaaagtgaaattaactctttttataaagaaagaaaagcagaatatacttggccaagcaaaaaaaatcttcaatgagaaacgtagtagtatatactgaccaaaggagcattatactcctttaacgaaaaaatgagtatataactcattaaacttgaaatgcagtacatacagaccaaacaaagagatcttcaatgaggaatgcatatatactaactctttacattctgaaaaaaatacatactgaaaaaaagagagaacagtatatactcctaatttagaaatgtggtatatactacaaatctagaacaggtggcatatactactctagagataacggtatatacttgtagtcttaaaaaaaagtggtatgtactactaatgtacatctcaaattttgaacgtacgtgagcattcctgtgtatgcatgcaaaaaatttgaaaaaagaaaccgagcacggcccatggacatgcatccatgcgaacgcacgacgttggcaggagagaggaactacgagcttgagatatgcatcggcgtcatcatcattcatccttgcctctgctttcgtggtcaccatcgccatcgccagacgccagctcgactgactagcaggcattgttaagccactgactgactaaatatttatttcagtaatataaaatctcgactaaattgaaaccatgataaaaacaatggtccactatatagtttattattacttttcattttacaattttcccacactactctcttctatattgcttatatacgcacactatatggtctaaattaataggcctttccccttttttttcatattataagtaggcacacacaaaaagaaaaaaaaatacacgtaccatcacatactcctgcaggagtagaagtaacgtgtgtactgtactcttacccgaactactccctccgtaaaaaaaacaacctagaagaaaatgtgacagagggttatcc

SEQ ID NO: 55482 - DNA, 1501 bp, Oryza sativa
gacttcgatcagtcagtttgtagagtcatacactctccctagcccccagccttgtcgtcggagaatcgttctcggaggataaggctcttggacccttgacctgcctttgttaaataagcgctgatcctaaccccaagccgtgtagttggaaagctcagtttccgattacacagcttggttaatacggacggcgagaactcttacacgaccagatcttacatggtcttttgtctctacaagatccgacaaggccttatcggctctgggcgtccccagccgaagttcccttaggttcctcggaggccttgtcaagacggcgtaaagggacagtaggataggtttcaacgctaggtgtcgtcatggtaagggatctctgggtaaaacacttggcgatattgtgtacctgctatcaactttgttgaaatagaggtagtaggagagtcgctacaccgctggtcgaggatcaggtagtagtcataactcgaccacttgaagtggaaatagtggaagaatcgctacaccgctggtcgagaaccagacagtagtcgtaacttgaccacttaaagtggaaatagtgggagaaacgctacatcgctggtcgaggaccaggcagtagtcgtaactcgaccacttaaagtgaaagtagtgggagaaacgctacattgctggtcgagaaaggcagtagtcgtaactcgaccacttaaagtggaaatagtgggagaaacgctacatcgctggtcgagaaccaggcagtagtcataactcgaccactagaagcaaatgtacgagagctcactacgatcaactggttgagaaccggtgagtaggtgtctctcgatcatttggagtcgtggtacaagaaccgctacgctgccggtcgaagaccagtcgtagctgttcctcaaccatctgaagttaaggtgcgagagattgctacgtactggtgcgagaaccagcgagcgagtagaattatctctcgagcaccaatggaagttgctagagttggtttattacatgtgtatctcatgtggccagcatgactcacatacccaacttatagcatatccggatatccgtttgaaatcatgtcgggtgatcaagccgacggcgttcgcgaggaattatccgttaacaaccttttctcgagtagtccagcgatggccggtgctatgagataggtcgtcggtcttcgttggcaggttgggtgcgataactccgcatttgtcgagaatgttctcaataatggagtgtactcgaccataacctactcgagtgctcaatttttcctgaaaaatattttctagaaggcaagatatatagcagataatatcgagtatgtactcaaaaaactgcatggatcttctagtattatcaggatacaacaaacagatgtaaatatcaggcattatgtaaaccgtaaacaagcatgatttatacataagagaacagagtgagcccccagcgttagaccgtagttggcctatcgtcggaagtactcgca

SEQ ID NO: 55483 - DNA, 1501 bp, Oryza sativa
ttatcacaataaacggaacataatcttgctaagagattgtacaactgggaagcaaacaggtaaatactaacaacaaagagagccaggagctactcatcaaagaacaaactgcatggataatcagtgcaagaaacctacatccatttccagaccaaagccgcatttctccaaacgaactctagatgcaagccatcttctcaggcaatgagattgtaacgaactgagagccgctcattcagcgggctgcggatccaccacctcgctctcggaagaagcagcgggggcatctccctcggacggcgccgcggcggcggcggccttggcggcggcagagcgggacttgacgaagtcgaggaggcggctgctgacctccttggagtagagctgcagcgccttgatgccctcctccacggacgccgacgccgcccctgctcgccgtcctccgcaccccgtctccgccgtcctccgcgccgccctccaacctcgacggcgtgctcgccatgggcggcggccggccgcgctatcccctcgccatgggcagatgcacgcgccagctgcccagctgctccccagccgcccgcgcgccgcttttccgccgccatgccgccgccgccgcctgccgcccttctcgcggcgtcggatgagaagagaagagagagagaatgaagggagagagattgacgtggtattctgacatgtgggtctcatgctgactcagcagccacgtaggataaaatcgggatcaaaacccacctagagacctattgtgaccgattttatatagttaaaggacctcgtatatctggttttgcggttgagggacgattttgtaactggatgacaagttgagtgaccttcggtgtactttttccttccctgaatgttgtaagccgagtaccagcagtttctttacttccaatcgttttctttcccgctgttcactgtcttcccgttatcgcctcgtccttttactcgtttcacgtctccccgcctgtgccctccatcccaatcctttttccttgtcttctcctaaaccgcggcttaggttttggcgacaacttgtttttcattgcgttttcgagggggatattttgctcctctggctcttttcctgtttttggatcctctgttctgttttggttcttccgtcgcctaatctctcagcatgagaattctatcctggaatatcataggcttaggagacaaaaagaaaaaaaatctctacttctgtccactctgattgaacataggccagacatagtttgcttgcaagagaccaagcttgcatccatagacagattcacaatgccagctcttcttcctgttttcctacgagattttcattggcagcctgctctcggctcagctgggggcttgctaacagcttgggactccagagagctgccaaccactctggttcacgaaaacagcgactccatctcctgcactttccactcgagaacagaccaaaccaagttctgggtcactaatgtatacgccc

SEQ ID NO: 55484 - DNA, 1501 bp, Oryza sativa
aaatctagcctgaaaatttaggcacaagcatgaaggtatccagcgagtaataattgagagacataagatagtactagtaggattttaggatttgagtttacagacagacttagtggactttttatttttgttattatattattattgtcaagcaactcggttatcttttcatgattgccactagtaggaagtaaacacaaatccaccaaaaaaaagagaggggggattcgtaagaattatgctatctaagtttatttttcactcattccatatataccaatacaaataacaaaaggatagaatacctatctgatcccaatgcaactcccctatgagcatcttcgaagactggccacgcacgcacactcacccctatgagcaatcttcgaagattggatcggcaaatctttgagattgacgaagtcaccaccgtcactaaaagcacaatgtcgttaaattttggaaaattcgtttttatgggaagttgaacccataacctatggtgtcgttaaatcttggaaaattcgttcttatagagagtcgaacccataatctaaggtgctactgaggctcttgtaaccactagattacatgcgctttcgcaactattactcactttatttactcttaatacaattattccctacttttgtaaacttcgatacaattattactcaaaaataaatttatttcgaaataaatgagaggagctgatgaacccaatcaatatggaacatactccctccgttccaaaaaaaaaaagacaaaccccgcgtttccgtgtctaacgtttgaccgtccgtcttatttgaaaaaattacgaaaaaaaattaaaaagacaagtcacacataaagtattaactatgttttatcatctaacaataatgaaaatactaattataaaaaaaatttatataatacggacaatcaaacattggacacggaaatctagggtttattttttttggggggaacggagggagtaggtagtacattggaaattagaagaagcattaggagagattgatggcggtcgctggcaagataggagtagtagagtcgcgggagagaaaggagggaggcgagcgagacgagaagatgatttgatttgatctgattttggttaattttgatttcgatttgatggtacgagatacaagacgagctggtttgtccacccacgcacggcaacgccggtcggtcgtcgtgcaacggagtacgtgatcgaccagggtcggagtggcatgtgcatgcgatcggcaacaacgtcgtgcatctgcacgacgggtccgggtcggactcggacggattacttccccgtccatgtccagatttccttcgacaagttaaggcgaagctactggggcgcggttccgggagcgcttaagtcctaactaacctgttttagactctaactaattgaattagttttagataatagtgataattaagataagattttttttgaacggaatgtttgttgttttacgtcgtgcatcat

SEQ ID NO: 55485 - DNA, 1501 bp, Oryza sativa
caacatgcccaccgcgctctcttgcaacccagcactgcacgcgccgaacaccccggagccgccgcctgcacccgcgccgtgcgtgtcttgggagaaatcgagcacggtctgaccttgttgctgctgctgctgtcgtggtggcggcatgcggaactcgccgagatgtaacctcgccgctgcatactccgccaacatccctagcgactccatctgaggcagaggaatgcagtagctgatgctcctcagcaactccatcgccgagaacacgcacccacactgcccctgccaccggcgccattcaccgccgccaggttgcctccggggttgcacatgctgctgctctccaagctcgggaacgccgtgaactccagcgactgcagggcgtggccgtggtgttgcgggaatgctaggttgaggtcctgcgcgccctcgtgcatcagcttcaggttcttagccgccagccccacggggaccgagccggacaccgccgcagaggaggaggtcgacgcggccaccgatgacaccacgaggacgacgagcgctttttctcccgtgccattgccgtcgtacgcgcctccctcctcatcgtcgctgtcgtcctcgtggccgtcgccacgtctccaccaccaccccaattgccgctgcaatcgctaaccctagaaatcacacaggtggaggatttgggggagaatggttggatcggaaatgggggagccaaaatgtggggggctaaaatgcaagtatgtttccaccgtggacggccacataagcaagtcaacccagtcagaggcgctttagacctaaatgattcacttaaataagatcgcggactcgaatgacgattttcctatatcatagaactaagtgacacctcactccaactttaagtaccggccatgtactttactctttaaaaaaaagtacgaatctatcgtggtggagggggtatacaataaaccaggagcgcacggcgcgagacatctatcgtggaaaaccttgcagcgctgatgatgaggttacaactcgcactagaagggataccatcatctcaatcgggcggtaaaccccatctcaatcgggcacggcgtccgtcacaggctagaagtcacagatgtgaagagttatctcaatcgggcaaacggccatcacggatgaatctatctcaatcaggccctaattaaagcccgtcaccgatagctttgacctagacgaccagtcaaactatagcccatcacagatgacctatctcaatcgggccacaactagcgcccgtcacagatgacccttatctgtgacgggcattaactatggcccgtcacagatgagtcatctgtgacgggcattaactatggcccatcacagatgaccctcatctcaatcggacctaagttaacgcccgtcacagatgagtataatcaaaaaaaataaattttattttttggctagtctcaggcctcctaggctagtctttttttgtcctcacttgaagttcaaactttcc

SEQ ID NO: 55486 - DNA, 322 bp, Oryza sativa
ttttactgctttccttctcttgttacaaactcttttgtgggtttgtgtgttttggctgtgtgcatcctagttatgcagaggccgggagttttcttagtatggttctatcaacttgatgtaatcgtctgagattaataaaagcttcctttatcaaaaaaaaaattggctagtttacctatagtatcatactacctcattcatgaccacgaactgttcatgagctaacctgctcaagctcaactcaactagtacaacatggcattcagttcatatccatccatgctcaagagaagaaattatgtatatactcctaatttttagc

SEQ ID NO: 55487 - DNA, 338 bp, Oryza sativa
ccaaagacactagttggttttgtgccaacaaaattttgacttaaaaattggagtatgaataaccatcttgttccctgcaacttgagcccactttccggccatctctattattgcatgacccttttatctagacttaagaaatagcacaaatgctaatctcatactcgctccttttctcattgtatttcattgaaaattatcaacattatagagtgcttcttagaacttttttcaatgtattatacgtacataagtctggataatttaaatcatatttttttttcaatctttctttagttttctccttcccctcaccttctttcttgggctttctcaga

SEQ ID NO: 55488 - DNA, 1402 bp, Oryza sativa
agacaagactatgtcaaaattcaaattcataactagagttgatttagtttaggacggagggtgattcttcgcatgcggttgatcaactggcccccgagggaccggtttttgtaggcacggtcaattatggtccgcctgcaatctattggggtgatcgtctaggaaaaccatttgtgtagtagtgtatgcagcagtgtctgggatcatgattttgcttcgttacggattgaggtcgcgaagtgaatcggactaaacccacagactgacaacgtaaacgttttcaatttttaagtatggtatgatatgatgatagatatagatgcagggtcttcgtttttgtgctgtcactttatgtcacaggctcacagcaatagtcttctctgtaattgaagcagggcttccacatgatgttcatgcagccggccactcgaccaacttaaagcctcagtagctcagtggtataagcatcaggaggttgccgttgcacatgtgaactgtagcatttcagatttgtgcagattgttttttttagggaaattactaccagtcaattgcctagtaagttatatattaataaaccaaaatattaacttgtgcaacttgttgtcgtctttacttttagccacaattagttattctatcttctgatgacaaatgcagttatgcactcgagaaattttaaatatctacccattcttgcagactgaacaatttcaaatatgtgtaacttgggatctttccttttaaacccttctctaaataagacacattttttttcttttataccagaggtaagtaaggccctgctttcacggaaggcaaacatgtatagtgtttttttatgctgtggataccagctacatgccagaccgaaaacagagaagggctcacaccatctaccaaaaacttcagaacccttaagataagcatacttagggttctacatcctggggcaaaccccgagatactccaggctataagcaagacaccaataactgacatacaactattggaattaacttcattagcgaacaaaaggtcgagatcactgcagattgtctacagcttgatgcagcaagatttcggcatttccagcattattccaagttcatcaggattcaaaagcaccttccaatataccgagaaaatgacgcaaaaaagaaaatcacagttagagggctggaaaggagcttggttttaaatatcataccattgcgcacaattgcacaaacaaaagaagccaacaaacagcagaaaacaacatcattttaagttttaaccctattcttcctagcaccagcccccgattgcctcaatgaagtagtagtgtttagaacctcacggcggaaaatttcatccacaagcattgcaacaaatataatacaccaaacaaattgtgcaa

SEQ ID NO: 55489 - DNA, 1501 bp, Oryza sativa
ttcgtgattgacaagttcgcgcaagagttgggtatggtgcttcaatcaattgatgcagaagacgtgaaaatggttatagacacctttaccaacctcattctggagaacgtctgggcttttctggttgggaagatcccatactttggacgctccaagtgatctatatgagaggatgtgaggcttatttctttctctaagacttgattagaagaacagtggtttaatttatgcctgagtgcgtgcatgcatgctctgtttgatgtggatgtataatctggattcaaagattagctgcgggcgttggatgtatgctagtctgggtttagttgtctgtttaatctcgggctgaagcaatttgcagctcattctagctccaatataacacctgccaattttgttgttgattgtccaagtttgcaatgtcagtagtacatttatgtccgtgaacagtaattgtggctatgaatagaatcactcgtaagctgtgttaattgactagtcacacgttttaattaataacccgagttccattaatagtttcagtcgtaaaagatttatcacagataaaaggaaaaactcatagttgttgtgagaccgagagggtgagtgcccaaaatttttaatttttttacttattaattacacaaatgatcattcttttaacgactacacttaaatgatcataaaagtttagagaaaaaaaatcgactagcataagttttagtaacaacattgtatcagcacgaacgttgaagtaattgtttcgtaaaaaaaactgaatttttaagagaatagaatattttatatgaactcggttctttttttttctaaaaaaaggaactcggttcataacttgatacaataagaaattactcgacggcgaatagaaacagatccaaacaacacaaacaatttatcatccgtatccgcttcacttctcacatcctaaagcccaacacaaaaattttcaaaaaaaacaaaaaaaaacacaattggacttgttcggctgctaggttgtggttgtgccgtagccggtacaaacagtaccatactcactgtgcgtagccgcagctgcagccctcgcagtcggcttgccgaactatcatattgttctcgctaatgccaatgggcatatgggctcatcgggtgtgcggccctgtcggaacacacccagcggggatggcccctttgccatccctatacccgctaacccgcttcacttctcacatcccaagcccaagataagaatttccctaaaaaaaaaaaaagccatgttctcgctactcagccgtgcgctctgcgccgcctcctcctcgccggcggcgccgcgggggagatctcttctcgccgcgctgctctccccgtcggctagccctctcgacccatgccggggccctgctgcgccggagccaccgaggcggcgggcgttccatggctcgccgagccccctggggttcaggtccacaccggcgtcgtggtccagcccggaggcgggggcggc

SEQ ID NO: 55490 - DNA, 1501 bp, Oryza sativa
tattatggcttacaatttgggtgacaaggcgttttggtccatcagtcatctgttcttatatggcaatgttatcttggcttcatttgaaacaattaactgtgagaacgttatttaacacttagaagcgggataagtcgatcaaaatgcagcatatttgcatctaggactcttcatggatcattaacttttcaatttttaaacagttaatgtcctgtactgtgcaatgatttagtttacagcaaacagctggttgcacagcatcaatgtgaagtatccacactgtttggtactcatattgtttacttgtattaaacctttgtctcgatgcttaacttgtgttttttttttacaccacagcaaaatgtagcaaatgttctactagcttctaagtgcagttaacagaagtccaatgtgcactttggccttttggactactattcaactgtggaaaatctttctaacttgaaaatttctaggacagatttaggattttggaaccaagaaaacttattgagctgaaaaacaggttcaatctttagtgggcatctagtaccgaataagcacaagcacaggaagtgtactaaaacaagggcaccagaagaatgtccatcaaattttgagttgacggttcaaagaacatcctattgaattttttgcagggaagatttgaattcgaatttgtgccaaaatcaaactacacaatagtcattctttctcttgcccaaacttgtatacaattcaacagtgggacacggaatagagagccagcagctaagtgaatagggtatgtactactatacaacctaatgtagcaaactaagatggccctttcctcactccatcacacaactatgctgataattcaactaaactaaaagaaatcagtagcacacgacaatgaaatgtaaatatgacagaactgtagaaaaagcacaatctggaatgagatgaacatataaataggcttgttccataactgctgcattgctgagacaccaaatgtgaccagattccagtggaacacagtgtccaaatatgcaaataacttatgattcccttcttttttcttctaatattttgaatttaaaattttacatctgaagattaaagaacttggctcaggaagaacctcattctgtgattcattgtgtataacaataagcacaagtgtactctaaaaaaaaggcaccagagaatgccaatcaaatttcagttgatggttcaaagcaacatcctattcatttgaattcgaatttgctgccaaaatcaaattatacaatagacattctcttgttgaacattgcaaacaattcaacagtggtacacaaaatacagtactagcttctcagtgtataggatatctacaactatacagctgtgatgtagcacaactaagaatggcccattcatcatttccatcaggaaactatgctgctaattcaactaaactaaaagaaaatcagtagcacacgcacagttctagcgattccaaacctaaaaa

SEQ ID NO: 55491 - DNA, 1501 bp, Oryza sativa
caggcgtcaacccggcgaacttgccctgttgttcattgctgattaagcacttgatgctgtccgtgtgcagcaatggcgcgtggagaaatgcttaccgtctcggggtccagctcgccggagaacctcgcggcggaggcggcgtcgctctgccactgcccggtcacgtcggaggcggcgagcttctccccggcggcgaacgcggcctcgcggagggcgcagccgccgagctggtcgccgttccggtaggggccgtaccactgctcggagaacaccttgacgccgcggagccgcgcctccttggcgagcgccactgtctgcacgaggcggaccctcacctcccggttgtccgggtgcacgacgcagtgctccacctcgagcaccggcgcggggcccctgggccaggcggcgacgtacgacccggcggcggagtaggcgaacgcggaggcggaggaggcgtggcgctggtgcgaggtgtggacggtggcggcgtcggcctcgcagccgacagtggggagcaggcggacgagcctgtagtggaggtcgcacggcgcggccgggtcggcgagagtggggcactgcgtttgccagtcgaacacctgcacgccccagtcgcggtaggcctcggggaccacgttctccggtagctcgacggcgtcgccggccgccgtgaactccgcgccaaatccgtcccactcgccggacacccgcgacgcgaactctgcccaactatctacacacgtagccagccacgtgaattcagttcaatcatccaagtaaacttgatcacaacaaattctgttactaacctggctgcgcggaggtggaggagccgtcggttgcaacggtggcgggcgagactgcatgcagatgcaggggcaacgacgacgatgacttggtgaatgggcgtagtccaagcggggacggcttgatcgccggggatggcggcgagcgatagcaggcgccgcatgggatcgggaggagcagccgttggccggagagaagatgcatggtcatcgctgttttaccgttagcgttattcgcggtgcgtggcggtactctctcttttcagtcgtggctcagaaacgagcgatcgaggttgatccggagggtgtggttggactgcgccggcaagggcaaaggcaaatcagtccacccctaaaccaactcaacgaactgattaaatagcctccgactcccccttacataactccatctctatttacctcctactgtataaacacggactggatattggagggagcgacgttttgacgtgtggtgcagtgataccacaccaacgccgatacaaactacaaatggttgagatttgaaacagtacggcagaagggaaggaatacataagaagaaattcacatgtggtttaggttaaaccggctacactttttcttctattcctgttacgtttggtttctggcctgaggatgggtaagtatgtttaaaccattattatttttgttcttctgtaagaaattggtaagca

SEQ ID NO: 55492 - DNA, 1501 bp, Oryza sativa
atattttcataataaatttgtcttgggttgaaaatgttattattattttctacaaatttagttaaacttgaagcagtttgactttgaccaaaattaaaacgtctagtatagtataagcgtggcacaacaaattgagatgggtatagaatcgtttcagggccaaggcgctagatttaaaagctaaaatttctaacattaatagtgagaaaataataaaatctagaaatattcacgttaattacagaacagggaaacatctcacacatcaattcatatgcaacattataatggatgtgtgtttgatcaaacaggcaataaatacataatttgatttcagcttgatatgtaagtgtagatacaatatgcccaaatcaaatactagtaagttctttcatgttggacaaatctaccaaggatagtataatggattgttccattctagcaataggcgaatcttacttgccatatgattaatgcaattaaataaacacaaacatacatttttgaaaattttgtgttatgcatatatatatgattcctaacggaagcattatttttgcactaaaaataattcctcttagtattttctcaacctttcgatgataaaaataaaaatacattaattgaactaacacaaatttctaaaatgaagtgtatttgtatttcctttttttaacaaatatatgtattttctgacaacactaaccgatgtggatgcttggatctatgactagtttttagtaaagaaactctcctgtttttgaagtggtgctgataagtttgatacatctacctctcaccatacctcacgcgacctacataagaatcgtaaaatctagacttgtaagtaaagttctaacctgttgttgtcgaaagttccagacttgattcggagaagacggaagaccctaagctgatcggcgaggatggagagtattgttgccgcgtgttcttccaggcacccaagtccgctgctgcataccctcgtaaataaaaacgaatcaaacacaacatgcttaccaatttcttacagaagaacaaaaataataatggtttaaacatacttacccatcctcaggccagaaaccaaacgtaacaggaatagaagaaaaagtgtagccggtttaacctaaaccacatgtgaatttcttcttatgtattccttcccttctgccgtactgtttcaaatctcaaccatttgtagtttgtatcggcgttggtgtggtatcactgcaccacacgtcaaaacgtcgctccctccaatatccagtccgtgtttatacagtaggaggtaaatagagatggagttatgtaagggggagtcggaggctatttaatcagttcgttgagttggtttaggggtggactgatttgcctttgcccttgccggcgcagtccaaccacaccctccggatcaacctcgatcgctcgtttctgagccacgactgaaaagagagagtaccgccacgcaccgcgaataacgctaacggtaaaacagcga

SEQ ID NO: 55493 - DNA, 313 bp, Oryza sativa
actagtggatccccctgctttgtatcagttccgttattatgggcggtcgctaaccaagtcacaacccccaccaccaccaccaccaccaccaccttgaagcagaagctgcacaccgtttagatcacgcaaaaattgaaagtttggttgaaattggaacgatgtgatgaaaaaattagaaatttatgtgtgtaaaaaagtttcgatgtaatggaaaaattaaaagtttgaaaaaaaagtttagaactaaacaaggcccaagtcgccggatctcactggagccgaatgggttcagtttcgaaggagctgacaacaa

SEQ ID NO: 55494 - DNA, 317 bp, Oryza sativa
tgtttggcaaatcagaaaggaaaatgatttcctacccaccaagagacatttttaaatcctaaccgtttattctctctttcatttaatcataacccttcgttcatttcctaatcccaattccaatcccattccctcgtttcccattttccgaacacaccgtgagtgatgggcgaaattactactccttcgtaatacgattacgtatccatcccctcctcgtcagtttgcccaccgccgcctccgccttcgccgccgccatcgatccccatccatcccgcgagcgagcagagtcgccgtagctcgtcctgctgcttcct

SEQ ID NO: 55495 - DNA, 1501 bp, Oryza sativa
acttcaaacaaattactataatccatgtaaacccaactaaattagttaatgaggtagcggttagtgaacatgcatgaacatttccatttataattctgacttcccaagcctaggcagatgacagcagacagtaaagattcacagtggtatttttacctgccaaggtctttcccagtcgagaggcataggccaagcaccaagccatgctcctattacagctccatgagcaggtgcagatatcatgtagtccactgaatcagttgatccgcaataactgatgcaaaagcacacaacaaaccacaatgtcaggcagttgctggacagtaaatttagaaggaagatatccattaaatgaacccctagcattctattttcatttaagagtaagcgatgtacatggaatgagagagcacagcctgccaattcactttggatgctccaaatacgcatgctgcaggaacaaactgcaaaatcatggatttagcttgatatgacttgatatgtaacaattatataaatataaaggcacagtattggcacaagaaaaaaagtaatagttgtccggttgccaatattgttaatctcagatgtggtatttttacatacttgctgctccaaaaatggcactcacatttagtaccacctgccagtgacagcatttccaggaatgctactttttggagtggtgaaaatctaactgaatctaactggcagtgacacataagtaaatcaggggaaatggcacttactgtgaacaaggacatgagaagtgaccaataagttgttgctgcccagtacctacagatatgcaaccccgtgaaaggaccattgatatgtattatccatgaaagaaatatcctggtgcattctggtaaaatcagatgaaaaatatgtaggaagcagtatatatgacagtactagacatctatttagcattgacataaaggttaacaacaaccattgacgtccttgttgatctatactcacttgattccaatgggtgcaccaagaacaattgctccaaatgcatttaggaacgcacctatcagaaaacattgtgtacaataagggaaaaaaaaggtaagtaggtcctaaataattcaatagttcaactattattgtgtcacaagaatgaactaagccatgagtactgaacaatatatcctgtgtccagctattttggtcgtagtaacgaagctaagttaactcacgaaactagaagctaatatgaatgttaaaacacagaagagagagaactaaccaatggggaggccaagcaatcctcgcgcagctgccttaagaaactgaaattatagaacccaattatcctatcattgaacataacattggcatagaaatcagaagaagcaattgaccgaacaggtcacaagtgcacgccataccgagcagcgcttgggatttcgacggagcaaactgaacactgcgatgacaagaggcgcttcgaagacctagaaaaagtcttacttcgaatcagaagaca

SEQ ID NO: 55496 - DNA, 1501 bp, Oryza sativa
tcttcttgacttgcgagttgcgacttcattgaatcattgtgttttcttttgcctttcttttcctatttcctggaaagctatttgtgctaacttttgtggttcagtatcagtgtgaggaaattctctaggatcgatgtacctatacttgtagtaattgaacactttaaagtgagctttcatgttaacttagaataaattacctgatcttaaataaatcatgaactgaaaatatcattgacttcaatatagaaaatcaaaaagtcatatttaatcgtaccagcttgaactctcaattctattatttagatatgtcttatccaaccaaaatctctatattttaggatgaagtgagtattttattagtttaattttaaaacttaaaattaattgttaatcagttgtagccaatatagattgcttttaatataagcattataattttgattttgaagataaccaacatgtttaatataatattaaaattcaaatacatatagtatcagtccataaaaacccgtccatcgttcgggttgatgactggtaccataataagacctcatggagagttcgtcagcgtgctgattattcactctatctctcccctcccaattaagcttaggcaatacatacaactgggcaactgattctgtataatattgctgtgtcgcgtaggtagtttaggtaagtcaattttcgtcaatgtctaataactgtcatatgtgtgcgtgtgccggcattatgtggctttgcacaatagtagtactatctatattcatattggatacgcacagttaacctaattacgttcaagttggacacagatccatccagtgatcgacaggttgcgaaagcgagcagtttatagttaagcgtgatagattggagggtggacgacgcatcaaactctcatcactctttggctaaaatatatgttcagtttgcgcaagaaattaagcacgattattcaacgactaaagactccgctcgcagtctttccttctgtttccctcttcctgtgtcgcgcgtatgaagtattaaagtgtagtctaagtagcacaggtggagaaacaatatttggtcggtcgaccaaattccacaataatcccggttctattaaaaaccgggacaaaaaacgatttttattcccggttaaaaaaaattgatctaacaccaaccgggactaaagatgatttttagtcccagttcatcccctgttagatgtatgtcaggggaccgaggatctttagtgccggttgatactaccaatcgggactaaagattaccactttagtccctgttggtaatactaactgggagtaaagatcgatctttagtcccggttggagttatcaaccgggagtaaatatttctctcacacttctaatcggttaagtcccagacatatatttagataagattggaacatcccctctcttcctccccctcctccccttcctcttctcctccctcccatcagccgcccttcctcctccacccctct

SEQ ID NO: 55497 - DNA, 157 bp, Oryza sativa
cgacatatatagcgtgcaaacccgacgatccttccgatcatttcatgccaccacaatgcagcaaagcttacgaaaatgtcaaccagatgaagattgtaatattgatacatgtcaacgaaacattagcgataaataaatattcgtgtaaatttttagt

SEQ ID NO: 55498 - DNA, 1501 bp, Oryza sativa
aggtgttcagatgcggtcagggcatatgcctccccgtaggaggggataataatgagattggagcagggctgttgacccgagccgagatgaagacaccggggagcaaagcatgccaagttttccgcctgtattgccactgacatatgtactgtatgcacctggcttctctcccccctctgcctgccttcctgcctgcttttgctacctgtaggcacgagcaccttgaattcatttcatttcattgcaccaccattctgaatatttctgatccctcaccctcaccccagccagccttgttttcttcctatcatgggtcagttcccctctcacttgagaattactaatttaaccacttgagagtaattcagttttgaatagtggcttaatagttaataaccaatacttccatccgtttttaaatatttgatatcatcggttactaccataaaatggttagattaggatgtacggaatttttatgcttatgtctaataggtattgcactatagtactccctccgtcccaaattataagacgttcttatttttaggaaaattaaagtcgataacttttgattaataatcatagcaaacatatctacgctaagtattatacatattatatcactagatttatattttaaagtactttcgtatgatgctaatttcgtattcatttggaacataaaatagaataaattaacggtcaaagtatataattaaaaatcgtgtaaaaatataagccttataatttgggctggagggagtaatatgtcatctttttagttgtttgtgttttaattgtttgaaacaattgattaattgaattatgtcctttcttctaaattttccatgtaatagtcaatcctatagtgatttttcatgcggaataatcaaacggtaattattatattttttttctatgttttgcacttgcatttacgatgaaatccagtgtttttttctagtcctacatcttttcaattttacatttcaaaggagcttgtagctgttctttttcagtatatttgccaggagaaatcagatagcatgtgcataaataggaaagcatgtgtccaatcctgggaaaaaaggaataaaggctcaatcttgtcaccggacgtcccatacgtgtacgagatatgagttgtgttgaatgggatgtgaaaaattcctagctagctctccctgcatgcatggactatatactgtactctctgaagaattcttcagaccctaccaaaataaaggtgtctgtaggacgctgtgcagtgcgtggcttcaaggattgggctttgaatttggattcaaaaagttgccaatctattgcaagaaaagctaatcgtagatttttctttccctttttcatctcgggaaaacaaaaaggctagtgatctttcggagacagacggagtacaagctactatcaaataaagtgcgaatttttcttaaaagtttttgtttgaaatttttttcctttgcatgcaacttatatcaacagg

SEQ ID NO: 55499 - DNA, 665 bp, Oryza sativa
aatttaatcgtccgtcttatttaattttttttttgaaaaaaataataaaaaaacataaatcatgtagtataaagtattatttatgttttatcatcaaataataataaaaatactaatcataacaaaaattcaaataagacggatgattaaagttggataaaaaaacttatggctgtgcttaaaataggacggagagagtagaaactagtgtaaggctttgtttgggagagtttaagctgcttgcatgcttctgagaattttgaaaatttgggtttcgcgagtttgagcttctacggttagtttattttataaattctatagctacagatactgaggatgtggactgaaaattctgggaaaattggcttttgctaaaagctcccgtaaacgtatgctaagtctctacaattccaagtctctcactaacattactaattcaatatgataattaatcattatttctctcacattatgtcttgagctacgcctagtagaaactactccgtactacaagatcggtttctttatcattcctcatttaatagttagattgtcacattatattattttaaatagaattgtctaaatacaatagaactttatttttctaaaaaaaacttgtagtgggtttatagctttacaaaattctgggtggcgcttgtgga

SEQ ID NO: 55500 - DNA, 1501 bp, Oryza sativa
cgatattaccgatccatccatcgatcgatctccttggattggatcagcaggcatgcatgcagcacctgccatctctgattctctgcacccgggattattaattaacctcgcctttaagtacgggagatcccggtcagaacgctgaaagagataagaatatatcgtgatcactatgctgcatgactgcatcgtacggcccatgcagtcgttagatttggttagttgcgtcttaattcgaggtaatgatcgatcgtctgatcctacctgatctccatcatgttcctgttgatataagttgcatgcaaaggaaaaaaatttcaaacaaaaacttttaagaaaaattcgcactttatttgatagtagcttgtactccgtctgtctccgaaagatcactagcctttttgttttcccgagatgaaaaagggaaagaaaaatctacgattagcttttcttgcaatagattggcaactttttgaatccaaattcaaagcccaatccttgaagccacgcactgcacagcgtcctacagacacctttattttggtagggtctgaagaattcttcagagagtacagtatatagtccatgcatgcagggagagctagctaggaatttttcacatcccattcaacacaactcatatctcgtacacgtatgggacgtccggtgacaagattgagcctttattccttttttcccaggattggacacatgctttcctatttatgcacatgctatctgatttctcctggcaaatatactgaaaaagaacagctacaagctcctttgaaatgtaaaattgaaaagatgtaggactagaaaaaaacactggatttcatcgtaaatgcaagtgcaaaacatagaaaaaaaatataataattaccgtttgattattccgcatgaaaaatcactataggattgactattacatggaaaatttagaagaaaggacataattcaattaatcaattgtttcaaacaattaaaacacaaacaactaaaaagatgacatattactccctccagcccaaattataaggcttatatttttacacgatttttaattatatactttgaccgttaatttattctattttatgttccaaatgaatacgaaattagcatcatacgaaagtactttaaaatataaatctagtgatataatatgtataatacttagcgtagatatgtttgctatgattattaatcaaaagttatcgactttaattttcctaaaaataagaacgtcttataatttgggacggagggagtactatagtgcaatacctattagacataagcataaaaattccgtacatcctaatctaaccattttatggtagtaaccgatgatatcaaatatttaaaaacggatggaagtattggttattaactattaagccactattcaaaactgaattactctcaagtggttaaattagtaattctcaagtgagaggggaactgacccatgataggaagaaaacaaggctggctgggg

SEQ ID NO: 55501 - DNA, 1501 bp, Oryza sativa
tgtgttttaaggtttctagttattttaaattgtactaatggggtccacaactataaatgctcctataacagaacaaagtttgtcaaaacattctaataaaagaactagtaccactatattcttctcaaaacatacccgtggatataatacgaattgcttgttatagccatgcaaacatcacggctttgttcactttatagtcattttcaatctttccaaaatttatcattgccaaaatttcaacaagttagaaacattaattaccaagatttagtaggataggctaatataatgtagtcaattatctaggcatgacaaatattttataacaaactaaattttgtcacacagttgtcaattttatcaaataatgatatgagttaaaatgacataaatctgaacaggccccacatcaagtaagtattactatgtccattctaaaataatacaagaatttgtggctacacaaatggatacaagtaagacatccctttgcttattactagtagccttttttttttcaagtttttcacttatctagaaatattgatgggatgcctcaagatgttgcatcctataaaaaatcaacttctaacaacgtatatagttagatatttagggggtgtttacatctaggggtgtaaagttttggcgtatcacatcgggtattatatagggtctcgcatggggtatttgggcactggtaaaaaaactaattatagaatccgtcagtaaaccgcgagacgaatttattaagcctaaataacttgtcattagcaaatgtttactgtagcaccacattgttaaatcatggagcaactaggcttaaaagattcatctcgtaaattagtcgcaatctgtgtaattagttatatttttagcctatatttaatacttcatgcaagtgttcaaacattcgatgtgatagtttaattcacaccaaactttccccaaacttaactttccatcacatcacatcacatcacatctaaaatttttctactcacataaactcctaacttttttttccaaactatcaactttcctcaaacttctccctaattttaggaactaaacacaatctaattgaatatttgaattagagggtaaagtgaatgcaaaatgatggttttaaactgttgacattattcgtgataagaattgctcatgatgtgactgatggctcatagattgacagagcataaactgattgctccaaataaagggcaatgaccttttcagttggaggtgaagcagtggctcctttctaggctttggggagtggcagctgcagcaagggacatcacactcatcatgatcacactgctgcatatcagtccaaacttccacaccacctccatatgtgtgctcctgatccacctgttgcacctgtatccctgatcacaagattggcaaaagaagaatggttttaggtggtgtttagatcagggacttaactttagtccatgtttttagacactaatttagagtattaaatata

SEQ ID NO: 55502 - DNA, 1501 bp, Oryza sativa
tttacgagatgaatcttttaagcctagttgctccatgatttaacaatgtggtgctacagtaaacatttgctaatgacaagttatttaggcttaataaattcgtctcgcggtttactgacggattctataattagtttttttaccagtgcccaaataccccatgcgagaccctatataatacccgatgtgatacgccaaaactttacacccctagatgtaaacaccccctaaatatctaactatatacgttgttagaagttgattttttataggatgcaacatcttgaggcatcccatcaatatttctagataagtgaaaaacttgaaaaaaaaaaggctactagtaataagcaaagggatgtcttacttgtatccatttgtgtagccacaaattcttgtattattttagaatggacatagtaatacttacttgatgtggggcctgttcagatttatgtcattttaactcatatcattatttgataaaattgacaactgtgtgacaaaatttagtttgttataaaatatttgtcatgcctagataattgactacattatattagcctatcctactaaatcttggtaattaatgtttctaacttgttgaaattttggcaatgataaattttggaaagattgaaaatgactataaagtgaacaaagccgtgatgtttgcatggctataacaagcaattcgtattatatccacgggtatgttttgagaagaatatagtggtactagttcttttattagaatgttttgacaaactttgttctgttataggagcatttatagttgtggaccccattagtacaatttaaaataactagaaaccttaaaacacaatgattatttagatggagcttaaaattcatagatacagctgatgaaaatatgagaagggcttagttttttagcttatagattctagtgcattttgtagatcttgtagctattggttactcagaatctgagtatctatactgtttggaaagatataggtttttataagacaaattacaactgtcagaagcctctcaaacagggcctaacgtattattgttttattgaacgagcttcttatattcttcttttcctttggtgaattttacataactaaaatgcactaggtattatagaacttcttgacaccctagaatatgtccaccaatctaatttaaagcatcaagattttctttttgagaattatgtcgtcagatttgttatttgaagtacttccacatatactactatatcccaatacaaattaagttgcagaaagtaatggacaaagtggcatctcaaacaccatagaaagttaaaaacatctcgaacacacaaagtcagtcacactgaaactagatctgcatgcatagttagccccatttgtcactagtgcgacactagttttgcacgctggcacgctgcacacacgcatgcatgtttcccatttctattccctttttcctctatctctctctctctcctgcagcagtggca

SEQ ID NO: 55503 - DNA, 1501 bp, Oryza sativa
  unsure (1)..(1501): unsure at all n locations
ggagtagtacttcacatattggcatggagtacatcagacgatactagtacagcatacatgtcgtggcgttcaacttgttggagatctgatgcgatataaatcgatcctacgtcacatgacagactggacccttgtcaaaattatggattggatgattaatcactgataggtagtactagtagcaactcaatcacacaagcgaagtgagaagaaaaggaacctcttcctgcattaagacaacggcgacggggtcactgaaagtgaagcctgtggcgcacacgacacgacctcctcaacggatctgtggcttacccgtcgccgttagagcgtttgctccaacgcttctgcagtacaagagtacagctgaaagccatagtacactgatgatatttgcaagcctgaagtacaagccgcccctaacgatctcccccccatatgtactgcagctaacttgtactactaccagtgcaccatggccggggtacaaatatgccacccttcaccaatggatgcatcagcagcagccacagcaaaatttggtttgggataggtaggtgttatgttaggtctggttttttggctgtagcagcagcagtggaaggggcatgcagaggagcaggagattcagtttgaagctggacttcacttttgcctctctctcctgtgcttgcctcttccattcctgctgctaggctgttctgtggaagtttgcagagtttatattatgggtttaatcgtccatggcatcagcatcagcagcggtaggagaaacttttctgttattgcaccaaactctcaacatttcggtcattctgctccaggtctgaattcatatccatttcactaattctgtctacaggtatgtcatgacaatgcggccgtgcgagctccatgagctcgaatgccattgcagtggattcaggacaacgaaatggacactgtttttcgttggaaatttgggcgtatgccgttgtaaaattcatgtttcagagaaatgccgctacaaaatgtatctatgagcttgaagttatctcaaagctatcagtaacacattatttggtcaattgttcagatcggggattagatgcgaaagaactacagagcgtggaaaaaatgtattaaaaaagagggttttctacagttaattaagctgtataccttgactaaatttgtactgtcacttcccaacttagaaagcactaatcaagaagagtagtattgtcaacgacaattacctgcatgttcatttgttccagtcagcatctcatctatggtacagacaacagcaagtgttggctctaaactaacacattgcaattaaacaattaatctttccaatctcctaccgccccagtttcttcatactgcanaagacanatcatcacaagaacaagagaactaatcagaacaaaacatgcaactaatcaaatcacaaagcgcgaacagcnncnncncggaaaancaancaccggcaannccnaggcacactccagtgacagaa

SEQ ID NO: 55504 - DNA, 1501 bp, Oryza sativa
actgtatactggattcacataacaaatcataatagccatcgagcaaatcctaaggtatcgaatgcacacctgtggtgctcattggtgaacacgaagaacctccttgccttgttagaacacagggccttgatcctgttgaacactgcgaggtttttattcttcacctcatccaacacaaccgatagtaggacaacatcgtcaatcgctggattctccagcaaatcgatctgcagcaagctctcagaacatcagcctccggaatccctagctctactccctacaggcaacaggaggggaaaggccaacctggtggagcacgacgttggtgtcgacgacgaggatggcggccgcgtcggcggagagcgggtgctcgaccgcgccacaggtggagcaggaggcggcgccgcaggagatgtcgtcgcggaggtagtgctccctgaccacctgcgggaatgggggaactccgggttagctagggtttgggggcaccttcgccgcgcgcagggtgatgctgctgccgagtagttaccttctggacgcggcctgccctcgtcttcttcacgaaggtcttgctctgcaacatgtcggcgaggtcgggcgtcgcaggctagcggcggcggcggcggcggcggcggagagggacacggcgtcgcggcggccctgagcgtgagtgagacggcgcagaccggcggcggcggtggagagagagaagagaggttttgataggttcagtgccgtgggccgtgttaagtggtgggctagccagtgtttgggctttgagcccattcgatgtggctttggtagttcggtttgaccgctgactcaaaccttctcccttcttaaattttttgaaaattttggaattataaatggcactgctcaattttggcagggacaaatttatctcatgttcagttttggtggcttccatttttctgttgaaatgcccatataaggtacaccccattttgcctgtccagtgatcttcttttatcaaagaaaagatatatgcatacaagctacaccgatggccataaaaccatgaaccacacagagcacacaaaaagaataacagtatgtcagtatcctaatccaaacagaaatggcgaaaaaaaaaatgagccccacgcagccaggctctcacgtctcaccagtttaaactacaggctgacacggtgacagcaagcgcgcaggcacacggcgacgagaaacaaagcagcggagacaacgacgggagcgcgcgcgggcgcgcactgcagagagatatttgtgtttcacctacgaggccaccagagtcacacacacggatatcgccttccgcgcaacgggtggctgcgcgcgcgtgcaatcgccttatccccggtctccacgccacaaagccccagcggtgatcgccgcgccctccgcgccaagtacatatacgcgcgcatccggccgcctcgatccatccagccgagcgagctaaggaaggaagaagcatacaggcggcagcgacgagcca

SEQ ID NO: 55505 - DNA, 1501 bp, Oryza sativa
gacaatgtgagtgctgttaacctcctcatttggcttctttctagaaacactattattcaattgcaacgtgccagaaatttgctcccaggttagtatgtaattcaaccctgtgatgcatgcacccgagaattcactcccagaaatgaaattttactcgtcctgtagcaggcctacagcgtttgattggccacggcacttaaaaacttttttttgacagtcgacatccatgccaaaatgccagattactggcatggttggcattcttagaaagcaacatgaaaaactgtctgccaatcaaattaacagactagtacatctcttctattggcaaaggcatcttttgaaatagaggattttttaaagagaatttcacgggaattggactgattcatgtgaaaatccggcaaacttcattcatttcaaactagtcgtaaaaaacacaggaatggtagttacatttgaacatctatttttttttcttaaaaaaacctgccacaatagtaacagcacactattcatctgaaatttttttatttatatttctcttaaactaaggcagcgttcgagagggtgagagagtgagtttgtttgtttcgttttctgcgcgcacgtttcccaaactactaaacagttatgggtgagggcaagggcaccaaggctttgcgctcagcctcgagcgccgtcatccgagcctgcagagaggcgttagcctctgacgcccgccgctcttgggcggcagctgcgtcgaggatgccgcgcgcgtcctggatcctcctctccaggtcctcggcatgagcctcatattggaggcagatgtcgcccagcgcctcgtccaggacgctcgaggcgatcagtgccgcctgccgctcctcctccgtatcccgcatgagggagtccaggacctcctcgcgcgcctggatttcggctagttgggcttggcgcattttgcgctccaccctcaccatgtcatccacggcgcgtcgctcctcttcgacccgcgcgcggtccgcggcgagctaggcccactctgcatccaggcctaatttttctataatcaacatgttctcttttttgcgttttttgtaaaaattttctataggaaaattgctttaaaaaatcatattaatccatttttgaaatttaaaatagttaatactcaattaatcataagctaatagctcatctcgttttgcgtatcttcccaatctcctcaatccccttctcctcaaacacaccttaagttgagtttagatttaagatttgtgagagtgtatttcatatctacgcatatctctagtagttttttcataaatttacaaaatttttagatatgattttcatgagttttcacatttagcttgttttcaccaaatatgtcttctttttatacaccatatttccggcaggtaacagttaatcaatgtgacatatatgaggttgtgcttgtgcacgcagaacagtgaggacgcgaggctggaacgcgtcctgagggcggcggcga

SEQ ID NO: 55506 - DNA, 1501 bp, Oryza sativa
ttttttgttttttaaaaagaacccaactattgaatttccagaagtttgtaacatataatagcagtataaatacttttgctaaaaaaaaaacaagtaacgaaaactctgtatttatttatgtacaacgattactactgttttccatagccaaaagggaccatcttacgttactcatcaggttaaactgtagtcatactaacgtgcgtggtaaattctacagtttgttatctgaaatactgaattgtgcacaggtaaaaggaaaaacagaaagctacagatcaatttgttagctaagctaagcacaggcacgtaccctggcgacgagctgcgagccaaggacatcggagaaggacgcctccctcgcggcgtggctgatggagcacgatcccggcctcagtccggagaagtcggcgaagtccaccctctgcaaccgcacatttcatcagatcacccgtagcttcacacgcaaagccggataataccacaagatcacgcacgcgcgcacctgcttggacgccgccttgctgtgcagccgggcggtggccggaatgcgggacgccgcgagcgctgcgtgtgtggccatggctcgtcgctgccgcctgtatgcttcttccttccttagctcgctcggctggatggatcgaggcggccggatgcgcgcgtatatgtacttggcgcggagggcgcggcgatcaccgctggggctttgtggcgtggagaccggggataaggcgattgcacgcgcgcgcagccacccgttgcgcggaaggcgatatccgtgtgtgtgactctggtggcctcgtaggtgaaacacaaatatctctctgcagtgcgcgcccgcgcgcgctcccgtcgttgtctccgctgctttgtttctcgtcgccgtgtgcctgcgcgcttgctgtcaccgtgtcagcctgtagtttaaactggtgagacgtgagagcctggctgcgtggggctcattttttttttcgccatttctgtttggattaggatactgacatactgttattctttttgtgtgctctgtgtggttcatggttttatggccatcggtgtagcttgtatgcatatatcttttctttgataaaagaagatcactggacaggcaaaatggggtgtaccttatatgggcatttcaacagaaaaatggaagccaccaaaactgaacatgagataaatttgtccctgccaaaattgagcagtgccatttataattccaaaattttcaaaaaatttaagaagggagaaggtttgagtcagcggtcaaaccgaactaccaaagccacatcgaatgggctcaaagcccaaacactggctagcccaccacttaacacggcccacggcactgaacctatcaaaacctctcttctctctctccaccgccgccgccggtctgcgccgtctcactcacgctcagggccgccgcgacgccgtgtccctctccgccgccgccgccgccgccgccgctagcctgcgacgcccgacctcgccgaca

SEQ ID NO: 55507 - DNA, 726 bp, Oryza sativa
  unsure (1)..(726): unsure at all n locations
gcagatttcgtgttttttggcatagatttggcttgtgggtgaccgcntaggcgtttctcgcgtgtttcggctttttgtctgggatcgatttgtggctggatttgcttgttcctggctgcggagcttggatcttagcattagaaaccctcagattggggatttcctgccggaggaagctttttggaggagctgcctttgggaggaactcttccagttctgagggtttcggtgtttgttgctcgcctggctcgagaagaagctgggaaatctcgtattttagggcgggttctagtagatttcgtgtagtggagagcaaaaagtttgtgtggttttggtggtcaagtctggtggtggaagcccctcaggccggagatttcctccttccggtggacgaccaaaggagccgcccttggaaggaatttcttgccatcccagaggtttccacttcctcaccttggctaagtttaaaactttccgctgttttcccttgccgtgtagtaacaagtatgggttgctgatcaagtctttgttgtgaaaaatgtcaggttggggatttcctcacgcccaggaagccaagcaagggctgccttagcgaggaactcttccaattggacgggtttgcgcgtagcggtgcggctatataagtggaaatctgcatcctgggaaggatacaattgttttgaggctaggaactttggaattggtttgcataagnagttcttggaa

SEQ ID NO: 55508 - DNA, 1501 bp, Oryza sativa
acgtcaccctttcacctaaacaaatttgcagttaggtatatcagtaatcctatatattagagatgagacacaaattctacacgtggacctcggaaacacacgcgcgcgcacaaactagagtatgtttgtattttcacggtcttttttagaacgtatgattctcataacacataaatagaaaagcaaagattgagttgctataaaaccttaaatcatactccctctgtttcaggttataaagtattttaactttaatattagtaaactgttccaagttcgattaagggtgtgtttagtttcacgctaaaattggaagtttgaagaaattggaacgatgtgacggaaaggttgaaagtttatatatgtagtaaagtttgatgtgacggaaaagttgaaagtttgaagaaaaaagttgagaactaaacaaagcctaagtttatagactaatatttataatactaaattagtttcatcaaatcaataatagaatatattttcataataaatttaacttatgttgaaaatatcaatacctttttctgtaaacttggtcaaacttaaggtagtcatcttataacctgaaacggatgtagaagatattgaaaaaaatgtaggaaagccacgttaatgaccatttggttgtagcggggaaaaaaagaatcaggagagagatagacacgaaggatttttttcttctccaaaagtttgaagctcatattagaatttctccgaaattcctatattttaagccaatccatataaatttcatatgagtttagctattcttttgatccaaatgatcatatggattttttttttcacacgattgaatttctctaaaattcttgtaggaattcttcatttcatagtagcccttagaatattcatagttgggcagtttatcttatgtggtgttcttttcttctgaagataatgatgaagattaagttttttatgcaaaacgagatggtattaacgtatggttgattgagttttaattaatacaaacttaaaaaatagattaatataatattttagagcaactttcatatagatagttttttacgaaacatatcatttagcagtttaaaaagcgtgtcacgaaaattttaatcttgatctaacttttattgaagtaaagaacgagactttaatatcatagttgtatatacacaaagattacccgtgaccggtgggaatcaaactcaaagccttccttgtcagacaaagataccaaataacatgccaatacattttctatagactaccgtgagattcaggatccccaaactagccgtgagcgaagagacaaacagctaaacatgatttgttcagtttctttttcagaccaacaagctagttttatgtcgtaacgaaataaataaataaataaattcgtggcgtcacgcatggcaccttctgtcaaattgtgtacaggaggcaattaattgtacaaaatatgtgtacttttaggcttagggggagaatataataaggcata

SEQ ID NO: 55509 - DNA, 1501 bp, Oryza sativa
aaaagaacaccacataagataaactgcccaactatgaatattctaagggctactatgaaatgaagaattcctacaagaattttagagaaattcaatcgtgtgaaaaaaaaaatccatatgatcatttggatcaaaagaatagctaaactcatatgaaatttatatggattggcttaaaatataggaatttcggagaaattctaatatgagcttcaaacttttggagaagaaaaaaatccttcgtgtctatctctctcctgattctttttttccccgctacaaccaaatggtcattaacgtggctttcctacatttttttcaatatcttctacatccgtttcaggttataagatgactaccttaagtttgaccaagtttacagaaaaaggtattgatattttcaacataagttaaatttattatgaaaatatattctattattgatttgatgaaactaatttagtattataaatattagtctataaacttaggctttgtttagttctcaacttttttcttcaaactttcaacttttccgtcacatcaaactttactacatatataaactttcaacctttccgtcacatcgttccaatttcttcaaacttccaattttagcgtgaaactaaacacacccttaatcgaacttggaacagtttactaatattaaagttaaaatactttataacctgaaacagagggagtatgatttaaggttttatagcaactcaatctttgcttttctatttatgtgttatgagaatcatacgttctaaaaaagaccgtgaaaatacaaacatactctagtttgtgcgcgcgcgtgtgtttccgaggtccacgtgtagaatttgtgtctcatctctaatatataggattactgatatacctaactgcaaatttgtttaggtgaaagggtgacgtttactaatattaattaaaacaaagctactacaatccaaaatgacaggttcatgggtacaattgggacatgagattttttgcgtgctagaaagattttgttgttggaagaaaataaacatgtgggatattatatgatctcttcgcattacaaggtgagatattaggtgttgatttagtggttgataaaaaatgtagtcatggataaggttattaaaattataatggatgatccttttatgtattcaaaggtacacaaattgtcaaaaaattggcacataaacaattgccactagttattgttaacttgtcatggtcttcctagtgcctttaccaacacctacttaaaaaatataagagcagaaatcttcaacttcgcttatggtagaaaacaaaaatccagcatgtattgggcagctgggagagtgcacgtgcgtcatatatagatacagcacatgatattggacgatggtgatggctcgagtatctctttcatctgatcaaaggaagtacgtggttgttcgtggcacacatgaacgtttacatactttgatggatgtgattttgaccgttgtttcttaag

SEQ ID NO: 55510 - DNA, 159 bp, Oryza sativa
agataattaggtaagcaatggatcaacaaaactaaagcacaaacaacaactgcagttcctatgctacacacagtagtgacagagcatataaaaggtttcagcctatgagcttatggaaggatatgttactgggagactgggagtaactgggttgttcta

SEQ ID NO: 55511 - DNA, 151 bp, Oryza sativa
caggcatgccatctactcaatgtactatccaaagaactctttggtgattttgagccatgtgctgaactatttattccggtatatacaaacaaattttcttttcttccttatattgtttcaataaaactaacatatttgtgaatttttcaga

SEQ ID NO: 55512 - DNA, 1484 bp, Oryza sativa
tcctgcagccctttatgatggtttttccactgcaggttgtggtgcctctattggtcagtgatgatgaaaagacactggttgtgtgtatcaactccttgacaaaggtgtctcgtacctgcagtttttccctgtttactgtttgagcgtttcccatttaagtttgaatggcacataataacaatataacatataaacttcatggtgccatggttctttagtgaataagttcatatcatatgttctttatatatctgatcttttgtaaatagcatcaattgataatataattactctctgctgagttgtcctatcagttattttgctccaccaaacctaacgtattacacatcctttggttagatttcctgatctcttgtgcaagtgcttttttctcagttccatgtatatattatgatttttttgggggggtactctggtaagtggtcagattgcaacatatctgaattgctttagcgttcaatgttacaatttagtgggttgtagtcttgtagatgcccctttcttgaattcttcaacctgttgtttgagtatatacgccattctactactttgtgcggaagaatgcagcccaataaactaatcgtgtgttcgtaaatgtatgccctgcataggacacatgaatcatatgtatttgaataaaacaattggattggcacacctctagcatctaggcattgtgtctccgactgattaaaaaccggtaaaccaaatataattttagcaagtgttgttgactgctggttctgtttggataatcttgcagcttgttggacggctttccgaggaggaattgatgaatcagttgcccacatttttgccagcactgtttgatgcttttagtaaccaaagccctgatgttcgaaaggtaggtactaatacagtaatactgtagctcttgtcatggtagatttcttctgtttctcatagtgcttttttatttcactgaaattttggtgctatgaggattttataaggtaggatttgtggaatggttgtccatggcttaagttctggttggactaaattctaataacattcaggcagtgagtggaatatgagctggagaggataggctggtggaatggaattgtaacagtttacatagagaagcatgctatacattagggatgccgcttacaaatgcctatttcctatagttcctgaattaaagccaccctgcccatctctgatactaggtccattagcttctgatgcagtctaggtatcacttgctcttgcccactgaaatattttcacgataatctttttacctgccctggttatttggaacattcagtgttttacgagcttaggacatggaggatgaagattagtttgaagctggtactggatgagattgtcttttttccatagtttgtcatccccatgcagtactactcatttcgatgtgccggtgttgaagttagttaagtcggcagcttcctttgttacgttgctttctt

SEQ ID NO: 55513 - DNA, 1501 bp, Oryza sativa
tacgttcgccggagctatagcttgacgatcgagctcacgcgctcggacaccgaaatggctcacgtagtacgttttcctcgtaccacgcatgcatctagccagcacgcgtatataaaagcgggggagagtcggatcgggcggtgaagatagtttggtcactgcatgcgtcgttgaagcggcgtacgttctttctcggtccaaactttctactccgaatagataatgcgccggttagaaattcctcaatcggtcgaagtctcgaggagggcaccgggcggtgacggtgagacgccgttgtggcgactttagaaacctagaatttcctcagccggacctggtatgttaggctggtatacttgcatgccgtccagattccgagaccggagattcaattaaattaatactagtacgtttaattctaactgatcctctctgcacacggtgttgctcggtcagtcagtcagacacccaccaacccaaatccctttttttttcaaaagctttgggttcctgcagccagtgcggttctaaagagtaaagatgattttcgcgtgatggaattttactgactaatctggctaatcaaatcaattaatgtggcgcacccaatcaactgatcaagtaggaatattatgctggatcgcctgatctaggagactaggacggcatgattgtaacctcgacaaaaatatcgagggctattttgaaatgcagaaatggaaaactacaggaatatatgaaaaaaaaatgtaagaacatcataggaatgttaaggcctcatcgtttggcttttttccctagggaataaaaataaatttgtaggtaaattatatatatatatatatattcttggtgacttaaatccaatgctaaaaaggaactacgttgaaaatatctcaaaattaagtttgaaaatttaaaatttagctttttctttgtttgattaggccatccgatgggagcttaaccttagcaatcgacttcatagtccatagtcctttgtcgcctgccccatactggcggccagacttgatagtccatagtccataatcgaagttgactatcaatcagttcttagaatctttaaactgctctaaacaaacccactgtacgacagactcagcagcagacggacaacctgctcccgctccttgcgaagaaccggcattatcctaaccattaaacctcatcactggctaggacactggagctttgctgctcctggagactggagtggtgaattactggcaagggaacccaactaattagagacaatttgacgccgtaaaaatttcaacaaaatccactgcgctggtgaaggtgtgaactttgtatgagttcagagctaacatgatgttcgcgttgctggtccgaaacataccagaaaccccagaacaaaaaccaagttttgggctagattgggacctccataagcaaggcaaaaccaagaacgaggctgacaactgagaattcacacctagcaattccaacggaaatcata

SEQ ID NO: 55514 - DNA, 1501 bp, Oryza sativa
ccgttggaattgctaggtgtgaattctcagttgtcagcctcgttcttggttttgccttgcttatggaggtcccaatctagcccaaaacttggtttttgttctggggtttctggtatgtttcggaccagcaacgcgaacatcatgttagctctgaactcatacaaagttcacaccttcaccagcgcagtggattttgttgaaatttttacggcgtcaaattgtctctaattagttgggttcccttgccagtaattcaccactccagtctccaggagcagcaaagctccagtgtcctagccagtgatgaggtttaatggttaggataatgccggttcttcgcaaggagcgggagcaggttgtccgtctgctgctgagtctgtcgtacagtgggtttgtttagagcagtttaaagattctaagaactgattgatagtcaacttcgattatggactatggactatcaagtctggccgccagtatggggcaggcgacaaaggactatggactatgaagtcgattgctaaggttaagctcccatcggatggcctaatcaaacaaagaaaaagctaaattttaaattttcaaacttaattttgagatattttcaacgtagttcctttttagcattggatttaagtcaccaagaatatatatatatatatataatttacctacaaatttatttttattccctagggaaaaaagccaaacgatgaggccttaacattcctatgatgttcttacatttttttttcatatattcctgtagttttccatttctgcatttcaaaatagccctcgatatttttgtcgaggttacaatcatgccgtcctagtctcctagatcaggcgatccagcataatattcctacttgatcagttgattgggtgcgccacattaattgatttgattagccagattagtcagtaaaattccatcacgcgaaaatcatctttactctttagaaccgcactggctgcaggaacccaaagcttttgaaaaaaaaagggatttgggttggtgggtgtctgactgactgaccgagcaacaccgtgtgcagagaggatcagttagaattaaacgtactagtattaatttaattgaatctccggtctcggaatctggacggcatgcaagtataccagcctaacataccaggtccggctgaggaaattctaggtttctaaagtcgccacaacggcgtctcaccgtcaccgcccggtgccctcctcgagacttcgaccgattgaggaatttctaaccggcgcattatctattcggagtagaaagtttggaccgagaaagaacgtacgccgcttcaacgacgcatgcagtgaccaaactatcttcaccgcccgatccgactctcccccgcttttatatacgcgtgctggctagatgcatgcgtggtacgaggaaaacgtactacgtgagccatttcggtgtccgagcgcgtgagctcgatcgtcaagctatagctccggcgaacgtacggcgatc

SEQ ID NO: 55515 - DNA, 191 bp, Oryza sativa
tcggcgattcaactcccatcaagcaaaatacatttgaatgctcgccgccgaattttctgatcaaccctaagactaggatctttcaaatattctatcaaagggattctccagttttcttctaactcttgggcacaaatatccgaatttacaactaattcggcctctaaatcaattgtctcatgccccccagc

SEQ ID NO: 55516 - DNA, 1501 bp, Oryza sativa
acaaatggggatcacattattacatagactttgactattagcatagctttggattggtgttaccacaatgatgttagttaattaaaatacactgaatggtgggtcgtgggtgcatggttttgctggtcgcacccatggcaattaaggaccggttcacgggaaaccctgggagacttatcgtgcttaccacaagcgggagtgggttactgtttgatctgaagtatagctcgaccctttcctaggcaccgttggcgagggtgggcatgatggagttgggtcggcgagggtggttttgctgctttattgcaaatgaacccttagcctcctttggttatatcctgcatcatacctcctcttccggtatgacttgctgagtacagtgggtagtactcagtcttgctcccttttcccccacactagagctggagttcttcccagttggagctatctcagagaggttggtttcgtcgctgccgtcaaggattgcctgtggagtggaatcacccgctgcagaagtcaagattccaagtctagctcgttttacctttttccgctgcatttgtaatcttttatatttttgtaagacgtggatctatatgtcaacaattgtcgtttgtgtaccctggctggtcctggacagaggtttaatgcacattaagcttagaaattctggaattctattcgggaatttctgggcgtgacaagttggtatcagagccaggttgaccgtaggacaagccaactggaaacctaagagacctctgaaccccttttcatctgcatatgcctttttcacttggatttgtttcgggaaaatttggggttttgcctctttggtttgcggaaaaaatcttattcgttcattcagatcggatctttaaaattagctcagtctagggttttagaaaaaatttatttggagtttattcgacagtcagtcgggaatttatcgggtgatatgcactaagtcgtgtctaggttcgatggggcagcttcaagcgtatcattataactatgcatctattttatgcattaatttatggtttagtcagttgcataagtatcttttgtgtggtttcatgaaaaaaattttatgcataaaaaaatcatgatgcttggttatttatttgagtcatttgttgctttgtttaatttggatttgagcatgcgttagttcctatcccttgtccatcttagatgttagacttgttctctgatcacaagcgccgctccgatcttcagagtcgccgcccttagattcatcgtcttcttagtttgttttcttgctagtttccgtgtttaggtttgttgcttgtgggttagtcggcggtcgatatcacgtgtgagtggtatgactgccttaattaggagttgtttgcttccttttcagtgttttaatcaagattaagataattgcacttaaatttataagaaagattagtttctaagccatctgtttttctcccttttctcttatttctacctatccccctccagatgg

SEQ ID NO: 55517 - DNA, 291 bp, Oryza sativa
ttggtcacatattgttattgcatagtagatgctcatatttggtccaaatgctcatcacacaagctgaaatcacaaaataggggcaaaatcgcacagctgaaataaaataaaatggggcaaaaatgcaataaccaccaagggtataaatgtccttttttctaccactaacactgttaaaaccggctgttaaaagtgggggtacatggctgattcagattcaaaaagtgggggtaaaactgcaaaccctaaaaagtgggggtaaaacagcaattggcttcgaaagtgggggca

SEQ ID NO: 55518 - DNA, 162 bp, Oryza sativa
ctgttgggggacgaggacgagcggcgcggcggcggggccagcaggtggcggcggcccatcttcttccccatcctccgacgacggccacaaccggttgtggcggcgtctgcgttggcagcatacgggggcagcaggccgcggcgcatcggcggcggcaggcga

SEQ ID NO: 55519 - DNA, 268 bp, Oryza sativa
aaattccaaaaatagagttgctagtgaccttcctatttaagctggtctccctcaggttgaattggcgaggtgggattattcttactacagtaccgcgatggtactgtagcgctgcgctctctctctctcctcttctgcttgcatgcttgggctggtttttgttattgggccgactagctactgggctgcatgtgctgggctgctagctagctttgctctttttcccttttctctcttcattctctttttctatctaattatttgcaga

SEQ ID NO: 55520 - DNA, 1501 bp, Oryza sativa
ataacacaaaaactacattaaaacattgcatgacacaattaacaaatcaacaccgagatgactacatgtttcaagcaaactaatgtagttcctcgacgtccagtaacatcaaagagaattctgccccggatagcgagaggaaccacaaagtattttgcttcactttccaaagctcaagaaccacaaccagctcttaagcatgaacctcgagaagcggtaacgatcactaacacaaacaactactctgctagacagaatgacaacgtactagacaacaccagttttgtccatatgcctatggcaactcagtcccttagatgtgctctgaattaagcaatcatatccgcaataattatttcaggtctgttagggctcaagaccgccatgggaacaaccaacaaaaattccatactagttaccaaacattatgcataatacgcatggcaaaacatggtgacagtaacatgtatgtaagagccatgctgcgccctacttaacaggaaatcctccgagggagcaagataagggacaggcccatgatacaacgagacaatatagcttcaagggaacgagtccgtcgggaacatgattccccacagaccagatgacgaagcgtaacgatcacatctcatccctagaaagagtaacaatgtactagacagaataacaatgtactatacagtagcaatttactagactagacaacaccagtcttgtgcatatatgacaactcagtcccttagatgttctttgaatcaagcgatcatatacacaagaatcattacaggtctgttagggctcatcactgccacaggcacaactaacaaaaattccatacactaatcagacattacgcatattactggaaaacatggtgacagtaacatgtatgtaagagccatactgcgcccaacttcacgggaaaccctacaagggcgcaagataagggctgatacaacgagacaatgtggcttcaagggaacgagtccatcgggaacttgattctcccacagaccagatgacgaagcgtagcaatcacatgtcatgaaacaaataacgaattcgcatgtgacaaacagatctaaagataaggagttggggggataaaggatgggatgggggattattacttgttggcgagcacctggacgaggatctcgttgaggacgtagccgagcacccttccgaacaggttgccaccaggaccacaggccatggcacagggaagagaattctgctacaccgggggaggtggaggcggcggagataaaagttggttgacctagagtacgaggatcggacacgacatgaacccgagtacgaggattggacacaaatcaacactagagtaccgaggattggacacaaatcaacaaaagactcggtcaagtgctggttttgggactccaaatcctagtccgtctcctacagattccaagaacgcataatctcgtttgttccatgacatccattcgaaaagttgtgagaaaaaataatttaa

SEQ ID NO: 55521 - DNA, 1501 bp, Oryza sativa
tgcggtggcatgaggttggaaatcgatgggatgccactaatctggtcgcagcgcaacaccccatttgcgagatcagagcttgaggttgacggcgaggtggttgatcccggctgaggaaattgggcggtccggacagatgtgcagaggtaattctccaaagtaaaccctcaagtcccagccacctgattgttcttgttgccatcctcaagagcaatggatctagcgagtggatctgcctggaacttgttcgttcttgatggcattctgagagcactgcatctagcgagtggatctttgctttcatccactttctgctgtgacgccactctgctggtatttagtgaaaaaaaagacatgtatactttcttccctttccggccttatggtttgtgcctgcaatggagcaatcaatctgatcaaaaatgttttaccccctgcaatgattcttctgctgataacactaggtttcagcatggttaggatggatcaatttgttgcagaacagcagatccatcaccaagcagtccattgccatctccaccatgggttccttcattcttagtagtccgttgccatcgtcatcatgggttccttctttcttagtgcatgtagattggagacccgttggtgcaagacatgctctgcaatgcagaaaacttagcacctctggctcaaattagtatgggaaaaggtggtggctgctggacgatcaattgactggcttgctatatttcttgcaattctgtgtacacacccagaggtaactgcgagctttcaaatatttgtcccacattcattcgggagggtactcctaagggattgaaaaccatatcaacaggcgttccatcttgcaaatagggcatatcttgcctaggcaaaatttttgaaatgatccccttattcctgtgtcttccggctactttatccccaactttgatttcgcgtttttgtaaaatatatacacgaaggttgcacgagttgaaattatgtagaaatcaaatttagtggctttttacaatttactgtcaagtgatagagactcccattgtctgaccttgtatgtctcttccagagctgcaaatagggatagcatttttttttgctagatgttaatcatagatttgtatggtatacaaattgcggttaacatcttctcttgaaactaaattgtagctgtggcttttcttccttgccattcgtgttatggattgcatgaatgagtgctgtagatttttttttttggtgccttgccattcatgttaaggattgcatgaatgactgcacagctttttattctttttgtcgttgatgcactgaccttagtttccttttggcaatgatgattggttcattagcttcaaagggtttaggtgatatgacctgctgggaaaaagatgaaatttgtcacaagcaaatacctaaggtaaactgtgatgatttctttctataggatgcaaattagggaggttctgttcagggatacaattttttttttaactac

SEQ ID NO: 55522 - DNA, 1501 bp, Oryza sativa
tccgatggctgtggtgggtgtcagccttcctctccggcggcgtcgatggcgtggctgcggctgctgctgcggctcgcggcgtcgccgtcgagttcagtggtggggccggggcgtcggtggagttgccgggagcggcgacgatggcgtggtgggtggagttcttctcctcgtcccttctctgccatcgcggcattggtgttgcggtttcctctcgctgctgtcgtgatcgcgtgccattcccgacgcgttgatccccgtcgacgtcaccgacggtggcgttcccggcgcccgaccggagatcagaaacccgcggtttggccgtttgctccgccgccggcgccggcaaccccgagccctcggcgccgctctgcgttctacgcgcggtgttacgcagatcagcgccgccgccggcaggaggaatgggcgggtgaggcgggagagacctcctcggcagcgccgccgccgacgtcgagttcgacgacagccacgacaggagtgacgacgacgacgcccccgtcggggaagggaacgaggcggcgtccgcggtggggccgctggcgacggagacgtagaagaaggccaccacgagcgcgacggagaagcatgccagcacggccttgctactcgtcatcacatggccgccgccgcaaccaccaccgccgccgtgcttaccgccgccgcgcttgtaaccgttgagcgacgacgacgacgaggacggggagaggaggccgtggaggtgcacgtgcagcgacccgctgctcccgccgcctccgccgcccgcgcctgatccgccgcctcggtccagcatcgacagccacgccttcctccacgcgccggccattcaatagctactagtactagctagtcagcgtgatcggtgtgtccggctagccgcgcgccgccgccgcaacttgctggggagtgaagcgagcgaggagtcgaggtgtgtgcgcgactcttgcagcagttggtgataactgtagtggagtggagtggatcggatcagccagagatcgaagtgcaaccgcttttactggttcttggccagtgcccagtgcagttagggtcgtcgagctccctctccccgcgcttcgcctccggactttttccaaacaccttgcatgcaacacgatctcgtcgatctcgtcctcgacccttcagaatagactaggaggcccgtttataaatctaacccagccaccgagcatctcggcccaatcatctattgctcctacatggaggcctaacacagaactgggccgagtcatgggccgcaccctcgttatcttagggttagttacccatgaaatcctgaccgtttaatctctcgtatctgcatcctgaccgtcaaacaagattacacggagtactaattaacccaccttctataaaagctcgcccccatctccctccgcctcagcaagcgccgctccggttaataatagcaaaatcccctcccacccccgccttctctctggaagcttcctcctgctcttcgcca

SEQ ID NO: 55523 - DNA, 1480 bp, Oryza sativa
tagtgtttggttcactaaccttttgcagagaataaccataaagtggaggagaattgacatcaactcaaacgataaatcaatcagacgatgtcgagaatcagacttatgcatgaatgggccaagaactcagaattgacacgatgaattgggccaaaattcacaagtctacaaagtgaagcaatagaggaggccgccagccgaagatgggccgggatggcccagcccatggttcggcaaaacctggtggttgggccgaacccatcctagcaccgttggatgcagggttcggcgtggacgtccaggattgcatcccaatgacggtcggagggcacttcggacaattccccttccacaactgtcataactacctctatataaggacttcaccttctcacttcactcacacacctcaagcaagagctctctcatattctctcaagtttagtttagtatcaagctggtggaataggaataaagtagaaatcgggagtccggaagtcttcggaagagttcgggtatggctctagtagctttctgttcctcttttgtaagctttgtactttatttagaatactcttctttatacatttatggtattgaaatactttccgagtatatgaatgcctactttacattatgttcatgttatacggaatatactgctagcttatctgggagatgctttggtgcgggtataatgtttgcatatgcaatttctctatgtcatgacgatgatattagagtagtatctggtagtttagacgtggtgtctagattatgggatatcattatttggggttatatgctacggatgagaggtgggtcgctgatggtgacagctcagtacgggtattcctccgcacgtgtatatagtcctaagttaattccttggggagggtactcctccgtatttagcctcggttatatggtcatgacgggctgtcgtaagaaactcggcagtcaggggtggcttctcgaagtaccaggagggcatcggatacagggtattagctagtatatcagttaactagaatgtatgtatactatgtatattagaagtataggaatagattatctttctcttttctttccacttagcttagataatatattatgagaatgagtagccaatgcttgtgtgtcactctacccttggtttatcttaacccctgtttagaatatgattatcacaagtgatatataaattattagtcaagttctctctacatcttcttcccacgggataaaataaatatgatacctttggaatactctcgggtgaaatgctacaatggtatatccgtgcgcttgcggatgaactctgtaaccataatataccaggagtatttctgtgccattgctgggaattatatttctagtaatgtcattaagaaataccaacacccataagataaattgcttgcttaggagaatgggtttcattggccgaagatgattgatgattgttccatgtactata

SEQ ID NO: 55524 - DNA, 204 bp, Oryza sativa
tagtgtttggttcactaaccttttgcagagaataaccataaagtggaggagaattgacatcaactcaaacgataaatcaatcagacgatgtcgagaatcagacttatgcatgaatgggccaagaactcagaattgacacgatgaattgggccaaaattcacaagtctacaaagtgaagcaatagaggaggccgccagccgaaga

SEQ ID NO: 55525 - DNA, 1501 bp, Oryza sativa
atatatgatatatgtacatctatctatcccagctgtcagctgaattatgacatgtcaatgtttttctgatggaaggtaagtgcagtatatgttcaggggatttaattacattattaactcgccaacctctcacgagttgcaggtacgagtagttactagttaggaggactgagatagcccaagaggatgaaaaacaatatggcgtattgaaatcttcggtgtagaatccatgcatggttgcgacttttgtccgtgagagagctcgcttcaaaactctgtctagaaagcggaaagaggagctagcgcgctgagtctgaaactctgaattagtacgtttgttggaaaatcaaattagcttgccttgagtagcagaatcagattactgttgtttatcacgcatcccaaattaaaggaagacgaccgattttgaggtttaaatcttgtcactgtgctgcttctcgtacccgatttgaattgagcgggagttagttaacttagtttcagctacggattttctcttattggattcttcattaagatgtccgcgctccatgtcccacactgttctactttcaggaacagcagaggatcgaccgcattaatcgtgagaccaaccataaatgatcgatcatcgatcgatatataccaattaatccagatgacactaatctccatcctaacacgcgtcgctctcactcgtgattgcaaaaacacatcttctcctcctatggagacaccaccaaaaaggcgaattcaatgagaaacaaattaagacgcacagctgcgcatgcccccctgctccatctggaacgaactgaataattgacgatgactatacacgcacaatgcatcccggccggaagaggattcagttcctgtactgccgggttcactagctttcaagtctggggagcaatgcaattctggtggtaggtagcaacagcgagctcgcagcgttctttccccttcgatcgatctccatctctttctcgtgcatgcacatgatccgaggcacagcaaggcagggcagggcagggccgggccagccaagtggcctccgagggcgagatgcgtacgcggggacgcaacgcgaagcgccgcatttagcatccaaccaccctgcatctgcggcgtgcagcagcaaaaacaactagcttgcgtgcttggtcaggcgcgcgcgcgcgagagagaagaggggtgtgtggtgtggtggtcctcgcgcgcaattgctttccgtgtcccgcgccccgctaactcactgctcacgccttaactgcgcgtcttaaggtggcgtggcgcgagacatcgatgcgaattgcgaacgcgaatgcggcctccctctataagagagatcgcaagcgagaacgtgaacgccgccaccctcgcgccgtccatacatccaccgtcgtgtcgcccactgtccaactgccagtcagctagccccaagtgtatactctcagctgctgtcgcgagtctcgccgacgtacgcgcgcgatgggcg

SEQ ID NO: 55526 - DNA, 262 bp, Oryza sativa
attaaggtagcttaccgatgcttcaagggatcgcaggtacaggttggctctcgatggtttaactgacaatgattacgtactgaagccatcattttttatcggctcgcttttgcaaaaaaaacagtggggcactcgtgctgtcgcacgccatccgcgagacccatgatccatccaatcttgatctctccttttattactgaccatctgcttgcttttaccccacgaggtcacaccagtctggactagcctggagaggcacaca

SEQ ID NO: 55527 - DNA, 515 bp, Oryza sativa
gccgaaccaaaaatccgacctcccggcctctcatttggccggtagatagcttattgggccgccaacatcttgcacaatgttttggcccgattctaagtggttttggttgacatatgggccctccaatctgtgtaaatgcgtcctgaatgcgcggaggttcattttgttattttcagggagaccatgaactctaattgtaccatccctagcttgggttcaattatcttcgacattttagaattgataatcaaattgatctcaagataaaatggatgtccaaaggaaaaattgtgcaaacctgcgctttgtataaaacagaggacgattcatggtagaggtggttcagccgaattggtggttcgactgacccctcattgggtttgactgcgtcaatttcccttgtgttttctcctcaaattacatgcatacacatatttcaccaacactaatggaaatgattagtaataacacctaccactaagttgaataccatgttttatttcattatatgcagg

SEQ ID NO: 55528 - DNA, 1501 bp, Oryza sativa
ctgctgcaccacctgcctcgccgcgtcctcgccgacgaacgccgccagattccgctggtagttctcgaagttgtccagctgctgaccgatcctaattatgttcacctgcacccacagcaaaacacaacgttaatgcgcatttgttcgtgacgaaaatggtggcggatgcgcgcgcgggggggcttacgaactggatgccggtgtcgttgaggatgccgacgccggcggaggcgaagttggcgccgacgagaaggttctcgcctcggaggtccgggctcaggtacggcagagcaggctgggacccgaggtactcgcctgagcccaaaaaaaaaatgcagcgtgtcaagaacagttgtaactaactttgtgcattgcattgtgtttctttttacaagtgacagtgatggataaggtgctaactgatgatgtccgggatgttgagcccgtttgagaatctccccgtgggcatgtgcgtcgggaagtcgatcccgtacggcggcgcgtccgcgcgcgccgtcgtcatgaggtagttgttgttgccgttgtccacgagcgagtccccgaacacgaagaacgccctcggcgccgccgccgccggcgtcgcggcggccacgagcagcgccgccaccgccgccatgaggaatccaaccaaagaagaagcgcccatcgcgcgcgtacgtcggcgagactcgcgacagcagctgagagtatacacttggggctagctgactggcagttggacagtgggcgacacgacggtggatgtatggacggcgcgagggtggcggcgttcacgttctcgcttgcgatctctcttatagagggaggccgcattcgcgttcgcaattcgcatcgatgtctcgcgccacgccaccttaagacgcgcagttaaggcgtgagcagtgagttagcggggcgcgggacacggaaagcaattgcgcgcgaggaccaccacaccacacacccctcttctctctcgcgcgcgcgcgcctgaccaagcacgcaagctagttgtttttgctgctgcacgccgcagatgcagggtggttggatgctaaatgcggcgcttcgcgttgcgtccccgcgtacgcatctcgccctcggaggccacttggctggcccggccctgccctgccctgccttgctgtgcctcggatcatgtgcatgcacgagaaagagatggagatcgatcgaaggggaaagaacgctgcgagctcgctgttgctacctaccaccagaattgcattgctccccagacttgaaagctagtgaacccggcagtacaggaactgaatcctcttccggccgggatgcattgtgcgtgtatagtcatcgtcaattattcagttcgttccagatggagcaggggggcatgcgcagctgtgcgtcttaatttgtttctcattgaattcgcctttttggtggtgtctccataggaggagaagatgtgtttttgcaatcacgagtgagagcgacgcgtgttaggatggagattagtgtc

SEQ ID NO: 55529 - DNA, 594 bp, Oryza sativa
ataggtgaattcactacggggaaacggtgaacagccccattgccatctctactccccctcaaaaggagcacgaatctgcacggcccacacagccagccgctgccgcctgtcgccgccaccaccacaccaccgcctcgttgctgccgtcaccaacccaccaccagaaaaaaaaaccatcgcgcctcgtcttttcctccatttcgtgcgtgagcgtgaccttggttgccgcgtacaccaccaccgcctcgcacttttccgccatttgtccgactccacccgcggcttatccctccttttttttttctttttcccttgctctcctccgctgtttgcttccccgcctcgtcttctcggttttttccgtgcggtcgaagcatcggttccttataccatacctttgcccccgttcttgattcggttcttgccaacagctttgtaacttctcgggcgcctcattggagtttctttgtgagattcgcaagggggagaggaggagtcctttggtcaagcccctgtttctccatttctggttctctgtccgtgcagatttgctgaggaagtagttcttgggttcatcagggagcgagaggtgcg

SEQ ID NO: 55530 - DNA, 1501 bp, Oryza sativa
ggaggtgcttctcccgcagacatcaatgtgatggtaaaaaaccattctgctaatgaaactactcaagaaggttagaataactttcctgcagcattttgtttgcaatttctcagtttgctttatattgtttatttgcccaatttttttgttctattttgcaacttcgaaaagcaagatgcaatttttttaacacttagagccctctattaggacaaggtcgttctcctatatagataaagaaatatggtatgccgtatgcttaataaatgttgatgtaccagtatttagctgctaactagtagccgctgtgataagcttcagatttcgtgtgaactgtgtatagaacattgtgttttttgtgtgtgccgatcctaagaacatagttttgataccaagttcttacaagatttacctcttttatatttaggactgagttttaaggttgaagaaatagttcaagcatggaatgaaatgtatgatgcaaagaagtggagaaatggagtgccatctttccgacttgagccaatattccgacgtagagctccaaagttgcatcatatgctggagcatatacactatgcttgaccctctaatatatataagaggctctggtttgtcatcatggagaagttatttcatgattttatcaggtaatgtcttgccttgcaaatattatcggcattgacaggctgcaaacagagcttcaccaaggccaattataccagaaaatttatgatgatgtccctctttttagataattggtcctggtttgaagtaatttagtatcttagactacttttcatgtcaaggtgaaaactaaaaatattagcttagaacaagtaagcgggaaaaaatgtctatccttatgtacctggaaattgacttgttatcagttggtgtccaggatttttacttcaacctgtacttttatccttgtgaattggttaaaacttactttgatagaataatagaaaataaatgtctaataatttgttaaatgaggaatgcaagtgccaaagtatgatatattaaagcactcatgttctacaactactacatcttgtgtgtgtgtgtgtctcccttctctcagaaagcacagtccgtttacacaacattacagcttcacctaatacaccatctgtgaaatacaaatgcagggcactagggtatcaagggatcttatactcagttgtttttatctgttactcctacagctgttgaactaaaggagctaacggtagtcagccacccctcaggtgttgattgaatgtactgaaactagattgttgtcatattttgtcgaatttcaatcatcagactattagtgacaaagtaaatccttagctgtgaagtcatggatatttgcatccagtaacatgacctaatggaggaatactttagaaaaggtccaacatatgcattaaaattccaacataacttgcatacagtgacaactaggaaaaactcctccagattacacctctaccaggtgctctttttc

SEQ ID NO: 55531 - DNA, 1501 bp, Oryza sativa
cttctctctcctgccagctgtggagctgtgcacttgttttgttcatgatagctgaactatctgactgaggaaagtgcagcctttaaaagcctttgttactgcaaagattccttttgatggtaatcatggatttgtaatcctctccatccaattggaatagtgcatctgcttttatgtttacctcctgttggctgctactataccacattctactttttcatcttgcctggtgttgctcagtccccatcgtatcttttcgtcggacgtgccattctccttttcttttggttttaaatagaacagggccatgaactgtactctccttgcatcaaattgggcctactaatgcctgcaaaaatccagcctttgcatgtgtgtgttgatgttttcctggaaggacagcatcttgctacagtgtacagtaaattagtaagctcgtctgaccttatatggcccatacccacagtttcaaatttaagggttcaatactgagggctttgcaagagagcattatatgctttgctgcactaggttgttcgctcgccagtttcttaccagctacctgtaattctattgtgatttaattggctacatcagcttttggatcacgggtacaaggttggttttgtaatgttccatactcgctgttccatttgaatgaatttcttgtcataactgtcttttcaggattcatcaatgttgttatcctctgaggcttcctttgtaataagaaggcagtgatcaatttgtttgacctgagtaccgggatgaccagcaaaaatgtgctaactgatagaactcacagagatggtacaaaaatttcttccactttttctttgaagtgctgcttaagcaagtgatctgcaactcctgattttgctttttttcgccgggtcggcaactcctgattttgctttcataatgcatatgaatttatactttagagttacttgtgatagacgggctagatggcattggcattgtttgaataatgattcatttgcataatgttagatggtggtctccctttagacaatgtcatgtttgattgtttgtagatgatgacacatttgtcttttctttctggatgttttcctcttcttggattcgaaaataattcaaaagagctcttgctatttttgttgcaagacactgaccttaaaaatcaaactgactgtgttctttatttgttagtttgtattgatagacataagtgttttctgcctaatgttaattgttcagcttgcatctttcaggctctcgagttcataaaagccggcaagatgtcaatagaactgttgatcccaaaataggttgtgtagaggacaaattagtgagtatcatgtcatttgccctattctagcatatgtaatttcaatttatcgtaggtgtcagattgtccttctaaatatatatctggacagcacttacacaattttgtaaatttcagaaagtatgtcttcatttttttttctaatatagtattcattgcagcaggtag

SEQ ID NO: 55532 - DNA, 334 bp, Oryza sativa
gagttcttcccaaaacctctgccactactgcattcttattcctaaccaaattatacagattagggtattctttctcaagaggttgacttcctatccaacaatcctcccaaaatcgtacttgtttgccatcacacgttttaaaataaccaagtgattgaaaggattctttagctgtcataagactagcccaaaaatgagaatctcctggatgtttttgtacttgcataatggttttttttttgccagatacttcctcctaagcatattttgccacagtccatcctcattgattagtttaaataaccatgtacttaacatacacctattttggatt

SEQ ID NO: 55533 - DNA, 269 bp, Oryza sativa
agagctgtagctagctatagcattctctctctaggatatagagagagaatacaagggaatgagaaggagaaggagaagagagggagtgtagaagaagggggaaggaggcaggagtccctttccccgctccgcttggctttttgcctaccctcctcttcctctacacctcatactcctagctctctacctctctagctagctagctataggtagctagctagtcctcctgctacctaggggggcgacgccgccggacggggaggaggcca

SEQ ID NO: 55534 - DNA, 266 bp, Oryza sativa
atatatatatatatatatatatatatatatatatttcctttatatgataattgtcggtgatatgggcccgggggtatcaggtttagagggaggaggctgccccccgatgccacgtggccctccccggagaggagtcagacccgaggtggcgtggcggccactccttcccaaagactagtcggaggaggctgccccccgatgcacgtggccctcccccgagggggggagtcaggctcgaggtagggcggcggctactccttcccaga

SEQ ID NO: 55535 - DNA, 1501 bp, Oryza sativa
atttgttctataacttaaaaaaaactttaaaacatgacttatattgttcatatttacactattttttaataagattttcctgtttgtgctactgtttccgtttactctagagtctggaagatgggcagttattatagctctaaacacgcccacgtgctgtgccgcgcgctatgcctggcggagtgtctgtggctgcctaattagcggaaactaactatccgtatacttgtgcatccttcgacgtggatttgacaggacgagcttaaaacacgggatcttcgcacacacagtccggagctcgtaggaaggatcggagctaactactcgaggtctcgatgactgtaagtatactgtacttctgatatatctgatgctattagcacaacgacgatgtactaggtagtactaaacagatgaatttctgatatgatatctgaggttaggagatatctctagctatatagaatatagagtggccacatcgatgcacagttccatcacattacttttcccagaatctttccatcttagtgaaaagaagttaaggacctcgaccgctcaacgcatggaactaacacacaactgctgtagactgtagctctctcgtacgtcccgtccactgtcctgttgctgttcatgagacgccttgtactgcaaacgctgctatacgaactccctccctccatcccaaaataagtgcagttttgtattaaccgttcgtcttatttgaaatttttttattagtatttttattactattagatgataaaacataaatagtactttatgtgtgactaaatatttttaaatttttcacaaaattttcaaataagacgaacggtcaaacgttgggcacggatatccacaactgcacttattttgggacggaggtagtagtacttagtactgctgctgcttcatgccgatcgacctggagacgaaaggagctgcggcgtaatactggccagcatatgaatatctctgttttctgtctgaaaacgaacagtattcgaatgagaagagaagagaggaaacatcccacacgagaggtgcatgtgccatgtgtatcagctgcgcctgccgctgttacgttgtccagatcctttttccccccgtctgtttttattcgccgtcattgctctgtctacgctttagcccaggagtataattattccctcctttctcatgtgttttgcagtagtttcactgttgctgctgctgctgctgcttgcaaacactgaatagcctaacctcttcattaatttctcgctctgattttgacgttagaacaaagctaagatgggccatacgtatactaggaggagtaccatcatattcatcttctttctagcttcctctcctcttcacattccctgcatccatccatctcaaccaccaccacctcatttcaggagatcatctcctccttttctttgctagggtttgtttgccataactactatctatcgcctcttcttcacctcacctgtcctgtcggcca

SEQ ID NO: 55536 - DNA, 1501 bp, Oryza sativa
attggtcttcacattacctcttctctagctggatcctaatcctgctgcagaagttctgttcataatttgctctgttgtgtcgcaaaacctttgtgctattttttcaaggggagtgggatttttctgctatcttttggagtagccatttgatgtgtgattgccatccatttatgcataccaacccagcgagcatactatcatattcaacataatttttgtgtctcgattgagctacttgtggatagtaagtcaattaaataagttgcttgatttccaagtgctttgaaatatactcaccgaataaacgagtcattggcatctggcatttggccttccttgctccctttactccttcagtcactgtcaatgctatggtgtaatggatgatgtaggctggcttgcatcagggtagattttctgttaatttgtgttgtattggtattcttgttctgttctactcaatctttacattgttcatgctgatcttttagttggtccagtttggaccgtggctcttgtatgatttatttatactttagttttagaaaaataattcatgttaatgaaacgtggaagaccaaattggtcctactgattgattatatatcataaataaaggtccaaagctaatttacatcattgtgccatattacattgtaagccatatttggatgtttggaaaataacttggtattgctctatggataaatgatttcaattgataaagaatttgacatatcaatagatcaccaggtggccaccttgctcgagttataagatgggaggtgtttgatcctgtttttatgttttttcctttgtcatctggtcaaacgcttcttctgtttttgaactgttgtacattatattgttaggaatttggaaagcattcgaggttaatgtaccatgccatcctgtactaatccctacctctgatttatgcctttcctattcaatagcttgtttactgatttattgcaataatccggtgaagtgaccgtttgaatgatatatactgtattttgacaaatctgtgagcttccagctgttgagtttaacattgaaactgcaacgccttttgttcgttggtttgaattcttgctgtatttacttatggtattagtatcattcatgtgtgaggactaaggaagtaaaaagttgtttctatatatgactgcaggtttgtaagtgaagtcatctggaggtctggacacgagaaagtgacatccgagcaaaagattgatcagacgggtcaggagctttgacacgtaattatatattaaccatttcacattctgaaggacctctctgaaagtaacttggaatggtgggtgtgattaggctttgtttgtcatttagctgtcaatcttttcttgagaggctatctttttttgagaggatcttgaaaagctatatcatctagtataggaaaacgggctcatcctatatggaataaaactgtaacatgagaaagataagtccactcctggacagcattcctgaa

SEQ ID NO: 55537 - DNA, 1447 bp, Oryza sativa
aactgtgaacttcttttaccaaacaaagcaacatatgtaaacttgacctttctgattcggctgattattggtgccgatgaaaataagttatgttgatttaattgatccacgtgatttcttaaattagcaaaacatatctatcaaagacatcaaattgtattgatctatctaatttctcgtagattcagaccctcctataacaaaacagctagaaatggtgatattcgaaattggcaactcatgtaaatgaaccatatccatgtaacgtgtttgttgtttaaacgctatggctgttatcacccacaacataagagtattctatccttttttttttacattctgttatgtatttcttttacatatttatgaggaactcctaaaaagcatgctctttacttcattttatgcaagcatccgaatggaaaaggcaatgacgacatcttgctggaacaatgtgtggtgtcaatgatgggagaggtcagttgagttttcatttttctagaacagttagctgggctgacattttccttggtcgtaggaaggggcatgctagcttagtaatagatataaatatagtttgattattacctgggtagaggtctgttctttccccagtacgacaactagttgttgaagacaaatgtcaactaatgattataccaacgcttcacttacttggctaatgtacggaatgagaaatcaaacaagctaagtcaaataaacgttttgataattgcatatgacatcaagagaaatgaaggtcccgtatcatttcagactccaaaatttcaaacttgaacggattagtcaccataaatatatttgacactgcacatgaggaagtttttgcacaaactaaatcttaatctcatgtgccagtaatgacatatcttctggcacataaatgcccagtgccttggaatatcgaataataaattatggctgtagacacttgagtaatacttgagtaaactgattcttctctcttacctttgcatacaaaagggcatgatatgttaatattgcggattctgtagatatgcttgtcttagtatatttcttaatatcgcatgatgtatactgtttttttgggccaaatttaagcaaacattagagaattttttttaaagataagtgtgtgtacgtatagcatgatctttaaaaaaaggggatataatgccctatggtacggtattaggaacataaaacaaatttctagctatagccctaagtcttaagtttaggtcagtacttgtcacttgatacaaattaaatacgccaaaacacaccaaattaagcgacagataaatgcaacacgtacagtctaatgtaaaatgtttctgtagggcagtaagagagtagaggaaaataccatttaaagactagactcacatgaagacacctggaaaatcaggcatgcacctatctctcatctaggagtggtgag

SEQ ID NO: 55538 - DNA, 204 bp, Oryza sativa
ccattttaaaattgtaattgtttgggctgtcagctatttgccattattcacaagtgataattgtgaccctacaacgaagaggctaacagtaggttttagaatttcagtaatgttatatctcaaaagccaactattacatttgcagggaaggatattagtgattttctactgctgtttcgtcagaaggacaagaactgaagaatt

SEQ ID NO: 55539 - DNA, 1501 bp, Oryza sativa
gaatatgcaatgatgagaatatttcttacttaaacaagaaaattaaataaccaagagaaatcttaaatactcacttgtataaaataagcgtatgccgaggtacaagagaggagagagtgccgacaactctggcactcctccagaacttcccctcaccctctccctattttccaatactctactagaaagtagctttgaatgaactttagagatctccacctgagatgtgtgtcttgagagtgatgatgaaacactcttttataggcagttatgatggttatgtaggtcagtttcacccacaaccatcattagcatccaatgaaaagctaccacgtggagggccaggatgagagggggccaaggtcggttcggccgacccccttggtcagccgaactcctggtcccacctctcagctgctccttcgcttgagtggctgcttggtgggcccttgtgtggttgcatggtggattagctcgattaagtcggttttctctatttgtgggctctccaatccttatgctcatgtctgagtggctggagctgtatttcttcacatggcaggtgtgtttttcattcaaaattacctgcatacaaatatttcaccaatacttgtggaaaatggtcagtaataaaccctaccactaggtttggtgttttcttttatttcttttatgcagaaattgataggcatatttggcatttaagaaccgtcaacacttgcattgtaaaacccgtaatgtgctaccctcctgaggatttaaggaaaaaaagtagggggctactatccagggctcaacaccattctatttggtgttgaggactgggtagcaaccagccaccaaaacattggtattgtgttgggtggcgcgctcggtgcccacatctcagcgcaaaattagctagtgccgagattcaacatctcgacactaaggggaatggagttgagctggtaacctcagcgccagctcatttggtgctgaggtgtactagctcaacaccattcactatggagttgaggttggctcccatgcagatggctctttgcgtagtcttacagctacgaatagtcaataatcacctgcatacaaatattcaccaatgcttgtggaaatgagtaataaacactgctactaagtttggtatttcatttcattttatgcaggaattatcggtcagatttgttatttaaggaccgtcaacagtaagctgttacccttaatgttagctacaagtgttgcccaatgcctcagaactacaacacttgtgatcttcacatacaccagttatcctctacctatcagctctactctttcttgaagaaacctcccatttgcagcctggatcgaggcaagccaccatgtacttaatagatgcattggagttcttcacaaggaatggcggtgcacacggatagagtagctctgcagccatagtttcaagtcttctagagatcgaaattccaaacctttcctcgattcctcccaaatttcattaatgggt

SEQ ID NO: 55540 - DNA, 1501 bp, Oryza sativa
ggtatcatgtcctgatacctaacctttatcagacgatacttccgaggtatcaggtgatacctataagatatcaggcgattcctatcatgtatcatgtgatacttgcgaagtatcaggtgaaacctgtcaggtatcaggcgattcctaccatgtattaggtgatacttgcaaggtatcaggagccaggcactaaaagcgtcgtcgtcggtgatcccactgtccacgtattgtgccggagcttgtcgccggcggcggcatcctccacgatccacgccggagatcgtcgccggtgatcccaccgtccacgtctcgtgccagagcttgtcgccggcagcggcatcctccacggtccacgccggagatcgtcgccggcgcagccacatcctccgccatccacgttccacgtcggagctcgtcgccggtggccgcgtcctcctccgccacgccccacgccgggctcatcgttagcggccgcgtcctccaccatccatgcctcatgccggagctcgtcgccgaggccgcgtcctccaccgtccacatccccacatcatcatcaagcgttcgcatcggcgcggtcacaggcggtagcgacgagcaggcaatgaccgcgaccatgaagctatcatcagcagcagtgacgcacgcggaaaagacatggctcaaggagatagtgcaggaggaggcgataccgtcccacgcgctcgggacggtatatcccgtggtatagcatttcaacacctctaaacaccttaataaaggataaaaatgagtattgcatcaatgaatataaaggaatgtgtttatttaatttcagacttttgaaattgcattatacacgctattaattactacattcataaatatgacttttaaaataagatttttttggttaaactttcaaaacgttcaccatcaataacattttcaaataatccatttatataaagatagcaaaaaaaaggctacaccatgttttctctataggtagaaactttcacattaatcgaagaaaaagggtaaggcattacagtctatctaaattataatagcgtagattaattgatatagttgtatagaaaatatgattgtatttattaatacacttttattctatgtcaaaattattttcataaaaagaatgatggttaaagtttgacctaatcttagactaaatcaaatgagcggataggtagtgaatatactaattaaatagaaatacaatggacgcagacgcacgtctatttctaataaacctttatcctgggaacccatttctgatggaaattaaacgccacaggccacatgcatcatcgaacgtcgctattttgcatagccgccacagtcatcggataggtgatttaatcaccgagttgttttttgttgaaaagctgctcacataacgtctgtgcaggtggccttgtaaaatcaaatcagcgtacaagtattacctgagatatcttttggatattattggtagtagaatgtaattaatcaaagaatc

SEQ ID NO: 55541 - DNA, 1501 bp, Oryza sativa
ccctcctcctctcagatcgatctctctcctcctcctcctccgcctcctccccttcccaacccatccccggccctctcctccccctcctcccttcccacccagcaggcgtccggctgggccgcgcacgggcccagtggcgagcggcggcaggcggcagccactgctggcatctttttttttttacaatttgtgattcactaagatgtataattttatgatttgtggcatgacctgagatgtataatctgtgatgtatttggtttgtgtgtaatttttttaagatttgtgatgtatttgatttgtgtgtataagtaacttaagatttgtaatgtgaatgttttgggatgttactttgatttgaggtttgatttgggatatgtatcccacttgatttgggagaaaatacagggattaaactctagctaaaaaacaatgaaaaaaaaagagacctaatgggactgccgctaccctctctttagtcccggttggtgttaccaaccgggactaaaaatggatctttagccccggttatttcaatcgggactaaagatgggcatctttagttccagattcatagacccggttgaaaaaccgggactaaagggggattaccaaccgagagtataaatggtttctctaccagtgttattagcgagaagtctagctaggcttgactcgcgagctggctcgttaagctcattaacatttattccaccagtgtaattttaagtttatcattttatcatatatgtgtggaaacgaagaatccactaaatagtaaatacatatatatagttggatataattaaataattaattaaacaccagttgtgaagcgctgggtatatgaagatacggtgatgtctagtactcagagattaaaggggtactagataagagagatgggataaaatcgctcccatacatcgtggtgttcttttccggatggttttagccaaagaccaggttgaggcttgactcttgtgaagagagaaatgtttgggcccatatgttagctcctattgtggcaaagcagagagatattttttttattttattttaatatacatgtaactgaacatggtaccaatgctaatctatacacccttcgtaaaaaaacttaaatcttggctatgaacataaacacgtcatttgattacttttttatgatgggatacattataacttctttcatctggtactgacatagatccatatttaatacgtgtgtatgtgatctgcacactattgatgctctaacatgctaaacaagcaactcgaaagctagctcgttaagcttacaaactataagactaatttgacttggcttattaaaactagagtctattcgagccgagctcgctacacaagccaatttaaactactactccctccgtcccaaaatataaaaagttttgaatggatgagacgtattttaatactacgaatttagatagactatgtatttaattaaaactccttatattttttggattatagg

SEQ ID NO: 55542 - DNA, 1501 bp, Oryza sativa
ggcacaatgatgtaaattagctttggacctttatttatgatatataatcaatcagtaggaccaatttggtcttccacgtttcattaacatgaattatttttctaaaactaaagtataaataaatcatacaagagccacggtccaaactggaccaactaaaagatcagcatgaacaatgtaaagattgagtagaacagaacaagaataccaatacaacacaaattaacagaaaatctaccctgatgcaagccagcctacatcatccattacaccatagcattgacagtgactgaaggagtaaagggagcaaggaaggccaaatgccagatgccaatgactcgtttattcggtgagtatatttcaaagcacttggaaatcaagcaacttatttaattgacttactatccacaagtagctcaatcgagacacaaaaattatgttgaatatgatagtatgctcgctgggttggtatgcataaatggatggcaatcacacatcaaatggctactccaaaagatagcagaaaaatcccactccccttgaaaaaatagcacaaaggttttgcgacacaacagagcaaattatgaacagaacttctgcagcaggattaggatccagctagagaagaggtaatgtgaagaccaatcatgccacctgattgttgtacctgatattggaaacagggatatttttagaaaatgcaagcactgtacttgttgctagctagtctgtgctatgtaagttactatgcttctaccaaatattctaccaaactgatcaaagaaggatgggcagttgggcactacctttctttaagaaatgatgcttttatacgatgaaatgcatgcattttatttacaatgcatagttagatgggtgttctgagaatgttatttcactatttcagcatgtaatcttgcaaaacttatttcttctctcccataatggaaattaaaaatacattacattttgcaaaacaaaagattatatagtgtacatgggttgcacttccaagttatgatttttacactttattgaactggccactgtctggttgtctgcaatacagtatatatgtgtgcaagagtagtacacagcatgaaccaaaggaattggatcagacatgaaaacttgaagcatacggtgcacaaagaccaggtccaaggaagaggccagcaataagctgctgccttgctgatggccgcatgatggagattctaatccaagggaaacaacaattagaaagaaagcaacccagatcacaccaccacaaattaaaccgtattttattaccatcacacgcagcccccttttcccgtggcaataatacaatcctctattcctctctcatgtctgccttttgagcacataaacacaccaccctcgccatcatcatgcctaaccaagtttaggccctaatcaacgctttgctctgcacacctcgcaagagatcagagcccctgaaagctagaagaggagatagaggataacccacacgcca

SEQ ID NO: 55543 - DNA, 165 bp, Oryza sativa
ccggtccaagaaccagcctccccctcctcctccccccacccctcacctctccttctcctctctcacccccaaattagcctcccacacttcacccacaccctattcctggacctccacctccccccacccctcaatgccaatccctccccctcacacctacgcagc

SEQ ID NO: 55544 - DNA, 1501 bp, Oryza sativa
tcctgggcttttataggcccatcaggccttatttccgtcaggcctagcggctgtttcagttgggaatttaagtctattatgactccctaattttttccccttatttaaacaccgacctcaactgcaaaaagtataatgcctcttccttctttaaaaacagatacaaatcagctcctgttgaaagcggtttcaactgacgtgatggttttaccacataaaacccacatgtcaacaactttctcttcatctcatcttcttcctcacctctcacctctcccctctctgtgcgtcaacccgaggcacaacgcgaaaacccgcgggttatcacttatttgacatataagtgggttcgcgggttggttcgcttgcatccctagatagtagaacaggtcgtccaccggatccacgtactattgttgctgccctagacaatgtcacatccacgccacagccacagcacaccgcttggcgtgctcgccgcctccgcgccttgcagaacctccataccacctggtctgcaatggcggtctggttcaggaacccaacgtaggacctgtggttggtcaccgctaggagggagaagtagttgtacccgttggctgccggatgctgcggctccgtcctaatggccgcgacggccttttgaggcatgcgcagcggcgctggtccaacatgttgcatagccggatcaaggtgtagcctccccttccttctcggtgaactaatggagccactaaaagggagggaggctgaaagagaaaggggagaggtgaggaagaagacgagatgaagaggaactcactgacacgtcgatcccacatgctgactcatcgagtcgaccatgattaaattgccaccgttttcaacaccatcacgtgagttgatttgccctgattttcgaagatgggggaggctttatatctggttttgtggctgagtaaggcgattaaatcaggagcaagagtgagggaaaataatagacttattccttccaagttgctgtcaggccgaggccgcaggcccgcgaggcttcaactgctccattctaattgggccggagtgtgacagctagtttcggcccgatatttacgggcctccgttaaaacctaattgggtcgctcaggagacagtataccttcaacttttatttaccgtcttctctttctactcccaattaaggcattataagtaatgaccttgcacccaaaaaaaattatggttaacctgtcagtgataagctttcaagcaatcttctcaatctcgttctcactgaatttacttcgactcctttgctgcaaaaataaccgcagatcagatcatcagaacccggtgtttttttacatcgggtattttctgattcagtttcacacttgttactgcgtgccaacggctaatgggctctcgtggagaccgtgccatgtgccggtagcattcgtttttttttttcttttgttctttcaaaaatgagccgctccaacggctagttcgcgagcagtcgatc

SEQ ID NO: 55545 - DNA, 1501 bp, Oryza sativa
caatttttcctaattaattccacacctataataatttgaaactaaccttctcaattctcttcaactctatttttataggattaaacgattaaggcttactactacacaggaaaaaacaatagcctcgtgtagtggaaaaaaaagtgtaataaaaggtcgttgccggtggaagtagaaactagaaaagggataagcgcgtgtgacaaaggcggccgctggccagcacgcacgcagcaaacgaacacggataaataaaccggagtcgcgcgcagaaaaaaccgaccacggaccaaacccggtcgagccgcgcctttttctagaacagcggcgatgtatgagatgactcggcgccgcgcccgcctcctcctcctcctccccgtgtgggaccaccgaccgccccctccgccggtagggcccacatgcccgtctccgctccccagcgcgggacccaccctcttgtggggcccacatgcccgcctctgcgtcggacccacccctgcgcgctttccctcgggcgcccgtcgctttccttttttatttttatttttttgactcctgcgagatgcggaggagatcggacggcgcggtttgaaaagggccgcgtcggtgcggatcctgggccgtccgatcgggccacgatcccgagccgcggctactgttcacgggggtggacgacagcgcagtcacagccacgtcacaggagttacggcttcgttcgtttcggcctcttttgcagtaacaccctccaagaagaagttaatttccctgttgtaccaatccatacctggttctgtctacgaaggaccgatttgtacagtgcaggagtagagaggtgctttgtgcaaaaaaattcgtcgatctgaaaagcaggctactgtttctcccgtggtaaagaaagggaaaacaaaacagagcatcgccatctctctcccctcccctgaaagagctaaaaatacaaaaacatttggcgtactcaacacaacgatcaaaccaaacaaacgcaaattacgtgaaaaaaaaggaacgaaatttgcgaggagaaaaaaaattcaacgcgaggaccacagtccaaagccgctccaaacattccacacacacagcaagattagaaaaaaaaagaaaataaaaaaagccataaagaatagcagtacgatttgttccccttttgcccttccaccccgggggtttaaaccgcgggaaccgcgtaatttgccccccctaattaactccgacataaaaaccttaccaaaccaaggggggtttagggggaaaaaacacgcacggaaagacaagaaaaatattaaaaaattcgcttcctcttcttcctcctcctcctgccgatctctctcctcctcttgacgtgttgagctgagctgttcccacttcccactccgtcctcttcttcttcttcttcttcttcttcttcctctcgctctcgcttcttcttgagcttaaatggcagtgggatcagctgcgtaggtgtgagggggagggattggca

SEQ ID NO: 55546 - DNA, 410 bp, Oryza sativa
aggatcacttagtatccttggccttgagactgtcaaaaagaagggagatgcaactcgtgcaaggcttaaagacaaaaaacacctgaggacactttcactaacatgggggagtgcaagcggaagtactactaccgtccagaaagaagtgatggagggtcttaaaccacatgaaaatctttcccatcttcttgtctacaattattctggtgctactccatcatggttattaggagatagtttctcacttggcaatttagaaagcctccatctccaggattgtgcagcagtgaagatccttccaccatttgaggagatgccattcctgaagaagctgtccttggtttgtatgccctgtctgaaaagtatcaggattgacttcaactctgccgatgaggaggatgaacttgagt

SEQ ID NO: 55547 - DNA, 1501 bp, Oryza sativa
ctacgtttaatactcctaaatagcaagattctggagggctatttaatagccctccggatccaaacagggccatgtttagatttaaactttttttcttcaaatttccaacttttctgtcacatcgaactttcctgcatacacaaacttccaacttttccgtcacatcgttccaatttacttaaacttttaattttagcgtggaactaaacaaagcgctagtgtgtatttctagctatacacaacataaattgaggatgccatttaaaggttggttaactttatagacttgcaaatgaatctctttactctcgtcgtactactccactcatcgtctaaaaatataattttgggttggttaaagagagttgagaccggctttatcccattttattataaaaaatcaaactcggatcatttcaaaaacagaagctgagatttggtgttgtaagagtacatatcattggacaatatcgccaatatcaaaccctgggttttcacttaccggttttaagggtccctttaaattatagggattaaaaaaataaagaaacaagaaaaaacacatgattttgaagccgtaacaaaaaattgcaaaacatagaaaaaaaaacatagaaatgactgtttgatttcttaggaaaaacacctgaatcgaatgagagagataactcaaagaaattttccaagagctttgagctcttgctaattttcctttcaaaatctctatatgattgtccattctatagtaattttaaaggattggataggatttaatcctttgattcaaagccatccataagaacttttcttacaagattaaaattctccaaaattcctatattttttcctccaaatcaaaagacccttaatagaggttagctactatagttgatatcacgaaggttttctcctgccaatttagtataagagttagttaccgattcttatcacggttatcacgataaccacgcgggttactcgaagaaaatcataataagactactaagaaaaatcaagatatattacccacgagattaccaccgcaatatgggcaatatggaaaatattttctacctctacgaacacagatccccatgcaaaacatagaggtaaagaagacagaatgttgtagtagtactactctttcccctttcttttttgaaaaaaaaaagagaacgggtcaagctcaagaccaatatcagcaacttattccttttgcacactttcaaagcccccactccactctcctctccttcttccccttaataacaacaccggccattcctcctcctcgcctcatccgccaccacggtttgcttcgccacacgcgcacagaaacacacacacacagaaaccgaacgcgcgtcgatagaaatggaggatgtggcggcatcattgcgccatgtactcgccaatgattgatcgcctcattccctcctcctcctcctcctcctcctgaatccctcctcatcgataaccgaagcaatggccagtggcaaca

SEQ ID NO: 55548 - DNA, 1501 bp, Oryza sativa
gtggcaaaactttttttattttagaattggcacagtgaacatcagagaatgagagtggagctaggtgaagtgctctcacaaaaataaattagagatgtggagttgggtatgagttagagatgtgaactgccatggtgttcgactaattgcgtgaccgaagcagaggggatgtgcggaccgctcacgccgaagcgagtgggggcattgcagatttccaaaagtaaatttcataaagctacagttaatttaaccagactattgtaaaactataaatttaaattggtatatcacaagctacatatttaatacataatttatcacgaaactatagatttaagataaagtggtataaaactacatatttagtaacaaaattatcataaaactatagcatttatatattaaaaataacattaatgctaggagtttaaactctaatataatgtagttttgtgataatatcaatattaaatctatagttttataatacttgatattaaatctatcgtcttatgaaaaaaaaaagatgctaaatttgcaattttatgatagtttggtcaaagtacatatagttttgtgaaagggattatctaaaaaaatgtcgcaagttttttctttataaaacttttaaaatataactatattgtaactacactgtaactcatatgtaacttatatgtgactagaatacaactatcataaaaaaaaaattggcgtggtggtagcacacttcctcaatgaactaagggcgtaaggtaaaaccgtcgacagtaatatagcaaaattccgtttgtgaaatttagttttcccaatcccttctttctataaagtggccaaaagctcaaacctcgtgcttccacatcatcatcaaattgtgaatcgtttgatgaatacattagatcacttcttagacgttggatggaatgcagcatagagcccaacccattagtcaccgggtgagtctcttcgcctcatcagtgccaaatatagctcacatgaacacattggctcatttctatacacatctacatgtatccagcctgtcaatccgtataaaagagctttatggctgaacgccccttcagttgacatgtgctacttaaatatctacaaattttggatagggctgctaaaaagaatttctccaaaaaaaactatttgttttttcatgagatggtaactcctatctaataaattgatgttaactaagtccgcagcaatgcgcggagcatcctctagtatataagaatatactaagcgggccaggagtgtacaagaatactcctgggccaattcttgggccgacattctcaccaaagtggaccgtttggattatttggcccggccgctctccgacaattctttccccaattattccattctctctcctccatcttccggttgcctcgctatcctctccacctctcccaccaccacccaagcagccaaggcggaggaggggagccggccggcgacgcgcgcgccaccatcccagcgacga

SEQ ID NO: 55549 - DNA, 354 bp, Oryza sativa
cgccaccgacgacgacgacgagttcgacgcctccgacagcgtcgacgacgccgacgagtgcgccgccgccgacgagccaccgggcggcgccgccgcctttaccatctccaggtccagccggaggccggtggggatgcacgacgacgccatcggcgcgccaccaagatcgcaaccttttcccccctccaaacaaacaacaagaaaagaaaaaagaaaatcgctacttgggcggatcaaatcagaaaacacaccactccaacatcacgagaaaaagcaagaaaaagcacaagaaatcaaagagattctaaacccccaaaaccccccacaaatatcccacaaaaccagcggaagaga

SEQ ID NO: 55550 - DNA, 538 bp, Oryza sativa
accaaatgttgttatgagatatccgattggtctggataaatatatctgttaatgcaaacacgaaataaaattaaggctttacagcattttttcccgtatccattctgtgcaactttgtcttcaaatagcatgtcagatatatcatttaatccgtttattacttaaagtgaaaatttgaacatcaacaggtaaataatgtgatcttgacaaaaaaaagtgtgttcggtgcttttgttggatacacaacacgcgctcatggcatcgggaatatgctccaaggatgttaacatgatgaaattctaaaatgttagaggtttttttatactctttaactgattctcgaaatattaattcacatattgatatgtcctgtaccattagccttttctctcaagtacttaggtttatacacttcaataaagacgcatgctcatcgagcagcatccatctcactagaatataaaatgttgatatctaattgtatatcatttgtgcgcatgttacaactggacctttttttgcattaccatgatagaat

SEQ ID NO: 55551 - DNA, 1501 bp, Oryza sativa
catttaggactgaatgatcttccctatttttagatacttccccccttctctgaaatacaaggagaagtcactgaccaactgaaatgtctactgaatctgaattcttcacaagtcactcactgcttcactgcattcagtttactcttccctgtcagcttctgaagacctgcaagccagcaaagactgaattttttgagtgaaagactgaaatctcactcgtcaggtcaagggtctctctcaaattagcactaattcaaaccaacggaatcttgaactcataactaaatcacggattccgagatatcgttgttcgttgggcggcggcgcgaggatcatgagcatgtgatggcactgtctgttgggagttagataatgccaagctgacagtatctgaggcactgtgcaaggttagttgccatgcagatgcagccctaactaccttgtgatcatggcattcagtcaagtcaaaacacacacacaaagatgattgctcaacacctataaatggaggagcacacctcacctgttcttcacttcttccatagctgcattggcaatttggcatttgctgacaagtgtacaagaccacacagcttttctactacattttcttgggtttcttgaatggcgaacgcgagtgttcctaagccggcgaagcgcctgtcgcgcaagaggagcttcaggctcggcctgccgctgctctgcgggcagtccgacgtggcgagcccacgcggcggcggcggcgccgccgccgccgcccgttcgtcgtcgtcggggagaaggcagggcgagctgcacaggatcttccagcacttcgacagggacaacgacggcaagatctccggcgccgagctgagcgcgttcttcgcgtccatgggcgacgagatgccggcgccgtcgccgggcggcggcggcgccgccgccggctacatgctcgacttcgccggattcgttgccctgatggagagaggtgacagccaagaagaggacctgaggagcgccttcgaggtgttcaacgccgtcgagtccgccggccggatcacggcgaggggcctgcagagggtgctcgcgcagctcggtgacgagcggtcggtcgccgactgcgaggccatgatcagggcctacgacgtcgacggcgacggcggcctcgacttccatgagttccagaggatgatgagctaagtccatggaatgcctcagcttgaagctgctacagcgagtgagtgactcagcgaggtgtttttcagtttcagagtcctgagaaaattatactgctactataggttgttgataagtctgctgcatccagatgacacattgcagattgtttacagggcagaagagttcttcagagctcttttgcttgcctggagcaaatttgttgttgtcatcttgagttgtttggtgtgccacacacttaatccagtgtatcagtaaagttacagttgatttccttctttcaaaagaaaagaaacagttacagttgatttcttggcttcac

SEQ ID NO: 55552 - DNA, 543 bp, Oryza sativa
atctctcttcagatctcaatatccactgaaaagaaatatgcaaatctgggcatttgatgaaaacatgatcaccgaaaatcatttaggactgaatgatcttccctatttttagatacttccccccttctctgaaatacaaggagaagtcactgaccaactgaaatgtctactgaatctgaattcttcacaagtcactcactgcttcactgcattcagtttactcttccctgtcagcttctgaagacctgcaagccagcaaagactgaattttttgagtgaaagactgaaatctcactcgtcaggtcaagggtctctctcaaattagcactaattcaaaccaacggaatcttgaactcataactaaatcacggattccgagatatcgttgttcgttgggcggcggcgcgaggatcatgagcatgtgatggcactgtctgttgggagttagataatgccaagctgacagtatctgaggcactgtgcaaggttagttgccatgcagatgcagccctaactaccttgtgatcatggcattcagtcaag

SEQ ID NO: 55553 - DNA, 213 bp, Oryza sativa
cccccccccccccccaccccaattaggcccattggacttgtttttgtgtaaatgggagtgggaccatgaccttgaaaccctaatccctatttccccaattctccaatccgagcacctagtcaaatcggtgaaattcaacggcgtcacggcgctgaggggagcgggcgcgccggcgtgcggcggcgcggcgggcttgctcgcggtcgcggaggg

SEQ ID NO: 55554 - DNA, 879 bp, Oryza sativa
gttggctatactattaaacttagctcttagcccttaggtgtcgtaaatctgaaattgtactatgattttttattaaaaaaaaggagcaaaaacgacttatagatattttgcttcctttttaatcggattctggaatcattgacaagcatacatttttctctggaccgcatcatagatgccacccagaccacccggtgtggaacagatcaagtcttttttttttcttttcttttacatcgtgagcacacacagccggggaactattctaatctctcgaggggatattccctcgtttgcttaaaaatcatctaaacggttatgaaaaattctaaaaaaatttgacaacattcatacaacacatatatacaactccataaaattttaagtcgaaactcaatttacacgttgagatataaaaaagacaaattcaacgtatgaatagtagcgtattgtttatatctaaatttgtccttttttttctcgatgtgtagattgaatttgaacatgaattttggtggactagtaggtatcattatactctccattgacatttttttcagatttttttcacaactatttgcatcgaatttggaagggaaaaaaaatataagaggataccctcgagggattagaatccactccccacgcagtcttgtctggtttgatagtggaggaaaccgatggagatggagtagaaactcagggaagaggcaacatgccctggccgtggccgcggccggcggcgacgcgagaggtaacataacatggccgtgggcattattccactcttatatctagtgaaataacccaacgttcccagcctagaagatgaaggacattgtggtatccaagtccgggccaccggtgctcgtcaccccg

SEQ ID NO: 55555 - DNA, 1501 bp, Oryza sativa
ggtgccgcctcctccctccccccgtggacgcaaccacaaggtcgaggaggccatcatggtagaggagggcagcacaggaggcatggtggagggcggcaatgttgtcgtccccttgctccgtcgtctttgtaaacgccggcgccgtccttgcccccggccgggaggaggaggccgcatggattggccggggatggggatggcggattggccgggaggaggattgggcagagagatgttgcgtgttggggatgggttggcagcagagaaagaggagggattggattaggatctgtttttttagaatgccctcgtactttttgggattacagcgctgtccctaaaatccgaattttctcttcttcacattgtatttcatataaaggtaaggcttttttagtaaaaattagaataaggatgaatctccaggaggactgcttcgttgtttcctagaggattgagagtttttttgaaaaaacgcatagagcatacgtgccctgcatgcacggcataaacatccaacacccggttgatggtaccggacacaaggcaaagcttagtaatctttgaacagtacactaaccgaaaactgcttattagcagtcaagctaatctgcatgaggagcccaaaacagtaaaagacaacgtctaaattaaacaaggagcctaaaaataattcaaaaaaaaggagaaaaacggtggggttaggggagttattgattgatgatttcaaatgatttaaatcgtatggaaaatttccttgctaggttatttggaatataggattgaacataggaaaattcatttggattgcaatcctatactccaattccatagggaattttgaataggagctccaaacttttttttcttcgagaagtccaatgctctgtctctcttctctctctaaaacctataaaaatcctatgttattgtccttatcagctatccaaacactttgtaaatttctgtcttttctatgtctgccggatttatttgacatctcacttctacaaattttcctatttacgtatttctaaaatccaccccctatgtttcaaatgagccattgggcagccgacgtttggctcatatttagatgttgccgttgactaatgatgaagccgaactagtgtactttgactaatgataggtgcattccagaatgaagtccactgctccactgtgctacataaatttagctacagtttggccgttaattttctacaatttggcacttaattggattaggcgtactcaattggcaagctgcagtcctgctttcaattcagacgtggccataccaagctggtggcgctgttttttgtttaacgaactggtgtatgcttacgtgggggatttggatagatgagtgcgtaacgtgacaggtgaattattaaaccatacgctaaaagggaaaaaaaaactaagttaagctaacttttgcgtgacatatagcaattccgaaaatactattcagtttcttgcatttgcccctgttttg

SEQ ID NO: 55556 - DNA, 1444 bp, Oryza sativa
ccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgatgacaacgacgatgtccggcgcctcttcctccacgaactcctcaaccgatcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcagcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacggccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaaaaagtccatataaggtccctccggggccgaaaatgaataaaagagaacagtagcaatttttccattttattttgtcaatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 55557 - DNA, 415 bp, Oryza sativa
ctagatacgtgttcctcgacttgcaaaaccaaagcaccttagggtccttaggtcctaaaacagtattgtgttcggttttcgctgacatgaagaatctattatattattaaagaaatagaaaaaagagcctccacgttcgctctcatggcctagaaattctcacattaatcggagaaaaagaaaaggcagagtgcatatagaaatacaatttagaaatagttgaaattcgtaattaaaaaataaggaatattagaagaggagactagagtccatatagaaatacaatttagaaatagttgaaattcggaattaaaaaaaaggaatactagaagtagagtatatagtccatatagaaatacaattagaaaataactgaaatttgaaattaaaaataagggatattagaagtagagta

SEQ ID NO: 55558 - DNA, 1501 bp, Oryza sativa
tgaattttcctatgttcaatcctatattccaaataacctagcaaggaaattttccatacgatttaaatcatttgaaatcatcaatcaataactcccctaaccccaccgtttttctccttttttttgaattatttttaggctccttgtttaatttagacgttgtcttttactgttttgggctcctcatgcagattagcttgactgctaataagcagttttcggttagtgtactgttcaaagattactaagctttgccttgtgtccggtaccatcaaccgggtgttggatgtttatgccgtgcatgcagggcacgtatgctctatgcgttttttcaaaaaaactctcaatcctctaggaaacaacgaagcagtcctcctggagattcatccttattctaatttttactaaaaaagccttacctttatatgaaatacaatgtgaagaagagaaaattcggattttagggacagcgctgtaatcccaaaaagtacgagggcattctaaaaaaacagatcctaatccaatccctcctctttctctgctgccaacccatccccaacacgcaacatctctctgcccaatcctcctcccggccaatccgccatccccatccccggccaatccatgcggcctcctcctcccggccgggggcaaggacggcgccggcgtttacaaagacgacggagcaaggggacgacaacattgccgccctccaccatgcctcctgtgctgccctcctctaccatgatggcctcctcgaccttgtggttgcgtccacggggggagggaggaggcggcacccgcccgagctgccgccggtgctcccctcctccttctccatccacttgtggtgacggcggcggcgggtggagggacgcccgctgaatccgccaccggttctccttccctccttgttctccctccacttaggccggcggcggcggtggtggcggggggagggcagatccggcgcccgacgccggcggatccgccgtcgtgccccctcccttcccttgtggcggcagtggcgagggtacctacgttggcggcagagccggctgcgcgtctgccgccgatgcccttccctcatggcggcgtcggaccggccgcctgcgcaggactgccgtacgtcttcccccgtcgccgcgttgcctctccgtcctctcctccgcagcttcccaaccgttcccctctcaactctcgacctctcctctctacgtggaacaccatgaccgtcgccgccgaggtcgacgcatcccctgacggagaggagaggaggaagcaagcttgcaatcgcacaaccatctatcgatttctcccttccttctctttcttctttctttctttcgtttccccctctcacatgtcaggttattttttctcctcatcctctccggatgatttcacttttgctcgaaatctctcaggttgttgttgtgttgaaggtggcgaagggggaaactttggtggtggtggtggccggagtggaggatggcggcag

SEQ ID NO: 55559 - DNA, 257 bp, Oryza sativa
tacatgataaacatggtgcagatgacatcgttgggcaagtcttcttgaagacttgaacctcatattgcggccattccaattactaaagtgtaaaactggatatgtcagattttgcagagaaaacaagaaaaggcatttgtatgactttggtaagacaaacacacaaacactgaaaattgtataaaacggcctccgccaaccacaaatccacaatggataatgaaaagttactttcctcctctttctgacctttcagt

SEQ ID NO: 55560 - DNA, 1501 bp, Oryza sativa
tggacacgaatgaaaaaattaatttcataactcgtctgaaaaccgcgagacgaatttttgagcctaattaagccgtcattagcatatatgggttactatagcacttataactaatcatgaactaattagactcaaaaattcgtctcgtgatttccatgtaaactgtgcaattagttttaatttttatctataatatattatatactacaagaaacaagctagacgtcttgtcatggttaattagctaggtaggtagttccagaaaaggtttcttgccaaagtgcagccttctcataaaaacatctccccagaaaacaaaatgagacatttgagctaccggaaggacattttgacttatctacattttgtattggttaaatcaagacctgaaatgccattgtccatgtcactacttcaattgataacatgcacgtatggcaatatgatgtttttcatgctcaatgcatgattgatcatcctaaaggtcctaaaggtaaataggtgattaaggatggattatttgcagtttaatctgcgatgacggagtacacgtacgacgttgagttttaggtttgctgagtacgatccaaatcgaatctttgtactgcatcagctgcttgctttgcctaattgattcttaattccgacactccatctaacaatcctgtactgctagttaatttcataatgtacttcctatatcgaccggccttatatatcttgctcgtcctttccgtagtaaggatatttactactagtcacttataagcaagcgattatagtcgatgccattaaggcgttaactgctaccacgataacagataggttcgatgatgcgtccatcttaaggttggagctgctgtgtcaattagacggcaagttcaacaatgatgacacgtatatatcctctgggaagtctgttttttaagtacgccacacccctacatatcctcgccagttaaaaaaaagagcaaaataacattaattatatcctttagtaaaaaaatagaaaaaatagcgtaaataatactttatatttaagtttaggtttccgttgttacgcacgagcatccaactagctagtatactaagcaactgagtatcatcatgagtaatattctaatcttcttcatgtgtgttgggcctggtctctctacggctacgtatacggcatgcagaattgttggggttaattagcgcgctcctacatgtacgtgttattctagctgatagcagagctactagtaactaggaagaaataaagcagacgaaagataggtgaactcaccgtgctagcttttctaatgtttcccccctgtcattcgtttagcttaaatcaagttgctcttacactagctagctgatcgagccgtgtaaactatatatttatcttggattttggttggtgatatgctatagctcctgcctcgttctccataaaagaattaaactggccaatgatcaaatatggtgtgtgcacttgtgcgtgatggttattgat

SEQ ID NO: 55561 - DNA, 1501 bp, Oryza sativa
ctccacgaattcataccctccacgcaacggaaaccacaccacaccccgatacgactaggatttcctctctgcttcttcgatccccttgttattacaatcgatcctgcaagagaagcactctataattgcagcggcaagatcgattttttacaaaccaacaaagcagaaaggattcacgcgccgccgcttgcgatttgtgagttgtctttcccctttcgattccccctcctctcttccttcccctatcgtcaactagctcgagttgcttgcttgttccctctgctgcttcctctcttgtgtggattggattcccggcctggccctttctttttcctcttctctcctagattagaatcgtcgcgatttgattcctcaatctctcgatttggccgccctatctgttattaatccccaattgttcttcacacacatactcaattgcaggtcaattgcagccagaaagaggcgatggatttcaaagtcgcttcctttctcctactcctgttaatcgtcacctgcggagctgctcaaggtcaaggcaatgattttggtacgccctaatccaacaccttcccttcctcccttacctatgctcctcctggctcctgcatgcagtttggaaccaacatgtcaaacattctcaagggaaaattggacaagttttttattgtgcgtagtaaagtatcattctaaaatttatatatatgggcagctgctgtgggtattttatttggttgaaattcaacttgaggataacctgctactgatcctcttagcttggttattcattgcctgcaaaatgcatccattatttttgttcaagctttgccatgcactcgttacaaagtcccatgttcatctcacaatggtacacaatgataaacattgtggtcacaataaattattgatagagaaaaaggaaaaagaggatagcctaatctaattgttggcatctctgatttctctcgtatgttaaacctaggctagttattatttatttatgctagttatggtatgttttaacagtgttacttttttaaaaatttctgcaacaccaattattggttatgggtacatacttctcataaaaaggattatggatacatacaacaaggctagagatgcaatatcacataatgtgacaggaattaactggttccagcttcacagaaatgagaatgtgcttcccaattattggcaatggtttacttttacttcttaatatgtaatagaaattattattttttgctgacgaccttcatgatattttattcaggcaaaattagttatgtagcaccgaaatttcacgatcttattttcattctatttatttgtttgcaccgaaattaccttttgtttattattcattccttctcagttgtccttgatctaaaaacaactgaggtcggggaagatgctagcccaatgtacaaggagcaaattgcgttgaccaagatacctgtaactcttctgaggagcaagcacagctcactgtgctcgg

SEQ ID NO: 55562 - DNA, 165 bp, Oryza sativa
aaatctgaactgttgtcacatttaaacttgttttcaaatattgttccctccattcattttgacgagctaaccgttctaacatattgagcagaggattgggatatagtttcatgagtttctcttagtgtatttctgttatcttatatgattatgcatcttttcagg

SEQ ID NO: 55563 - DNA, 249 bp, Oryza sativa
attcctgcagcccagtcccgttcggattacgcgagatttcttcgtgcggaccacaaactcaaccaactccgtgtaggccccacaattccccatcgccattatccgccggtcgctcgccggagtccccacgaaaaacacgcgaagggaaaaaaaaagggccaaaaaaaaaagaaaaaaaaacagagagagggagaccggcacggtacgcgcaccgcaccacacgaaccaatccgaaaccctagctccggc

SEQ ID NO: 55564 - DNA, 579 bp, Oryza sativa
ttgttgtatgaaacacttgaatatttctttgttctttcttttaaagaatgtattcttatatatttctatatttaatatggaactatggattgatgatgatatcatattaaaataagggattatgtctagtggttcttggtaacgctccactggcattccgaagtagtattattagctagaaagaatgatgacgctgtagaaattaaatgtactgccaatctggaacctgtttcaacagtccttgtctggctctcattctttgggatgtttcgcggtcagcatgaggatgtgggactgtatattactcaatggttgagagtgcagttcaattgactgtctgtccaaactaaataactgataagaaccacgcctgaatccatggatggatgagtgttgtttatgtgaaatttgttaactggttgtttcaccatagaaaaatcaatattgtttttaggatatatatatatatatatttacactgtagatgtctgacacatttgtttagaaaatgtgttcagttcataatgttgattggtttgcctgcatctcttttgactttttttgtgaatgacagaatga

SEQ ID NO: 55565 - DNA, 171 bp, Oryza sativa
cccgtgagtaacaaaggcattattaattgctgcagcagtctatctgttacgattacgacatgtgccattaattgttttcaccctgactatcgtcttacaaataccgtttgcatttttgttatgcttttatgcaggttagtccaaatgtgcagtcacagcctactggactta

SEQ ID NO: 55566 - DNA, 498 bp, Oryza sativa
catctgctcatatacttactatgttccttgctagaatgcttgttgagttctttgaccagatgaatgtttgtagagttatccctagtaatttaaatcatgcaggtgatgtctaggtttaaatgattttcatcagatgtagaggtcacagccttccacatgccatttttcattgatatacccgtgtatcaacacattaagcaatactcttagtctccaagtcatgatatttctggcatatctcttcttctcagttttttttaacataaagctttgtccatatatatattgtatagcatcaaatagatgaatcttttgtgcacttctcttcagaatgtcgatgccagacaaaattctccttttgtattgatgctcatagcatagctatgatattttgagaattgagaacctattagtccagtttgatctaagaattatgttttgttgtttttcatattggcatttctgtgtggatgcagctttttaaagggctggacttgg

SEQ ID NO: 55567 - DNA, 565 bp, Oryza sativa
atagggatgaaacccatatatatatatatatatatatatatatatatatatgaaaataagcttgataggttacatctgtggaatcaaggttctatacttctattcttatgtagatatagtaaaatacactactgaaattaatgcattcggcaaaacttgcaaccacaatgtaatttacaaaggagttaagcttgtcgtgataattttgttctacctaattggaagttttgccacctctttgtaatttacaaacgagttaagcttgtcgtgataattttgttctacctaactggaaattcccttagatatcttctgggtggtgtttactttacatctcacacctttactcctaagcacattggagttatgatctagttttgtcattatttgagttttatttgtttatataattatttttagtatgtttttaatcaaacaacttattgatgcatttgataggttgatgttaagagagccgagcgtagacatgatcataagcaaaccagtccatctattaagaaccaaaacgacagcgtgcagaaaaatcaatttatttttcaaaaga

SEQ ID NO: 55568 - DNA, 167 bp, Oryza sativa
tgaacaactaagaataatgcacaaaatcacctcaatgaatgtgagcccttgtgctagtgaaattcacttccttctatcttgccgttattgttaatcaatatctattattcccctttgcttttgctctccttccggattgtgattttcctgagtttgtgattgacagg

SEQ ID NO: 55569 - DNA, 1082 bp, Oryza sativa
aacgagccgttggaatgagtaatcaatcaaatcaatcggtgcaacgcaattgtactactggagttccgtcgttttgcttattcggaaaataaaccaaacggtatatttttaaatgaaaaataatttatgaataaattttcatatattcgggatataaaccaaatgacatattttcaaacaaaaacaatttatgaataaagttttgatatacatgttcttaacaatctaaaaacaaagactagaaaataaacttcgatgaaaaaaaacctcaaaatcaactttaaatttaaagttaaaaattcaaattttagttgataaagataagcataaaaaaaaagatggagccatccagtgtttacatatataagttcgtatataaccactcaatcgacttgtctctattattataaaaattgaagatgtttttatcgatattttggtacgtcatccgtgtatgagtcggttattaagtttgttcggttttgaaaatacataaatgtatttcaatcggttttaaattcgttcgcttttggaaatacaggaggagttgtataagaaatatttttttaaaaaaaacttacatattaacttgagatgatcggaatcacaattgcagatcatgattttattctcaaagtgaatttcaccttaactaaaccatacaacaataataaaattaaaatagctttcacccgttgtaacgcacgggtatttttttaagtaacaatataaaaccgggaggataaggaaaaggggacaaatacacgtaaacaaattgacatgagtcgacgcctccgacgtggtggagagttgagcggccggcagttgaatgtttgaacggagacgcacggcagccgggccgcatgggccatatgaataggccgttttgaacgtaggcccaggaagactttcacgtgtccggcccgaaaaacaggcacacccggacgaggaaagcgtattttcgtaatttacgctactgtcaaaggaaaacgtattaaggttttctgttaccagctcaagggaggaaaggattagtagatagggaaggaagagcagagagagcaaagctcccgccgttcatc

SEQ ID NO: 55570 - DNA, 384 bp, Oryza sativa
gcattgattaaattaaacagatttgctaaatggcattaggcggaaaacctatgcaaaatactatgaattcttgtccttgggatctactccacaattcatgtgctatgacctcgttctccaactccatcaagctcagacaatttagtgtccaggtgtggggtaggggtaagagtgggttaggaggggtggcgagggtggggggggatcccttgcaattagacggagaccggggtgacatcagcctagcggtgggcggtggagactcgacgatgaaggagggaggaggggaggtggaggcgatgagacgttgaagacgaaggaatagaggagggcaatgtgggcaacgggggcatctcaagcggttgtttccaaagtagcggtcaa

SEQ ID NO: 55571 - DNA, 1501 bp, Oryza sativa
agtctgccgaattcctaaagaggagaaatcaaagatgcatccctgccctcccgaccaaactctactcatgtgtgggcgatgcctcactggtgacgaagcagtacatataaacagtattttgtcctccatggacaatttattggcaaaatttcatggccaagcaggcaagcactgtgtgtcgtcttggtctcttagagaccataattcagtctgagttccggacaaaaaatattcaggtcgaaattgattgctgttactattgctagattgcaacgcggcttagttttgcctttcctttttctccatctttgaataatcaattattcatatttgaacgtacgcgccatttttttcttatcttagatcaaagttgaattactctgatcagagttcagctcgtacaatgtactttcacttcaagtttataaagcatcttcagattagtttttattaaattcaccattaaatatattaaattttctagtatatttgtttagtgttaaaaatattactgcattttgtcaacttgatcaaactctaaaaaaaaacttagagtaaacctaaaataacttatggggctcgcgatgaggacatcactccttgatactaggtgaaaccccgcgcattgctgcgggaatttagtatgaagatatacatcgaaacattatgtgaattatgttggatgataatttaacatgtttgtatttgaaaagctcttaaattataaaaactataaagatatagcatgtttgcatgatgtttaaatgtgatgattgttagtggatgatgatgtgacatcttgttaattagtgaatgatgatgtggcatcttgttagtggatgatgatgtggcatctttgcatattaagcttaaggagttagtggggtataactttatagtaagataggatacgcgtgaggggaagtgagaagcacttagagagaggcttgagacagaggtataattcatatcaagttcgaggacacctcggaatccaagagtagcacacactaaaattgacacctagaactcattcggactcggttttttacgttctatatatgtatgaaaaggtaacgagatcgcctttccaatgggtctggtctcatatcaaaactcctattgagtatcaggaatcatcaaaacaaaagagcgtccataatcttttcagatgatgtgttagcatctttaggcccgtgtaccatattggagtttgttcgggggtcctaggttgatcctagaacttaatcatttagtagttgtcattggattagggttgagttttatttagattattccgtcgttgcagtttcaccacttagttcagtttgtgcaaccccaacttgtgagcttcattgtatatttgcaatatattcagattgcttcttatactctcttgtttgtgttcttgattcgcttgctggagatagacttctccacgaggttaaccgcgttttggcacggttgataaccaacggagcaattgtgtagtgaatgataa

SEQ ID NO: 55572 - DNA, 518 bp, Oryza sativa
gaccgttcgttttatttaaaaaaatttaagtaattattaattatttttctataatttgatttattgttaaatatacttttatgtatacatatagttttacatatttcacaaaagtttttctgaataagacgaacggtcagacatgttttaaaaagtcaacggcgtcaaacatttagggaaggagggagtagtaaacatttacgtagctctgttaataatacctcaaaggctgtttgtacaggtgatgtgtctgaaaatagctctgactagaaaaattgtcgcatggtacccatttatttgaaagaaaaatatataattttttattctgtataggaacaataaatttttatataggaaatttttctatatgatttttgaactaaaggattattgaaaactattaaatcctatcaaatttctaaggaatacccaaattttacataagttttggagcatttttaacatgtaagtctctcatgaccttatctctctcatcctatgtaatcaacttcatgtaa

SEQ ID NO: 55573 - DNA, 1501 bp, Oryza sativa
tctctctcgcatgcagtcgcagaccatgtcgatcgcagcgcatctcgctgccaccgctgggcacgctccagtcgctcgaccatgcatgcatcgactccccgctgcaagctgctgctgcggcattatactggaccagtatcgccgattttgtgccggctgctgaaaagcgaaaaggtgatcgatacatcgcccgcgctcgtcaggctctcgcttatagccaatctaatagctcattcatacaatagttatatactacactattaatatatggtcccacctgtcatacgcacactgtgtcttagagtccgtgctatagctggctacaaatctatagtccgttgctcttctctctccttatttatctccttaaaatatgtttatagctggcttaaagcctgctattgtacctgcccttagctggctggctggcgcgattagagcaagtctaatagtatagccaactactggctccaattcatctatagctaatctaatagctcattcatacaatagctacatactacaatattaatacatggtcccacctgtcatacacactctgtgtcacctagtctcacctgtcatacacactatgcgtcttggagtccgtgctttagctggctacaaatctgtagcctactgctctcctctcttcctatttatttttttaaaatatgtttgtagctagcttatagcctgctattgtacttgctcttaccatgcagccaccaacacaccaatgctgcgaccaagcatcatgtgagtaatttgtgcagttttgcctgcgttggccgctcgaatcagcggcaatcagggagcgtctgcgactgcgacgacgacgcaagacgcatgcagcatcatgtgagtaatttgtgcgcagtacgctgtctgctctcattgctattgccgtggtacggaattgtccacacgttgttgcatcctcttgtttttttgcttgcaatcttgcatggacatgcaccgctcctacctcctacgaagcagcagcacaactctaatccagttactacagtggtatcaagattttagaacaagcaactgggctgggccaggagcccatcttgtcactccgtctctgcatatctgcctcttcatgtactggtgaactgagccttttcagtttcagaacctccctgttcttttatgcttaaatggaatgatggtgaacgcgtatacttcttgatcttcttttttttttaaaaaaaatacaatatatgaattccaaatgatttaaattcatttttcaactttataatagttaattaattcatttgtaccaatgaataattatcacaattcagctattcaggcatttagcgcatccactacactgcgtacaagatacacatgaagttcacagttacaatttagaaatgttttccaatgatatgtatatcaaaacttaaaaagtctagcagtgaatagttaacgcagaatgttcagaaatggtttgcatctgaaacaaacaacaggcatgcaattg

SEQ ID NO: 55574 - DNA, 1501 bp, Oryza sativa; identical to SEQ ID NO: 45468

SEQ ID NO: 55575 - DNA, 1501 bp, Oryza sativa
ccgacgaccacgtccgcggcggcgttggcccccatcgccggagcaatggagcatccagttctacggtccccgacacttgttcctcgtcaatggcaagagtccaaaacctaccgcacctctagactccagggggcccaccacccgctactgccatctgggacccacatccgcggatgtgggcccacgtaagcagtttccatttgcgacggacacggtccatggaccgggagacactggcatgtggggcccactagggctggtccacgtgagccgcatgcgccacgtatcacgcgaaaaaaaacaaaaaaaaaggaaaaaaagaagagggaatttgaggttccttgcttggttgcctcctccattaaagacaacaaaagcaacgccattagcacacacctccactccactccactctcccaccactctcgcttcccgaggcgcgcaaaccctagcctcgtcgcgccgcgccgcatcctcctcctccccccgcctgagtagcgccgccgcatgcggctgcgcgaggcgcggcgaagcgactgacggggggtgatccgccgctttcgggggctgatcgaggcgggaggaggagcggcggcgccggggaatgcccgacctctcaggcgatctccttcgtggtttttggtaataataaacaggtttgttcatctctcgttttacatttttctttctctccgtgacgcgcgtttttttttttgctgttcctcttttggtggtttacctggtaatagagctaagctacagtaggataaaggaccatactgtttagagattccttttgccaatttttaaattttttcatcggtattttgtttgaaggaaaacctttttttttttccttcttttagttttggctgtattttttaccagatgatgatattattcatattgatctttgattttgttgtttcacccttttttagcagcttgcagtattggttacagtgagataatatttgttcagcctgttctagtagatcttaactcatgcttgatcctttagcaaagtggtataaatttttagtttcatttcaaaatcaatctgttctaaagaaaatgcagctattaaaatgcatacggagtacacacagactagccgtttacagtacgctatattgtagtgtagactgtagagtataatcgttctgaagagccatttaatgtcatcggccgccctaatttaataaggttccgtaaatgcgtgctccatgagaggcttgtgaggtgggcaactccagtatcacaaagaaattgtgggcactgccgggaccagtagtggatgactagggtagtgagtgattttactcagtcagtagtgcagtcctgtactcctgtagttgttgtactcttgactctcccaaaccatcaaattgatgtctagtgtcatgcatacttgtaacttgtaagtgcacttccctgacagttccattctttggaagattctgtggtgtggcaattcggatattgctgaagatgaaggcgc

SEQ ID NO: 55576 - DNA, 211 bp, Oryza sativa
gccgccgtctgcttccatggcgccgtggagcagcgcgagaaacggcatctgaccagcgccggcgctggcggccgcgtggtccgccgccgccgccgccgcccactgttccattagcacccgcaccgccgcgccatcgccatgaaccggcagagttgagcacgttagcaagaaacagaaacagcggcaacgccataaaagagatggatgcaaa

SEQ ID NO: 55577 - DNA, 402 bp, Oryza sativa
acctatatttttgcgattttctattaaaatcgtattattttttaaaaaaattcgcttgtataggcgtgtatagctgccgctactaccactctacaggagtagtgttcttcttgcttgcatcgttgcatgcaaagagcatctttagctagctccatcttgctgttgtgtgtttgtgttgataggagtactcccaggttgctagagcggcgttaattgttgtgtgcgatgcatcacgagaggaggagattcccctcgtttctcgcgccgttttctcgggagaaattgggctccatctcgtgtcgacgtcgccgactcgccgtcgtattcgtcttcgtctccggcgacgtcgggagttcgagacggcataatttttctggcggactcccgcgctctcggcccaca

SEQ ID NO: 55578 - DNA, 675 bp, Oryza sativa
agaacgcatgtgcctttagttaattaatatgtaaacataggcatggtcatatctaagacgattatgccctcataagacatcttaaatacgtagttcaaatacatgaaaatcctacacgtggattgtctcgaaaggtattttataatagtattattttagtaggttttatgtatatatattgttcaatcttcaaaagaagagtttcacaaaacaacaactatttagtcaaaattagaattttgctacaactttagacagacatttcaccaaacaacatcgtagtggacgattttactagaattttcactattatgagtgtcttgcatgtggaccttggaaatagttagctaaagttgcatcaaactgataattttgacaaaatggttatgatattctgagatgtactcaaaagaaactagtgtcaaagcctagagtgaagagatcccaaatcaaaaccctaccacatgaaaattatagattggtagtccttagaaaggaattgaatgaggcacattgcatttgagcatatctttgtagttgtgaaaaaatgcattaattgattgtggtcatttgcttgcaaaatatatttcattctctttttgttgcttctcttgtatatattttctttaatatatatatttacagtgggggtctccctcactgtttttgggtcaa

SEQ ID NO: 55579 - DNA, 498 bp, Oryza sativa
tcatcagcaattaacaggtagaccgtcgcgtccatctgcactgccacctgcacggcagccggctcgatcttgtgctaacagaacagggcctttgtccaccacggatagatacatctttgccactgcagctgcactgcacatcgcagttcacacgcacgaacgaacaagatcgtccttgtgtttctcttctctgcaccccccccccccttggtactgatgtggcacgcgtaccaagagacaaaaccaccagcagtagcagccatccattaatacgccttgacccactcccctggatgtctctctcgccaccgtttgcattcgccaatctccaccaccacatcatcttcttcctcctccacctcttacctcgtcgtcctgagcgctcctggttgcagttgccttctcctgacaactcctcttcgccttggctaagttagctagctcatcatcacactctgcatacgtgcttgtcaactccattgagagcgtcgccgttga

SEQ ID NO: 55580 - DNA, 311 bp, Oryza sativa
ccatccataagccctatcaaccatcaccgtgccttcgcctctgacacaagctcgaaaacagtagttccgaggggtgtgtggatcaaatggacattccttatggtggtcgccaacatgtgctagtctttgtggatcatttttcaagttcggatgcatgcatatttaattatttaccaaaaaaaattctgagctgttcttgcatgcttgtctacatcgatccacagctgcaattgctgacacatttatcggggtctctactccttgtctattgactgtgtaggctgcggtgcaaaaggaatatccagataaaa

SEQ ID NO: 55581 - DNA, 345 bp, Oryza sativa
gtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccaccccttttattattgccgaaatctagtttcgacg

SEQ ID NO: 55582 - DNA, 1501 bp, Oryza sativa
tttggctgccgttgtggttatttgtggacatatctttgtaaaatgggtgtattttggcaatggtacttttagatgctttaattatactattatgtctatcttctctattttctcatatggagtgcacttattttgacagcatcactacttagctcaaaatggagatcttgggtcaatgagagaacatgctcgatacacaaaatagctaccacatttttgctattttattgatatgtagcatgtgatgtttgtcttaagcacttagcaaaaaaaaaatgtaactatcgatgtaaattgttttttttttctctataaaatatttgcctcattatttttagttgttatgttaattacacagtatttgcattaaaaaagttaaaattcgctattgtggtgcatgcttattaatttaaaattataaaatttgctttatttccatagttatttgagttagcttcacccatatgaggccataccctcccaaagacagtaaagttgtactcttgtttttcatagaccttggctaggttgagttatttatttgtacttgaacctatgcagtcaacctcctttgagattcatattagattatatatggtacctagtattagatagaaaatatgacaattattatatataattaactgccatttaggaagaggaaaggtgcacattagcttccaagatctatctagcccatttgtaggtgcattgtctttcaaccaaagtccggctattgtctgactttgtgaatatgaattaacccacaattggctataatgcaagagtttttatgcttggctcaataccaacacaccatacccttgctagaaccttactttatgtcgtatattgctcaaggataactaattattgatcaaaaaaattatgttatttaatacccataaaccaagagatgtgcaaaaaaaatattctaatggctattactccaacactaatgtgatcaaggataaaatagaaatcaaggtaaaaaaaacaaatcctttagtttcttacttcagatatgttacacccaaaagcatatatatcatcaaggtaaattggttagtatagatcgttgctaatttatggtaaaatcatttgagcgattctgagtaaggaaaattgagaatttgcataacataatatgtgcataggttgattaaagaatttaatattagaatgaaagatgtgttagcattgatgcataagaaatagtttgaaattgttgtttttctagtaatatgttatgttcttttgcatgtaatttgaatctcaaaagataatcttctcatcttttctaatccaaactacactagtcccaaagtccgacaaatttttgtgttgatctttcctttcttatctcttcccccaaaatcatgcatgttaaatattgtctcccttcaccactatctacaactctactctcgcgcgtttcatggtctttctgtgttactagttgcctggtgcaactcccatcatagccaggtatagatggcca

SEQ ID NO: 55583 - DNA, 437 bp, Oryza sativa
gacgcatgcagcatgctattaaggggtgggtagaaaaagacggagaccgagatcaaaaagaccgagatcgagaaattcggccctaggcagtaaaagaccgaattttgttcggtcaattcggttagtttcctcgggtaaccgaatagaccgaattatcaaaaatgtctaaatgcaacctacaatccactatgtttaataggattaaactctaattttcacatccctacttcttctaggcatgcaacctaataagagtctttactcataagtgcttacgaactttttttttgtgatttttgtgttgaaaatttccattatttctttgcatatatgaaaatgttgttgaatttcggttaggaccgagaccgaaaagacaaagaccgaatttgtcggtcctaacatttttgcgctgaaatttgttcttcacttttcaaaga

SEQ ID NO: 55584 - DNA, 154 bp, Oryza sativa
tcctcctttcgtcttcctcccgttccggccttgtgcagagaatctcaactgagatatgttcagcatatgtttgctccaacatcacatcaaataccaagccacaatcaagcaggagtacaagtatgcacttgagatctctcgatttagatttaga

SEQ ID NO: 55585 - DNA, 206 bp, Oryza sativa
ccaaaatcaaagctacagtacctccgtgctcttgcgtttacacttggcatactgactgcttcttttttatataaatatatagaaatagtgccaggttgatggagagaaactaaacgggcgctctcgtacactgtagacaacacacactctgcacactgaagacaacgcactcgcacaaacaccacgcacgcctgccattgctagat

SEQ ID NO: 55586 - DNA, 1501 bp, Oryza sativa
ggtcaaggaaaacgtccatattcaaccactcaacttggccttgatctgaattttgaccttcgactataaaattgctcagttttgtacctcgtaataaagctatccctaagcccaaaccaggttttttttatgacacggtgaagtaattggtggtatgatttggatgccacaaagcatctactccatcctttccatattgtaagccattttagtttgtccaaaatcaaattttaaccaggtttatagaaggatgcaccaacatccataatatttcatggtggatttaatgaatgtgatttgatgttatagaagttgttacattttttatgaatttggtcaaagttaaaagaagtttaacataggacaaaactaaaatgactgataacatagaattaagtagtagctatcaaactaaaataaataagatacataagagagaaaggtggtgagcatgacaagtgggtcccaatattttctacatttctttgttgtttattgttgatttgtgtggtgaacaactcttttcacaagtaggtaggggtggcattttccccattggaaacagggcctcggtgggtccccacccctacagggccggggacagggccaaatcttcacccgtgggtgttactgagtagggccctgactttgagcggtgttagggccgaggtgacatcttcactcgtggagccctgaagtttaagaaatagtcacctcatgtatgtatttctagccatcaaaagcccataaggccaaaaatagaatataaaaggacaaaaaaacaataatccacctgcacaattcgatgctcccatcggctgcatgatttgtgcgatcgcttcaatgctctgcgcatgcaacgagtcacgcacgtcgcccatgcgtcgactttatcccgcccgccgctatcaccggagtcccacaccatcttgtccacaggtgccccacaccttcttcctcatcttgtggtcggccaccggcgcccactccattcctctccctcttcggtcgcctcccgacgttgtctcttctctccatacgattgctttatttggttgaaggtggcacttgtcgttcttccctccttccaaccgtcggcaacttccgcttgcttaggggatgttgggacttggctgaagtgcgaggccctataggggccggggtttcggccagggactaatttcaacctgttctttctttcggggtcgggaccgggtgaacctgcaagcgaacagggatgggagtttttgtccaacacgaaccgacccaaccccgttgccatgttggatccatctcaccacatcaatggaaccatgttgatgaaccatttttaaagttgcgggatcagtaattaattgctttatagttaaaaggacaaaaattagatcaacgcaatagttgaagggctaaatttggactttaattgtaggataaccaccatttatatacccattgtcattatgatatagtatttattctcgtctcgaagcatcatcttaac

SEQ ID NO: 55587 - DNA, 478 bp, Oryza sativa
caaacggcccaaataaatcccagaagacggcagatcgctctccccagtccccaaccaattcggcattcgcgagcgacggcaagccgacgccagcagcgtgaagtataagcggcaacggtgcaaaatcattcatccagaccttggcgtgttctgcacctcgcatgcactgttttcttttctatcctattttctttgccttctcttgccgatcgagcatatccttattttttcctgttggatctataagggaagagcacatatgttggatgcatagatgtccagtgattttggtggtttgggaattgtgatgtatctttttttcacggtaattcaatttattctttaattagttacttgactgattaaccccctataattgggcatgcagacggctgtcggccggcggcagttctgttatttttttttaatcggaactaaaaataaactttaatctgataaaaagttttaaatctttagt

SEQ ID NO: 55588 - DNA, 1501 bp, Oryza sativa
gatattctatctatattcggtatcctatattcagtccaaatatcatcgccgtgtagatatgggatatccataatctccaaagggcgaagtggggtttaattcctaagaaggcttcacagacatggatgaaattggcaatgtggactatggaattcgggtttaggtgatgcaagctgattccataaaagcttaatatcccgcggaagaatttcgaggtcggaagagcgaagccgccatagaagaaatgcgagaagactacgatctcatgtgtatcagggtggaaaagccttaccgaacgcgtggccgccacccgatgatctccttggctgggagaacgccgtgcgccaccatctccttcaggttctcttccgttacgtcggacggcgcccattggccttcgaagctttccttctcttccgccatcgattttatccgaatgcgctgatttgattcgagggatggctagggagaaatgagggattaaggcggtggatcacgggaaggattttgatgcacttttcgaaggtggatttgagtggagtggtgaaccctagttcgccggcgcagttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcatttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttatattcggatgcctgtccagtgtgttcattcgtgaaccttttagagtgtaaaccactcggactcttttcattatggctaaaaagcagtcggctagcatgcctatttaggcgccgtgtgtgcttttgtcatatgatgcacaattgtgctattatttgatttctcaactatatgtttagtttgttaactaatcacatagttgggggctacacctaattaggtgcatctattcgatgcaccatatttttatcttttcgccctttacagtctttgtcttcgctactcggcaggccttggcatgaaaagtttgaagcactcggattattatctttgagaaggctacgatgattgactgcaaaggtctcgggggctactgtggagattatggatatcccatatctacacggcgatgatatttggactgaatatag

SEQ ID NO: 55589 - DNA, 302 bp, Oryza sativa
atttaataaaaaagataataaaataaattaaatatgtgggggtgtcactcgacaaatatgtaaattcaatttaatatatataacttaaaaaataaatttaactatgaatgacatgttttattctgagttaatttattattttcatttctagttaaatttgagcttgtattttatttatcaatatattgtattattgatatactttttattaatatttttatgatttttcaaatagtataaaaaattaaaggagtgtttcctcgagcgacgaataaactttcccatgttacatcatgtatagc

SEQ ID NO: 55590 - DNA, 1189 bp, Oryza sativa
attcctgcaccccataattaagaaaatattcttttttagattttgcttactaacagattgaaaagaaatctatatatgagataaactttcaagtaaaatttaaaactttctatcgaaaaattaagggatttgctagatgtctattagattaatgggtaggccaaattaaatcccaataataccatattggaaatttagtgctatgggtaataataccatattgaaaatttaagtgaagagatcttaatttaaatatggagctagtggagaatctctgttcaccggttgagatggtggatggacagccacactcgtgcacagagctgtgtattaactcgggttaatcgcacggattgaattctccgaatgtaactctcacatgtgctacaaatcctctgcgattaatcgcgtggatgctctccctctcttgttctgtatcggaagatgattaattctggtgtattaactcgggttaatcgcgcggattgaattctccgaacataactctcgcatgcgctacaaatcttccgcgattaatcgcattaacccgggttaatcgtgcagattgaattctccgaatgtaactctcgcatgcgctacaaatcctccgctaacggggttaatcgcgcgaattgaattctccgaacgtaattctcgcatgaggtacaaatcctccatgattaatcgcattatattctagtgtattaacttgggttaatcgtgtggattgaattctccgaacgtaactctcgcatgcgctacaaatcctccgcgattaatcgcattaactcgggttaatcgtgcggattgaattctccgaaagtaactctcgcatgctctacaaatcctccgctaacggggttaattgcgcggattgaattctccaaacgtaactctcgcatgcgctacaaatcctccgcgattaatcgcattaactcgggttaatcgtgcggattgaattctccgaatttaactctcgcatgcgctacaaatcctttgctaacgggatgaacagacacaacgctcgcacttatgttcttcctctctcgcactttctttccggctgttctcctatttcggaactccgtctgcttacgtacttgcacgggtaggcaggcaatcaagtctttggggagcgtctcggtgcaactgctcatgttctgcttcgacttcttcctctacatcgcga

SEQ ID NO: 55591 - DNA, 1501 bp, Oryza sativa
gcgcggatcgcgagaccgtagacggtaagccacgattcggggttagtggtgccgtcgtacttctctattccagtcggcttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgttgtagcgagaactaaattcgtcgtactccacaatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgctgtcgtggtggagacggccgctaaatcgtcggggagcttcatcaggactagtgggtaagccccatcatcttgatctggtatcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggtgggaagacgaggccgtcgatgccggagatggaacccattgcactgatcggcgaaaagcttgacgctacccctacctggcgcgccaactgtcgaaactagatttcggcaataataaaagagggtggctatcaagctaggaaagtgtatgggtttggagacaaaggat

SEQ ID NO: 55592 - DNA, 357 bp, Oryza sativa
cccccttgcattaattatgcatctgccggcgtggttggctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacta

SEQ ID NO: 55593 - DNA, 524 bp, Oryza sativa
tggtgatcgcacgccatgaaactccaagctacaggtgtttataatattttcattatctcgattctcttgagctacgcacgcagacggagcaagttactaacactgatggggactgtggagtagtttgatcactgctgcactgtacgcaataccacgcatattgcaatcggctattctcaccacaaaataaactcaaccggtatacttatgcagaatactccggattatttttttcctttaaaaaaagatacgaacatgtaaaagaattacatatcaattatattagaagaaaacataatttttgatatactaacacaatcagcccaacagatctatgcctcgagacgagaagaaaatagaaaaaaatctgttaggagaaaagactactacaaaactctgctccaataaaacgggaaggtcgttacggagccgggctacaatcccaaaagaccacatttacgaaaattcatataatgattgtttttaacagcgggctataagtcgtatatatggttctcttcagt

SEQ ID NO: 55594 - DNA, 1501 bp, Oryza sativa
ggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaatgattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaagtgcatcaaaatccttcccgtgatccaccgccttaatccctcatttctccctagccatccctcgaatcaaatcagcgcattcggataaaatcgatggcggaagagaaggaaagcttcgaaggccaatgggcgccgtccgacgtaacggaagagaacctgaaggagatggtggcgcacggcgttctcccagccaaggagatcatcgggtggcggccacgcgttcggtaaggcttttccaccctgatacacatgagatcgtagtcttctcgcatttcttctatggcggcttcgctcttccgacctcgaaattcttccgcgggatattaagcttttatggaatcagcttgcatcacctaaacccgaattccatagtccacattgccaatttcatccatgtctgtgaagccttcttaggaattaaaccccacttcgccctttggagattatggatatcccatatctacacggcgatgatatttggactgaatataggataccgaatatagatagaatatcttatgtgtatcctgggtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccaccctcttttattattgccgaaatctagtttcgacagttggcgcgccaggtaggggtagcgtcaagcttttcgccgatcagtgcaa

SEQ ID NO: 55595 - DNA, 258 bp, Oryza sativa
aaatgtaagtcctttaaaagcaatgagttttgtttctgtaaataggggtcatagatccatgatctattgtcgcaagtaaccgcaagataagattcgtgcaggagccgtatccttagcaagatactaaatcaagtcagggctagctcagagtctcgatcattaagaagggacaattgccgctaatccgacagcgatcagtagcctgtcctttctgttaccagtcgtggaagagttcggattctccccaatttgtccaaa

SEQ ID NO: 55596 - DNA, 405 bp, Oryza sativa
ccaaagcgcacttgtttatctttcaacaagtatggtgaaatgatggcctcaactaagtgggtagttgatcgagtggtggacttgttgcgggataacccctcaacggggagcataggatctgcaagcaccatattaatatcctataatttagggtcttcagaggataaatggaaagtgggatgacagctacgatcttctgcctacctatcgtgaagagctattaagatcagtgccaagcagcttagatgagttggacagtaaagagtgcaatggtgatgtctgcttcacgaggttctctgttgctctcaaaccctatatcaatgggtttttgaaaggatgtaggcgttacatagatatatactccactcacttgactggaaggtctagaggccagttggcatcagc

SEQ ID NO: 55597 - DNA, 1073 bp, Oryza sativa
tcacttccttaggcttttttcactgggatttactgtgacatttcaaatcacatgtgctcctatttccttttggatcaagagatgagataaaagccgatgttatattaagcttaacatcgactcctagtggactttcagagaagatctatactactttaaaagaaaaaaaagagtggtggatatggtgagtctgccactcccaccaccaagtcccctaaactgacacatggaacctacgtgaaagtcgtttttgcatttaaatattttgtaaaatcaaaggtgttttttattattattttgtgatgaacaattgggcattggagattattggttttgttatttggaatttattcacgaagtggttttggatatgattggatttcacacgtgatcgcaggattcgtcattttatgtgaccggtcagaccgagctctggtagccggttagaccggcgtgtaatgcgcggtcagaccggcgcagcccgcggtctgtgtcggtttcggtttcgggttgtttatttagatgtccgaatttatttcatgattataacttctagatggatactatacgtatgtaatactattgtttgctgctgatgagtcaagttggagatagcttggtctcggaatatggtttctttgtttgttccatgtgtaggtgactcgatgtctcgggagagtatttgcggtgatggaccgggagtcggcttggggataagacgacatccgtggtggtcaaagatcatgcgggatacttaggctagagttgatgcacgtggttgatggagattccatatggcatacgatggagttattgtgtgcgtatgggatgcggagtcgaatttggaaggagtccaaatttggtacaattggttatgtaaagtttctttcttgtactagagggtttcctaaggtgtttaggactcttagtatgagtttggttcgtggctttaggctgcctacctcatgtataaatagagggggagcgtgaggcttcccggtattgcttttgagagcaattgagttgagttttgagttagggtttcgagtttagtcgaaatttttgtaaggagt

SEQ ID NO: 55598 - DNA, 151 bp, Oryza sativa
tccctatatattatggaacggcctaaagttctggtttgataagattgtaaagtagatttaggaaaccgataccgtattggttaaggtttctatcttgtaatcctgccccccatcctatataaggtgggcaggaagccctctagggggcatg

SEQ ID NO: 55599 - DNA, 1170 bp, Oryza sativa
tatagcctttttaaattttgatatataagtatgttaaattggttaatggtgtggtcatgtgaaacttttgagcaataatattcatggctatgagttacgtgctaaaatcccttttgttttgtacaactttgtccataactggtggagttttataaaacccactctaaaaaaaaacttcaatgcttgaaatgcacattcacaatgtttccagaaaatacatatatttgagtcggtacgattattatgtaacactttttgcggccaagaaaaataaatccatttaagctaaacaaagagagaaggagataaagagaatgaactaagaaacaccaaaaatatgttaaaaaatacaatggtttggattgaaacctaaattgccctaatttcttagacccctatacgatcgttcattctgcatataaccgaaccgtgtactgcttgcacatagaaaattatataacaataaactgacggtattaaaaatactgtctacaccatttttcgcagccttaggtttacgttcagtattttgtattgcttatatttcaacggcttacgtaccttagacaaaagcttctgaagggcagattttgctttttaattcattcttaggttttagtgtacattgcaagctgtaacaacttttcaatacattatttgcaacttagacacatacgtaaacacgatacaataccgtcaagttctcaatttgtaccaccagacaaaaattatgtttgccctgcaaaaaaaaaaactctaaaaaagagagagacaaattcctttgataacccatttgataaaggctgtgtttagttcaacgcaaaagtttagattttgattgaaattagagataatatcactgaaaaattatgtgtgtatgataggttaatgtgatagaaaaggactaaaagtttggattcaaactttagatctaaacacagaaaaagctagttccctttcatttcatttccaaagacgtatttaagtcctcgaagccagcagcgaacccccggtattatccaatccttccgccacgcctccgcctccgccgccgcctcgccgtccgcctccgcggccgccgccgccgcctcgcggcaaaaccctaaccctcgaactcccccccaccccactcgcccccgcgcggagcaggcgagcggctaccccaacccg

SEQ ID NO: 55600 - DNA, 734 bp, Oryza sativa
  unsure (1)..(734): unsure at all n locations
cgtgcgcccngatagtatcacacnactatannnnnnnnnnnnnnnnnnnnnnntctacgatgacttccgtcacgtgttcggcgaaatgtcgaggaggggcctcccttctaacataaggttctacaacatttgcatccacgcgtttggcaagtggaggaggctggatatgtcgctaaagctttttgctgctatgaagaccgcctctcctcctcttgtgccagacatatgcacacacaattcgctcatccgtgcgcttgtggttggtgcaagggtcgctgatgctttagtggtgtatgatgagatgaagtcatttgggattgaaccggatgtgttcacctaccgggctatcgtggatgggtgctgcaagagttttaggatggatgatgctttgcgtttgttccaggagatgcgagggagctatggggtgaagggggatgctgtggtgtacaattcgcttctggatgggcttttcaaagctaagaagctggatgaggcatgcggtttttttgagacaatggtggcggatggtattcaatgctcagcaagcacacacaacacagtgattgatgggctattcaagaatgggagagcagaagcagcgtgccggctgttttatgatctaaggagaaaaggccaactgttggatgggattgcatatagtattatggtgagggagttttgcaaggaagggaagggggaccaagttgcggaggcggtagagttaatgaaggaaa

SEQ ID NO: 55601 - DNA, 728 bp, Oryza sativa
ctagaacatgaacacaacgacttgtttattcaaccacctgcccaccatccaaattaccaatccaacgaacacaagcccattgatcatcgtactcgatctaagcattacactactattttaaatgtctgccatgtttccaaatgcaactttagccatggataaacgtcttgtattagaagagcatgacgttatgagaagcagaccagtgtttattaacttctcatttctaattaattttctagattatacttcctcaattttaaaatacagtaacttaagatgagattagatcattctataactatgagggcatgttcactttaatgacattttcaaccttatcaaattttggcattaccaaaattttggcacatgatttcttatatagttaccaaaatttggcagcaaactaaatatatgcactttttagcaactttaccaaaatttggtaaggttgaaaatgacatcaaagtgaacagaccctgaatcttaatataattatcttcagattcacatgttgctgtatattaggacgaagatagtagtaaaaatctaaattgtttgaggagcttaagaagctgcatttgctaaaacttccacagataagaccaatttatatactatgaagtagtaccatattgatatgatttatgtgcgtccattcttaaataacaatagtcggagttaccctcgtttggggtacagtaacccctcttccccggtaaagc

SEQ ID NO: 55602 - DNA, 1501 bp, Oryza sativa
gttcttatgaagctacaaggaaaattcacttattgaaaagaaaacatcgaacaatacatatggaaatagcattcagtaaattcaaatggaagcaacttacttcattaactttatgtaatctatagtagagtcaaaaacatcaacatcaaaagggccttcaggtccactgaaggtagtgacacctacaacagaaatatcgacctgcgatgtgggcaagaataaaggagtgaaacatatatttcaataccctgggagcaaaacaaacaacaaaaactaacaagtcagcgtcaactcttacatctggaaggtcttccgcgatgagatattcagtaattgtcgttgtattagagaagatcttatcagtaaccgattcaggggcaggtccaccattttccatgttatatttgattccgaagtcctgccaagatcaaatgaaaagttgctgataaacacagaaaatcgtgccacttgattagcagcagagatacatcataactgtgatacctcagtaggaccaccagggttgtgactagctgttaaaatgaaggcaccagtagcctttgatccctattttttgatgatttgataaagcaccagtaaggtaatttgttaacacagagaaaataagcagtgagtactaacagtcacactgcaaaaagttaatctttgtaaaataaatcttacatctgcaccaactctttcacggataacagcagatacagctggagtagacatgaggctgttttgtccaacccaaacacgtcttactccattagcggcagccatttttgtaatgatctataccaagcaaaataaatgtcaaatctccaaccacaattcaaagttccaactttcaagagcaatctacaactgagatagattacaaccactaataaataaactacatagttaagaagcactatgcataggcactgcacgatacaaaattgtgtactaggtattatgatcaattttatgatgtcgcatttttgttttggtgtgacttctggtaaacaattgaaaccatttaacttgacacaacatagaaaaatgaacaatatttgacctcaataaacacaatactattactatggtacgtctgcactcaacaatcaacatgtgtcacatgatgtggaggcatgtataactaagcaagacgagtctaatcatgcgtgggttccatcacatagctcgataaatgttgaagtatgtggctatacaaatatttaaagggaaatccgtagaagcaactgcaaatatataacaaaattgacaataaggatcacaaaattgcacaagaaccatgaggcctaatcaatcataaattacctgaacagcatccttcgagaaatagcggccatcaccagacacaacaatggttgcacctgtaagaaaagaaatgatagaaagatatgaaaaatgacaatgaaatatcagaaaatactttaattacggaaagtggtaatagcatttctaacttacaggggatatgcagaaaatg

SEQ ID NO: 55603 - DNA, 1056 bp, Oryza sativa
ttgaagatgtctcggagaggttggtttcgtcgctgccgtcaaggtttgcctgtggaatggagtcgcccgctgcaggagtcaagtcttcaggcttagctcgcttgtatcttttccgctgcatttgtaatcttttatatttttgtaaggcgtgggtctgtatgtcaacaattgtcgtttgtgtaccctggctggtcctggacaggggtttaatacacattcagcttagaaattctggttcgtgaatttctgggcgtgacaagttggtatcagagccgaccttgaccgtaggacaagccaaatgaaaaaacctaagagccctctgaatccttttcattgcatatgttctttgcaattggatttgttccgggaaaattgggatctgttcttgtggttcaagggaaaaatcttggtcgctcgtttaagtggggtttttcaaaacaagtcagtctagggttttagtaaaattattgggatttattcgtcagacagttggggtttgatgggtgaaatgcattaggtcctagctctataacatgggttgcaaggtgtttatgcttcgtttgttattattaatatgtatctaatttctcattattttgtcgttatgtgagtctgtcttatttattcgctctcatgcaaaatgatctatgcataaaatttcgcttttattcgtttcccttatttgagtcttttattgctttatttaaatttggatttgagcatgcattgattcctatccctctgtactctttagatgtcagacctattctccgatcgcaagcgccgctccaagcttcagagtcgccacccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatgg

SEQ ID NO: 55604 - DNA, 1501 bp, Oryza sativa
ttttgtcatggaagagtaggcaacggcgtagtgggctcaatattgcgagttggaaggtaacgcatggctgtagtaggtccttgtcactgcactcacatgagggtgtcatctttgtcttgtacagacggatagagtcgttacggatattgttacgcaggaatcagctatacacttgtttaccatcagaacaaaacggtaaaatcctgatagggttgaatttggaagtgaattgcagaactggacaattcggattggtaaagaaaagccatgtcttgacagagagtttggaaactcaactacagaacttgacacgtcaggttgggaaaagaacagcgattgaaaagagtagttcagcatcgaaaaaaatatctagacacaacagaaggggagcaacctggatgaagatgaagatgaagaagagctatccaattcgcaagggcattgtcaatttctgatgcagtcatgcagctgacgcttttggccgtctttaacttgtggcacaatcgtcgtcgtctttttcctcaaagtgtctggatcatccatgaactgacttgaaaaatatctgaggtgtgataactaccagaagaatggataaatcacaagtacataacacaaaaaataagatcgataaattgggtgggaagcacaaaatttgcagattttcatggatcttaccagttaccactaacctcacacggttggaaatgatgaaaagatggaaggacaagatgagaggagggagggcctgaatttcaattgggatggacggaactggtggcgaacttgtgccgcgtcgaagtcgaaccggccggccttctctccggcgggcggcggcgatcgtgtcttgaggagaggagagacgctgaacagaaggacactccgcttctttcctcggatgcgatttgtcccagttacagcccaatatcgaacagagataacaactgacggcccaaagtggggcctgttactaggtgatggcccaacagaggaccatgaatgttctatcgtagagcttggcgggcccattaacaatcagcaaccccgggctggtcttggaccacacatcctccaagaatagcccgttaacacaacacgagtaattcggaaggaataagtaaccccggcggcgagtgaccggagaaggcgggtgagcacgcggccggcggagcggagtggcgacagccgtgccatctgctgccggctgtgcatcgagaagattggagaggaaaggagaagagaagagaagaaagataagaaaagagaaaaaaaatagaagaaataaggtatgtgggacggtaagtgaacttattccaatatggaacggtccgacgtcacagcccatatggcctgttaaagcctgcttgccatccattaacatttctttagttgaaatccggaatttctatctagcgctgtttttgaaattaatgtttctaaaaatagtgtgcgtagtccgatgacctgaaaaattcgtgcgcatatgcacagcatatatgcaagt

SEQ ID NO: 55605 - DNA, 935 bp, Oryza sativa
gagttctgaatgagtgtacttggttgtgtcgaaaatgtcggtacttggatctggatgctgctttacaccatgtcatgattcaggaagaaggttactgctgcctaatcaaaatgagagcaatacgaattgcattgttgattgttctgttccatcaattgggtacagcggtgccaatttgtagtattattgagagatcatgggtaaggtagagcatgattcttttgtcatggaagagtaggcaacggcgtagtgggctcaatattgcgagttggaaggtaacgcatggctgtagtaggtccttgtcactgcactcacatgagggtgtcatctttgtcttgtacagacggatagagtcgttacggatattgttacgcaggaatcagctatacacttgtttaccatcagaacaaaacggtaaaatcctgatagggttgaatttggaagtgaattgcagaactggacaattcggattggtaaagaaaagccatgtcttgacagagagtttggaaactcaactacagaacttgacacgtcaggttgggaaaagaacagcgattgaaaagagtagttcagcatcgaaaaaaatatctagacacaacagaaggggagcaacctggatgaagatgaagatgaagaagagctatccaattcgcaagggcattgtcaatttctgatgcagtcatgcagctgacgcttttggccgtctttaacttgtggcacaatcgtcgtcgtctttttcctcaaagtgtctggatcatccatgaactgacttgaaaaatatctgaggtgtgataactaccagaagaatggataaatcacaagtacataacacaaaaaataagatcgataaattgggtgggaagcacaaaatttgcagattttcatggatcttaccagttaccactaacctcacacggttggaaatgatgaaaaga

SEQ ID NO: 55606 - DNA, 564 bp, Oryza sativa
atttttttcatttacatttggccgggtaaatttaaatgaaatgtacataaaaaagataagagtgaaattacaacaatatagactatgtggtattatgctgaatgatctccaaacggccagaaggagccattcatatggttggaatcgtaaccctgcaaataaaaatggagaaatatttcagttcaaaagacaacatggagacatcgcatgcacagttgcacactcatgtttcaaccataaaaatgtgatgcgggcaccatacaagattgtttcagttgaaatctagcaacaataccagcaaagcacaaacaaccaaactattaacactcattaaaatcgtctagcaagggtactgagattgctgatttgttaagaaaactataccataaagacagagttaacctcacttatctgctggagtctgagaattattcttttggcaagtaaatcccaattactactaacactggcaagtgtggtagatcatgaatgtggataaaagttacactaacatcagaatatatggaacaaagagcaaccaagtattaactaaatctgaaagag

SEQ ID NO: 55607 - DNA, 159 bp, Oryza sativa
ccgccaccgcgccaaccacaccaatcttcccgcggaatcaaaatccaccgaccccgacgcgccacccgcgaatctctccccctcccgccgccgccgcggcctcctcctccgcctcctccgcctcggccggtcggtcgagccgccgccggaccgatccga

SEQ ID NO: 55608 - DNA, 776 bp, Oryza sativa
acatggattgctgtcattttcaaactaagtttgttatgtattgtaagctattgttttacaaatgcactttacatgtcaagggcgcgtggaactttcatgatatatccagacagatatttgtatgtgtaaagtgagttatgaaaaatatattagttatcaataactgcttacgttcaaatgagatatgtagtaaagtgcccttacgacgacatgtctaatactacaacggtttagacattccgtgttaaaaatcttatcatagcctttaagaacgtcatcgattttatgaccactttggaaaaaaatctgaaagattagcttgcgtttattttgccaaggagttaaaaaacacgttagagagaaaaaatcacgaaaggaaacgaaatcgtgacagaggagacattatttctcataacagctcagctaacacgtattgacaacgatttgcctataaaactagctagatttttctcacggtcctagatggaagaacgaaaggacatttaggaggcagaacataaatgaaaatagccccttgctagcatcaaaccatggatcgattgtatcacggcggtcatcaacgataccagcaaagaacgaaatgcctacctattcactctcaggatagagcagcggctatattttgtgactttaggtgaaaacagatgaaaccgatatgcatgggcattaatgtggactattaagcatatatgaattttatttaggcagcaatgcttaatgtttttaacttataaattgatatttccgcgaccagg

SEQ ID NO: 55609 - DNA, 324 bp, Oryza sativa
  unsure (1)..(324): unsure at all n locations
gccgtgtaatcactgttataagncactncagcnngtgccgataaaggccgcaaaaaccggccctaatttttttttttttttgtgattgcctttcaggtatttcactgacgccctttgatttttttttattaggcgtgtttatttgtgagtaagttgtttaaagagatcatgaactgcatgtttctacaggttcttgatttgattataggattcatctaattctgaatcatcatcaattccttttcatggttgttctcctagtctccttatcccagaatgccggatctttacttagtattttacatttaaaagaggttaatcacg

SEQ ID NO: 55610 - DNA, 1501 bp, Oryza sativa
tagatggtgttaaatcctcacctaggttattttctgggacggaggaaatactcccttgcaacatgcaacagtagagttagttaactgaataacaaatcatgttagtttttcttatctccgtcgtttattttccttatctcctagatgcaaagcacaagtaggtgcagttctctttaacagggaagaatgttactgtttctttataggtatctaacttcaactgtaaaccataatttttcttattaactactgttaggtcttatgtcatctagaacatcaactatatgtaaatcggtatccaccatatagttgcaaactggtaaccatagaattgtgaaataggagtattttccaagctaatcatgccacacaaatgaaaaaaaagagtaggttgtaacatgacaacttaacgatatataaatctatacacaattatatctctaaattcattaacacctatataaatgtgaacaatgctagaaagtcttataacctgaaacagaggtagcaacaaataagcgcaaaaaataacatgagaaagtgtgcacgtgccccagtgacatgcatgtataaaatgtgagcaccattttgaaaaggctgtacaccagtattttcggacaaaattatgaaaagtaaaatcactgccaaaacctagcaatcgacaaaatcagctgaaaaatcattgcaaaaagtgcatatgctgcccacggatacgatggaaaacaccaacatacggcctcttaaaagccagaaacggtacagatggcaccagccaccagcacagttttttccacggcattctctatttctttacgtccacggtaaaggaaaagaaaaaaaaaagcccatcgtttcacttacgtttgcatgacttaatacaaaatttatatatacgtgtccatttaaaataatgctaataaataaaaaatgttaaaaaatatcataaagttaagttttaaaattcaaattctaacatataagatctagttctcttcttcaacttcaaacttcaatattcctgttttccattagtgcgtttttaagctgttaaatgatacatattttaaaaaaaaattctatacagaaactgtttaaaaaataattaaatcttttttaagagaaaatcaattaaatatatttttcaagtttataattattaaatatttaattaatcatatgctaatgatttttctcgttttgcatatgctaaaaatatgtagcctaagtataatcataagagaaataataagctgaagaaagaaaaaaacactttaaaaaccgccccaaaaatataagcggcggaaaagaaaagggataaaaaaacaaaacggcacaacggaatgatcctctcccgcaccagctataaaccgccacacgccctcgtcgctctcgcccccgcaccaccactccctcctcctccatctcctccgctcccgatctcacaaccaccgactcctcctcctcgcgcggcggcggcggcggcgtgagccagcagcagcca

SEQ ID NO: 55611 - DNA, 386 bp, Oryza sativa
accacccttccccctcccgtccgccccgtcccgtccggccgcgccgcgccgcaacccaaccccctcgtggcctcgtctcgcctgcgtcgctcgctcgatccgtgcgcgcgcgcgctaggtcgccatggcctcggaccaaaccctccccgtcccggtctcggtcgagctgccccccgccgcgcccaaccctcctgacccgaccgcacccctcctcccgcacgcggacgacccctccgcaccccccgccgccgccgccgccgcccgcaagctccccgtcaagcgccgctccccgccgcagagccccttctccccctcctcctccgacccggcctcctccgaccccgccgccaagcagcagcctcagcagccgccgccgccgttcaagt

SEQ ID NO: 55612 - DNA, 1501 bp, Oryza sativa
aattgtaatgcgcctgtggtgacttcgtcaatctccaggatttattcgttcagcctttgaatatgttcataggggtagggtttgcgtgcgtgtgttcataggggtgagtatgcgtgtgttgtgagtgtctgcgttataccgtgtactctaaaaaaattttattagccccctccccccctcccccaaacacacacacacacacacaaatttgggtaaaaatagatcaaataatatctgaccgatttacccggaatccgatcggagcgaggatatggtacatgtattttaaaatcgggtgaaaaagggagttttttttttctcgcttagatcatatttgagactttgacgcagaccaatatggcatgctggaaaagggagacagtgtcgctctcggcttctcgcctgctgactgcgagagtagcttttttacacagcaacgtcgtcacagttgggtggcttgtgaacatcatgaaacacacgccatgttcccatgaattaatcctgaaaacctctcgcgatcagaagcatttttcttttctcggcacagtttcctctgctccctttctggtcaatctgaagcttccataagccacgactgaccaaaatatttcagctgatgtgacatggggccgaggttacaggtggtgacaagtaggagtacttccgtacgtgtttaaatattacaatttctagcattcaaattttgttttaaaatataacaacttatatatctattcatttctcaatcaataacgaccttttacttttagtatttaaaatattacaatttgtttgttaaatctacttccgtgcttaaatattacaatttatagcattcaaaatttgtttcaaaatgtaaacgatcttttaccttttagtatcctcaccaatcacaatcttttcatatttaatttcacctatgtttataatactcatgtctaattttaaaacattttatgtcttgggacggagatagtagctgttagtccaatcaaattgctaaatgattttttgtttggaggctctttttctctagtgaggaggaactagaagatgttgacatggcaggctggcagtgatggttatccctttatttttgacttgattgttcaaagaccgtgggaatactgttagtgatagaagtaaaaatacaagagtagtttcagtttgttcctttgtttaaagatgttggggttgttcaaaacattggtggggggtgggggggtgtcgagggtcaaggttccaaagaatggtggctggaggaaagaagaataatctgatgcaagttcacttgtttaatattactagagtcaaagagattgaaggaaaaataaataaataatctgaaagctcgaagtatgtcgtcaaacgctgggctccatatgttcaatgttaatactctatttaagcatattatggttactagcattctcaacgtgactaacagagaaggatgtcatgctgaacctgtgagctgagacgtactgcgattgtgagtagg

SEQ ID NO: 55613 - DNA, 1501 bp, Oryza sativa
attttcaaccaagataaatttattataaaaatatattaaattattgatttgatgacactaatttagtattatcaatattattatttttttaataaagttagttaaacttagagcagtttgactttaacaaagtcaaaacgttaacctaaaacctcatttttcgtatattccttcccaaacactaaaacgagaaaagtagctcgcggcgttgctgaagtacgtgaacggttcctgcctacccggccgcccaaagaaaaaaaaaatttctgctaatcggctgcgttggtcaacacggaaaacgcaatttcaccggaaaaaccttcaatgcgaggaagaaaaagaaacaaatacactacagtagtagtacgagtaaaatagttctttttttatactgctagtgctgttggtaggagaaaaagaaagatggaactggctgacatgcttgttacagcaggtacaatagcaggtataagccagttataaacatattttaaagagttaaaaaaagaagagaagagcagcgggctacagatctgtagccagctacagcacggactccaagatataatgtgtgtatgacaagtgggaccagatattaatagtatagtaaataactattgtatgaattggctattacattagctataaatgatttggatctagtagtggactatactattaaacttgctcttagagcaaggctaataatacagccgacctgctggctataaggttctttatagccttatcttagcctatccatataatagttagctcttcacaattaatacaggacccacttgtttctctcacagagttttttggttcttgtgtccaagccggctgttagtttacagtccgcttcttctctctctcctctcttctttcctccaactcagcatttaaccggcttatattctacaattatactcgctcttattgccagccagaataataaccgagtgaccggttaacccgggggcgcgggcccacttgtcagcgagccctcccagcacgcgcagcaaggcgcatttgttgtctcggctggatggctggcagagacagtcaatccaacagggcactctcccctaggcgtagcattgccagagtcatcgtacccagtcgcattccccttccccatcccggccaagcaaacgagatcccattaccattcccattcccacccgtgcgggcggcgccacccattcccattccctttcccaaccgcccgccaactcccggaataaatcccggcctcccaaagacggaaaaccccaactccccgaggcccattccgcaaaattcgcacgggagtttttagggtttttccgtttcgcccacctctctctctctctcttctcccccatccaccaccgcccacacacacacccacacacacaaccaaaagcgaaacaaaggcgcgcacgcgccgccctcctcctctcgcttcctcctctgcgcgccgccgggatgcgggcggcgtggcggccggcgagcggcc

SEQ ID NO: 55614 - DNA, 1501 bp, Oryza sativa
aacaccggacattgcgcactgacgaatgttcttaggactttgatgatctgaacatggagatataataattgtaagtcacatgactaaccagccgattagttggtactaaatctgatccaaatcttctgttgacgtcccgtcaatttctttggcatcatgtagagtagacatttggtacactggcttgggcttttctgaatttaaaatttaagtcatacagaactctttgcgacttgtgctgcaagagtacgatcaaattgaccatggtttggttgttaataactctagctgctctaccagctgcgcgtggaaaatacattttgagagaccaatggaagacttaacaaccattgtcttaccgtaagcacacatcgatcagccatgacgcaggcacgaaattagcgagtctatctcgtaaacttgaaaatgatgtactaactatactgtttcatcatatatatagtttcgaaatatggattgatctggtaatcgatgaatcagaaatatagcaggcaagcttttatcttttctgaagaactcatcagagaaaaactcaccttattaattccaaagcttctatgcgtctgcatgctcttctgatctgtaatctcaggctctattactctctccctctgctaaataaatggaaataatttactacctctgtttaaaaatatagcaacttagtatcaaatgtgacatatcttattattatgaatatatacaaatccttatcgatcaatattatgtaactatatattttagaacagaagtagcaacaagatattaggtaactatatattttagaacaagaacagaaatagcacatctcgttgcggcgagacattccaaacgtaaacctcgagttgtccgtgctcgtggtctccaaaaaagaacgaaatgctatgccaattgccaatatgccgatgaattcaagacggcaatcttgagaagtcatttcactttgatttttggaaagccacgtcgtggagtcgcgggctacggcctacgggtgctggtctcgttcaaacacactgaaatatcccttgcagagaggatccgttagcaatatcgcatcaggcatgacgtattgaaaaaaacggatctaccgttgactttggacaaaatttactcaaacagtagcaaaaacgatctccaaatcgatcgatccttttctttccacacaaccaaagcatcatctgtcctcatgaaaaaaaaaagatctttaatagaaagaaaaaaaagtgaaaaaaaataaagagcagtggcccaataggtccaaggaattggtcagagctttcttgggccggagggcaggcacagaacaagattctggaaccttctagacgcacccgctgcccgtataagataggcatccacgccgcacagcctccaaatccaaatccaaaaacccattataatccataaacaaacaatcccctcctcctctccaatctccattccctctcgagaagaagaagaaatcgcaacaatttgacgg

SEQ ID NO: 55615 - DNA, 1501 bp, Oryza sativa
ataggctaattatagattaattaggctcaatagattcgtctcgtgaattagtctaagattatagatatgttttattaatagtctacgtttaatatttataatcagtgtctaaacatccgatgtgatagggacttataagttttagtccgatctaaatagggtctaagtcttggaatggtcaagtagccaaccatgatagaggaagagagaaaaaaaaaaggagcaagaatgtgatgccaggcattaaactatcgctgtggttgtttcttatactccacggctttctgaaatctgcacagtggggagtaaagcccaccttccttttgctctttgccttgctgtagcgctcctgtaggtttgcctatttataagccgaaaacaggagaacaaaacaatgaaaatatttttatggcaaaggcttttgtacacatggtttcaaggcaaaagctcagtattgaaagcgacaaaagaatctgtctaaattaaactctaaatcaaatttagttgcatcataagccacggttttaagaccaggtttgagaaactaccgacagaagatgccaaagaaacttacattatcactcaaatctgtggttataaatcttagaaaaaataataaactagaaaccaaaaaccaagaaaaaccagctattttaggattctcataaatgtctcggaatctcgatctcgctggccccgacaatgaccatccgttttgcgttatgtaatcaaaactctgatttcttataatataatgatgtccaattctttagtttgttcgcgaaaaaaaaaatcgatctccccggcccaggcctaaattgacccctttatcggaacacatatcctaatgacgtcatcaagcgacgtgcactctaaacaccatggataaacttatttggataaacttatccaaatacaaatgacatggacacgcaattatccttcgatcatactaccgcctactcgcagaataccgtgatcacgcacgcacgcacaagatacagtatatctcaccgtcagttagcccccggattctcactcatccccttccgtattaatctccgttgggatccgacggcgatgcgtgcactgccgatcgggcggacgcgccgatgcaaccggccattaccattgcagctgacacggctcgcgcgcgcgccgcgggatattccagcgttgatacgggtcaaaaagggcacgggcgcacggcagctgacacgggaactcgccgcgatccccgccgttttattttccaaaccagcacgcgatccatccatccacccggctccccacacacgagaaaaaacggacgccgccaccgccccgcaccgcgcgtgatccgtcacggtgcggtttccctttcccatataaatcccccccgcgtccgctgcgaactactaaaccgagagagagaggcgcacacacgaagacgaggcggcgatggtgagcggcggaggagtagcggcggagaacggcgagatggtggggaacggggagggga

SEQ ID NO: 55616 - DNA, 242 bp, Oryza sativa
agtattaatcccttagttaaactctggttaagtatagcagagacgccggccgagaggagtggggggagagggaggaggaggaggagagtggctactagtactagctatctttggagtgggcgtttcttggccggcggcgatggagcaggtgcggcggaagagtagcctgaggtcgcatggctcaggcaagtcctcgccgcgggtgggatcgggggtgttcgatgagcggtccggactggcgg

SEQ ID NO: 55617 - DNA, 220 bp, Oryza sativa
taaccctttcctcaggaggtggcccaaagcactgttccttccattaggggaattcctttctttccggagggagatccgaccttcccaaacttttcccggccacccacatattgatcggggccttgagagtaatacctagccgtttaggagtcctcaacctccaagagtacaaatgatgcaaagatctcctggagatgatgcaagtgctcacaaatcttca

SEQ ID NO: 55618 - DNA, 201 bp, Oryza sativa
gtttttgctgctgttcttatcaacccaccccaaggtctttgctagtgagatgattctatttttattgagaaaaaaataaattctggtactatacaagaacttcagtgtgctaaatttgctctatcatttcttgcctctagcagatctcagtcagttgattactagctttcctttatgaccttgctgctagcttgtaaaaga

SEQ ID NO: 55619 - DNA, 549 bp, Oryza sativa
ttgagttttatataagattattagatttgtaattagacttagcatataagattgtgtagggttctaatatacgacagttaaacttagcatatatgactatttgagttttaatataagattattatagttttaatataagattattagatttgtaattagacttagcatataagattgtgtagggttctaatatacgatagttagacttagcatatatgactatttgagttttagtataagattatttgagttttaatataagattattagatttgtaattagacttagtatataattattgactagggtcctaatatacgtcacttagacttagcatagttgactattacagttttaatacaatattatttgagttttagtataagattattatagttttaatataagattattagatttgtaattagacttagcatatacgacagttagacttagcatatatgacttagcatatatgattgttagcatataagattgttaaagcaaaaatgacctatagacttagcaactatttcttgtatgaacaga

SEQ ID NO: 55620 - DNA, 1501 bp, Oryza sativa
ggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgctcgaacagccgtgcccacggtcatgggcggatgtgaggtgattcctagcgtagttttgtttgactactgcttgtgaaattgctgttgtgaaactgggttcgatgtttgaaaaatcagcagctgacgggatcagctaggcccgggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatcccccctagttgctgaagaagatgaagtggatcctgctgacgaggagttcttccaggagcaagtcggctacgatgagttttagggtttcggcctagttcccaagtcgcgcctgtgatgattggtccaagtactggcttccgctttccttttgtaatgcagttgtgagctcgggatctgtccgcagcccaacatgactgtacttctactctataataaagagacctctgttgctgtgatactctgtctccttgtgataccagcactatttcctgggactggtatcgattaacaggttaatttggagcgtcacgggctagatccggtcgggactagttcggggcgtgacaagaggtggtatcagagcacaggcttggccctagggcgaaacccgacgcttaggacgaccctaaggatactaagttcaaaactacttgcgaaaagctaaggtttcttttgttttctttattttcaatagtttgtttctaaaacggttactgatctttctccctctttcaaaattgtagatggcagtgaacgccagcttcagttcccacggttttggtgagggtcaccacgtcgctcagcttcgtgacctctcccgtttccttggcttctcgtgtcccgagtacacggggtactccgtggaccgtgttccccctcactg

SEQ ID NO: 55621 - DNA, 1501 bp, Oryza sativa
gaaatacactaagatacaacaagcatgtcttcagatgatagggtagatcataatagctaagcagcagtatatcgctcatcccttgtgaactaaacgcagaactgagagaattgtgcacttgctcccattggtcttttgtatcagatttactagctagcagactagctaaacagataatagctaatggaaagccatggcactttttaatgattgcatgtgaaacttcttccaagtgagtaggaaaattggagtctgagtggaaaagccttttcagaaatagcttcttagagtcttgctcatttagaggttgaatgttgtaaacagaaccttgaaaaccagagcagcatgattttgccacattgacattccgtgtggttgtaattattctactacaaagactgttctcaggcaaagctaacctcacatgttcccatgcagatgcactccagatatcatcaacaatgatgaagtacctatgtacatgtaggagattattagtctgccttaacttaaaaatgcagtatacatctcatgagaagtactgcagaagatattatgccactctaaaagtatatattagatatttatgccacttttaattatccggaacgcttctggaagacaaatttaatacacatatatagtgttataaatacaatattaccacattttatcgctcaattttaatcaagtattcttcacctcgaactttaaaaagaaaatataatatgtgcagggcagccatctatatctaacacttggtgcctctcacactcatgaaacactagtacactacattcagatttctctgccagcaaacattttcaatgtttcatgtattttcctttttcattacattcaattgcaatgttgcatgtattttccttttacattacatccaaactgcagatgctatcacagttttttggttattatgcatggatctccatttttctttgtaaatttcgagtaaaactggcattcttagtattagaaatgatggtgtacactgctgttggggctgttaaaacagtacagttaggagaatgccatttagaatcaaaagaagttgtgaaataacactctggtccataccctactatttctttctatcctttctgttagtcagatcagaacaaaaggtcatttacatcctcaaaccagacgaagcccataatgctcatcaaaaaggaatgcttatttgcaatgaagctaattacaaccaatagcagaggatgctgtgacaccaagacaagacaactgttcaagctgcacggccacagcacttctaatccacaactgaccctcccattactggcatcctataaattaattctgagttgcatctatagaaattttaatacaaaatcatgctaatatatattggctccctcagtaattggaggaaaaaaaagggaaatatctataagttacaaaacttgttctgttggctctgacttaaagaacactgcaaatgaagatgtataatcgatctgttacg

SEQ ID NO: 55622 - DNA, 510 bp, Oryza sativa
atgtactgttagattaatgtttttctttttgagttttcaaaggctttgaaagttttctggcctaaaaaataagagtttggaggaagagacatctctccaaacaatttttaagaagaaattgtgagcgtgttggagattgaacaaaaaacgtcggggttgaaaccacacactccttgcaacttcaccatcaagtgcatctcaaagttttctggcctaacaacatctagttaatgtgtacaggtattgttgttgatttgtttgctgatgggaagatcatacctcagctacaagaagtaaatttcctctgcatctctttctattcattttttaccagtctatatgctacgttggttgcatcagatttcatgcttttgagcatgtatttcttattccttggatcagttgaatgcatggtcaagcattgatgaaattacttgatatctacatatctttgaggttggaataaattttaatttatctcatgatgtgttgatttattacccctttagt

SEQ ID NO: 55623 - DNA, 1491 bp, Oryza sativa
ccgcaatctttctcatttccggcatacattagaagagagagtaaataaagcgtggaaatatacaaaattgcatgccaatttaaccttataacttagttcatgtgttcgagaaactaagatcagtatacttgaaaaactggtgaaaataattggtcgtagcttgttgagtaaagaccggattttgttccattataaaaaaaattgaaccagtaaatatgaaaagcattgcaagttttgtctaaatgagactgcaagaatcatgatcttacgttaaaagtttaggccggatgcaaatttacatgagattacaacaaacacgacgtcacggcaaacagctaagctcatctttttatagcccaaaaaaactttatagcttgacgaaaaataattctggagaaaacgacccgtacgtacagcggtaaagggaacagctaatcagctaccacacaacacagaatggcaaagccagctagtggataacagaacaaacaagagaagatctgtttgtttaatgtgacgaccatctggccatgtgcaaatggaatctcagcactgtggttctcgtatgctcacctcctaactaatactttccataattttccatgctcaccacaaaggcaaaagaacaaaaaaagcaggaacagattagttaatgctactagctggagtagtaagcactaagcacggacagtaaactgtcaattcttcaaaattaaccattttacatcagctgcagtggcagtaaaaacttttacagtgccacaaacaaaaaggagaagaaattcagccactcgctgaatcactctcacagtcactcaaacaccatcaggagcagttgcattgcagtccaaacaccacctcccctctcttccatccaaaattttacagtgaaaaaaaaatgcacaaactcattgggggaggattaacggtttaaccctcaacagtaaccgggaacaaatcaagagcgctgtacaagtacatctaccacttagacttagcaggcagtgatcaaaacccaaccttaattagtcaagtgattaaccatcactaacgacgccatctactggtataatattcagtaaacctcttcgggaatgctctgcaggccgggctcccactccccgttcgcctgcatccgccgcgccgcctccgccgccctccgcatgctgcgccgccgcagcgactgcagcctctgctcggcgcctgggccgccggcgccgcccgccgcgcgctgacggtgccgctcccccgcggccgtcaccgccgccgccgccgccaccgccccgccgccgccggtgcccgagccgagcgccgcgaccatgtgcttgagctcgcgcttgctgaccacgatcttgacgcgcactgcgccgccgacgtcctcccgcgacaggacgcgcccgccgtggtgcagctgctcgagcgcctccgcagccgccttggactggtggtggtggtgccggccgccggcctcggcctccctggggaagaagc

SEQ ID NO: 55624 - DNA, 1501 bp, Oryza sativa
gtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaacctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaa

SEQ ID NO: 55625 - DNA, 926 bp, Oryza sativa
cctgaaaaggacactaatattatctgcgatatatgctgaaggtttctgacaaaacctcttctcaatattataacggattcatccgattccattcctctgtttacctctgctctgtatacatactccggatagttcaactttatgtacgctaacatatgctaaccgatcacgtggataattaatactactacgtgtctgcatatgcgtaatacctgacggtcgaattaatggcagtgctacagtgttccaccggcaatgtggcgaaaacagtaaggagaacatgccaggggcgctgctgtagctaacaatgtctgtgtcaattgtgccatcctaaccaaatgttcgtagactccacgagtcatcgagtcgtgaggagtgacaacacgttacttgcaaagggcctcccttccgatcgatccaatgatcccggcccccgtctccgcgagagggacggccatgtgaggcgcccatttctctattcaacttcgccatcttgattagtccctgtctcatgattgtttttttgagtgttaattaaaaaaacttcgccctttttattgtcatgtacattaagaagaacttaaccacagaagtggacgtacttttattttttgttagcgtgggggcaggttggggtaggagtcgatggatggcccacctgtcagggagagtgggggtggtacacggttggagttggagacagttgtggctgcgctcaccaaaaggcaaggcaaatgcatcagctcaaggtccccggagtagtatataagtaggttggtgcgtcacattactcggcagcggacacattcactttgccttcgctttagcctttgtgctgtaacttgcaagaaacgtcggagtactcgcttgcgcgcgcccgcggcggcggcggcggcgacgagcgatcgcagcgggtgacgcggaga

SEQ ID NO: 55626 - DNA, 194 bp, Oryza sativa
acacagttggcaaccaaactaggagccggtaccgcaccgcatcgcacctagaacgactcaaggggtcgaatacctgtgggctacgattataaatagtcacttcctatggaaagaactcttcacccaaaaaatttcccgtacaatcgctatagttgaaggcaagagacccttgtaatttccaaaaatattctaga

SEQ ID NO: 55627 - DNA, 218 bp, Oryza sativa
tcgactgcggaagctaagatctctggacatcagacacacaatggtatcttcagttcctaggggtttcggaaagctagaaaatttggttgagatgttggggttcccaaccgatttggatgacagtacacatgattggtgtagcttggaagagctaggatctttgccaaatctcagtgcactacatttggaggttctggaaaaggcaacacttggccaaa

SEQ ID NO: 55628 - DNA, 514 bp, Oryza sativa
cttacatgaatatatatatatatacatgtatatatatatacatatatatatatacatgtatatatatacatatatacatgtatatatatacatatacatatatatatacatatatatatacatgtatatatatatatacatatacatatatatatatacatatatatatatacatgtatatatatacacacatacatatacatatatatacacatatacatatatatatatatatatatatatatatatatatatatatatatatatatatatatatatatagagtgcataggactacaagcatttgcaccaaattggtatagggatattaagtctaaaagggatatagaaaaaattattcaaagattagaagatatccaaattataggagaaattcctatgaaatattgggaaaaaaatgctattgagtgcaaaattaatataataaacccagagtatattattaagactagcccaatagaagcaactccgaaagacatagaagaatttaaga

SEQ ID NO: 55629 - DNA, 210 bp, Oryza sativa
ttcttctcccctctctcccttcccctcatgttgctcagccacgacagcgatgccaaccttcatcgccaccccacatctccaacctctcatcgacccaaaaactttgttaccatgatccataccatctaaatacataaagccaattatggtcacattttccatcttcttcccaattcttttttcttcttctcccctctctcccttccctca

SEQ ID NO: 55630 - DNA, 1501 bp, Oryza sativa
ggcgtcgtacgtagtacaaattagtcgtcgtactcgtaccctcaattgccccaaccccgcaccgtcgtctcttcgttttcccatcgcagcggtgttttgctcgtcgtttttcctctcgatcggcccttgaccagcttgcgctcaactttcgtggtttattagtccaaaagttatgtccacttctcggtgccgccatgtgggtggttggtctaccaaagttcgggaaactattttgatcactcgatgggatatccctcatttgcttaaaaattatttaaatagttacttcctccattccaaaatactcccaccgtattaataaagatagtcgtttaggacaatgtttaagtcaaaccttggaaatataaatcatgaataactcttaaattgttgagtttgaaaatttaaaaattatatgaatagatttgtcttgaaaaatactttcataaaagtatacatatatcacttttcaataaatatttttatagaaataagaagtcaaagttgtattttagagaccgtgtcgctgtccaaaacgacttcctttatgagtacggagggagtaaaaggctcaaccactcttaatctaaagaccaagaaataattattatcatctcatagtttggatcactcatgcaaccaatagaattaaatatattgagtatggaggattcgaaagaaaatgctagttaatggcatgtattcatgtattccttaattatattatgaaacatttaaaaaaaatagttgcgccttatataatggaatggagggagtataaaaaattgtggaaaaatttaataacacttatacaacatatctatataaccccacaaaatattaagttcaaactcaactcatatatcgagatataaaaatatcagcatatgaatagtattatacggatcacatctgaatttttcactaaagccgagtatttaaacttaatttttattacctatcgattttactatatactttatattatcaattttttataattttttttaactatttgtatcgaatttgaaaggaaaaaaacacaggaatatctcttcgagggattaaaattcactcccactaagtcgtggtttcctcccagctgccaggctagctcgctagttgcactgtgtcgccggcgcgtcgcagatcctatcattcccaattcccacgcggtcgctgagctcagtttcacagttttcacacatatgtacaattgacagccacaagctctaattttggttaattaatcaatttcctatttatttcatggcatgtaggagtaagtgtgtgttcagtgatggctatcggtgggtgggtggggtgtactactcccctataaagggaagctcgcgtcgccagaacttgggcactaccaccactcgcctcacactcactcgctcagcactacttgcaccccctagctgagatcagtagtaaacggtcagtcaattgttgcaaagcgatcagctactggcgatggctcagggaaggggcagtg

SEQ ID NO: 55631 - DNA, 824 bp, Oryza sativa
gcacctacacggtgggatgtgtgggcgttttgtggctacacggtggtggtggtgccgtgtggctggaggctgggcgggtttctggtagcggctaaccgggtatcggttgcaaaagaagggttacacataggttgattttttgttccaaacttaaaggctggttagctcgattaagagcatcttaataatattattgtaatctagattatttagctatatcactataagctggattataataagcataacctttatgtctcttaattagtagctatttgttagctgttagctatccaataattttttaaaaaatcatctttaaagtggattatcagattatagtagtatggcttatagattgtaataatctatcataataagctatctatttgtttcagtttactcataataatcctaaactaaatcaaacagggtcttagcaggtttttaacttattattgtttaactcgataggtttggagtaaagttgtggaacagtgtaaaatcctgttccatctttattttctgaaagcattttagcttgctctactttcttttcgagtggattgcagctttagaagaggggggcaaacttaaaagaactctaaacatttaatcatgtaaaaagataataaacatagatgcttaggtttaaaataacacaatatgtattctatgctatatcatgaaaatatgaaaaccagactaaaaatattaatgttttcacttaaactaatgttgattgattaaacatgcacactattaatgttgacaaataaaattgtgagaccgactatattggatttgtttgtatgcatgtacga

SEQ ID NO: 55632 - DNA, 1501 bp, Oryza sativa
ctgatgagactatcctttgcccagttgacactttcacaaaccacaaaccagatgcgaccatacgagccaattagccaaaccactttaccactcaaacaatgcttatcactgtatatattaatcctactagtatactaatcaccagctcactgaaccgagccggccgaaccagcccgatcagaccggagtaagaccggagactaagaccggactgagagggtatgtttgcagaagttttcgtagctgcagtttcttctaaaatcctcagctgctagaggctctcttaaacaatttaggttcttatttagattttaagaaattatagttgtagaattcataaaatgaattagaaactagaagaagctgagtttcctagcttatccaaattattaccaactactacatccgtcatattttaaatgcaaccataagtttccgtacctaactttttataattagtatttttattattataagataataaaatatgaatagtactttatgcatgacttatgtttttaatttttttaaaaaataaataagacaagcgatcaaagctaggtacaagactgcacgacaaaggagcttctcattagctgtttttttctctcttttaaattgagttttttttagtacatagggagtagaatttaagcttgcgaatagactaaggggctgtttgggagagaggggctaaactctctctctctctctctaaaaaaaaaagaagttcctatcccaaacaccccctaaaccggaccggagtcacaggaggagtagagcgtgcagccgcgaccggtcgtccggcccggtaccacccgacagattccttgtctaaactgtacttgcattccattcccccccacatccacaagaccacaaccacaaccccccttctcctctcagatccgcgtcgcggcggccccaaatcccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgaggcacgctctctttctaaaccctagctgttcctggccagatgcccagatctgtggcggaattgaccgggtttcttgggttgtcttctccttctctttgctgcagatgatcgtggaggcgatcgcgtcgctggcggaggagaacgggtctagccaggccgccatcgcgcgccgcatcgaggcggcccgcggcggcggcggcctcctcccgccgtcgcaccccgcgctcgtcgcggcgcacctctcccggatgtcagccgccggggagctcgtcgccgtcgcgggtgggaagtacgcgctccgcccgactcctccgccgccgccgccggcggatccggcggcggcggcggcggtggcggaggaggaggaggaggaggaggagttcctcgccgatgatgactcgg

SEQ ID NO: 55633 - DNA, 1248 bp, Oryza sativa
ggggggtggtgtttggttagaggagatcgcacggagggggactgaccgctctgtcggtttttttggtaattttgggtgcgtctgagccaaccgttcgggcaagagctcgtaaaccctccctgccctaaaaatattttcagctcactgtactaaaaataaatttatttttaataattattatattagagtagagtactagacagatctatattgtttattggaatttaacgaaatagggtaatctagttcttttgtttttttaaagtatggaatagataaaattgaatttattttaggacggtggaggtagtacttcggttcaaaactactccaatgctatggctcatattgatatatgaattttgaactagtaaacaattgaaatgttacgtaagcatgatcaatagataatatgcccaatagtagcatgaccccgcctcctttccttcacagcgttcggcgtcctatgcatccaaagtcattgtgttttggcggtggaatacataagtaaacaataagtaaacaatatgttagtatttagttatgcaaaacattgttgccaagacttactcaactcacgactttcacctgcttccggtgataattaccactatcatataaatgggagagtagagtaccaagatatagggattagctagcagatacggtttatttattacctttacttgataaaacatgagaggtgtaccaccttttgcctaaagtaaagaattcaaacgtttgcgacccaatttaatagcgccagggatgatttaaacacatccttagtggaacaacggcttcactcctaaaatgaaatcattaagaacccacgctcaatctctccacattgttagtccctcatgcagctttgaattaaatatatgatgtggcctcgctcattttttaagggttgtgtatgggctcttccctatatccgcaaagagtttagtttaaaactattgtgtctgtttgatcctaagctgcaaatgagtggaatttgatgttgaatttcaatcataaacttttgagagcaggaggttttgcctcaactcaatccatgaatgttatttcatttccgctgaattcaactcagtcttcatcctaccctagagttatctctcaaagttgaagctaggaggtatttgatttattggatttcgagccccttttcttgctccttgccattagcgcaaccctttttattttcttagctttatttgaagtatggtttgttacctgaaaaga

SEQ ID NO: 55634 - DNA, 220 bp, Oryza sativa
gcttgcatgaagcgggttcgatttttctcttttgctcggacgacacatgggaagcaatttccgaactttggataatgggatggtaaaatcttttcccaccttctaaaatggtaatttttaatcttaaccatccattcttcatatctcatctcaaccccccactcatatccctatcccaatctcacccctcttactccattatctaaggctgcaggtaaaa

SEQ ID NO: 55635 - DNA, 431 bp, Oryza sativa
actggcatttttaggagaaatattaatattgccaaagctatatagtgtttaagataataggttataaaactaaatttgagatccagaatagacccaccaatatccaaattccaaccttacaaaccaaaaccccccacaggaatattggatatgagatgatttcatcttcttttctttctctaatttattcgattgcattagcaactttcgcagatgcagtaggctagaagccagtgaaagatgccctgagatactcctggtaagtgatactcctaatttctttctggtttaagtacgacacaaagggcataaaattcaagtgattattactccggtagtcaagaataaagagcataagtttgatcttatcagagtgaggacttggggtttagtgatctttataaccttctaattaccctaaatttacttca

SEQ ID NO: 55636 - DNA, 338 bp, Oryza sativa
cctgcagccctgttcaatcattctctctgtgagaatagaactactgcagagatccaataagagcgggtgagcaatcgatgcttatttagtcgctcgctttcactctctttccattcattcctactccagctcgtcaatttctccagcatggatgcagtgtagccaacaaaaacgatctattgtacctgctgtatcactctatccaccatccctccccctctccgtagccagttctgcatctcgccttgcagctactcaaggttatatgaggtatcaaaacgagccgaggggaaaatagaagaaaggccaaaccagttgtttttaaaacagagcacaga

SEQ ID NO: 55637 - DNA, 619 bp, Oryza sativa
ctgtttttattgtgtttcataaaattatcaaaaataattgctactaccctccatcaatgcttgcatgcatgcattttatcggtctttaaaatgatttttcttctaaactacttatccaatctatgattcgattacaccgttgtattcgttgtaattaaatctttataataaaatatcacacgattaaattttgatgaaagaaaaatatatgtttcaatctattaactcttattgtttcataagtgatagcaatatgtttcaacgtgtatcttcactgtgtttcataaattttttaaatgttttagttgctgtttttttgtttcaccatatataaattaatgtttcacttgttggtcagctgcaacattttgaccgaccgatgttttttttgatatatcggacgttcgattggtagtattctccccaaagttccaaacacaccctagttgtttttttgtttcaaccgggctggggttgggaggagatggaacagatggagaccgagccaccaaaaagcccaaacctgtaacaacaccccactgacccagcagcgtaataggcctcttgcctccttgcgttgcgacccagccccctgtcccctggcctcccctcctccagc

SEQ ID NO: 55638 - DNA, 211 bp, Oryza sativa
ggccgaggcaagtggagctgcgccgggactgcccttacctcgacaccgtgaaccgccaggtatggcttttagcagcagcagcgtttcaggtccaattttttagacattctgtgtgatcgattgatgtgaataacctcgatgaaatatagtttttcattatgttcacgatctccaatttacttgggatccaccatttacgcctagcagtaaa

SEQ ID NO: 55639 - DNA, 193 bp, Oryza sativa
gatcgattcgtgctgttgccgtgcgtttctggttcttgatttgattcgccttgttgccgttactgcgggtgcctattgattgatttggccggttcttgaggaatgaggtttctagtcgcgccgctggttcttgactatgattatgatatggtctaatcaatctcttgattttttttttgtttttctcagcagg

SEQ ID NO: 55640 - DNA, 1501 bp, Oryza sativa
aagaggaaataactaatactacaatacgtaaagggcagaaacagatctgctgctgtgtctaaaattttaagcttcaatccctaaagctcttccggtactgacaaaatcataaacatttgacaaaaaaggaagaaagatgaaactttggatcgtttcagcagagattcatagcaacaagttaacctcaaggaactgacccagaaacacataagtagtacatcagaacttgacttcaagcagcatcaggtaacataacccagaaattcacaagtacagcacaacaacagaactgaacccagatttactagcatcaggacttcaggattcaacagttcaaaagccaaatctggatttcccccacacaaggatgtaaaattttacagctgcaggccttggatattcgtcaaagatatctcaaagcaacataaagattgtcatctaaattggaaaaatgtcttctgaaaaacatgaatgtgttatcaacaacaagtttggtctattcacagtattagctattccattcattcatcacctagaataaatccgggcaaaattgttgacctgtcagagtaggaaagggctgaaacctgcataagcctactgatttctaccaacaattagagcaccaaggcaatttacacgcagccccgaatcctccaaaaaaaaacacaagatagccaacaagaaatcgccaagaaccgctctccagagcctagaaactgacgatgacgatcgacgagaactcatcaagaactcgtcaagaaccaagaactgacccatgatcgggagggcggcgacgctgccatctcaagaattcagagcaggcttggtgcgcggcggcgaggtccccggcgactgcgtggtgacccaggcgttgcagacggggcagcgcggcgagatggtgagccaccggtcgacgcagtcctggtgaaaggcgcggctgcatccggggaggacgcgcacggcgcgcccggcctccatgccgtcgaggcagatcgggcagagctgctcctcctcctcttcctcgccatccccggccaccgccacgcagatcccgcccagcatcctcagctcctcctccgagagcccgttcttgtcgtcctcctccgtctccggcgtgcagggcggcgtcggcggcggcggcgggtccggaggcggcccccgcgccacggcctggaacaggtagcagagccagacgcccagcaccccgagcatcccgatggccagcgacgccacgcccacgtacagcgcccagagctcctggctctccatcccccctctctctctctctctctctctctctctctctctctctctctctctctctctccccctctgcacagagcaattcgttggtttgatcggaggcgaggcagttgctagccgtagcgatggcgatggcggtggcgcgctggacgttttataggtgaggccgtcgcggtgccgatctaatgggcctcagaggccgggaaagtctaggcccacaagctctcagtcaagg

SEQ ID NO: 55641 - DNA, 460 bp, Oryza sativa
ccatgtacgacgccgacgacatccttgacctcttccgcgccatggagggcggagaagaccccggctcagcgccgagagctgctccggcgccgtcggcgtgctggagcgccctctgccgccgcagccctgccgctacgcgcaagatcgggaggaagatccaggagctcaaccggagggtggaggagatcgcgaagaggagctcccgcttggatttgtctcccaagtaatccactcctcctcggcccttcgtctaaccgatagacccatgtgttcttgctcgtcagaaagcagccgcaaccgcaagacgggaccatccatcattcgatccgatgttgtcggcgacaagatagatcttcacacaaggaacctcgttgatctgctgattggcaacaagctggcggatggtcgcacgcgcgcaagatcgtcaggcgatgtcatcgccgtcgctatcaccggcgct

SEQ ID NO: 55642 - DNA, 1501 bp, Oryza sativa
tcaagctactagggagtagaaagggagcacacacacatgatgctcggttgacgaaagcgatggtgaattggtgatctgtccaatattgtacaacgaatccatcatacctggtttcccacgaacgggatgcaaacggaaccgaagctaacataggacacacgagtttcatttgttgtgttgctccacgtcgcgtcgcctccagatatatagaatcccattcgcatgccatatgttctgtacttgctgtcttgcttctgtttgcttttgaggcccaccctaacatgttacttagctggtggcctgatcagatatggtgctaatcgctgcaccctgatttggaccgactaaacgtttttttgttcgtttcctacatgcctgccaaacagaacaaagatagctgtttgcacagtccattccaaatcttggccgtgctcccatgccagtgcatgtctttatgacgaaatgatgaccatctatctaaatcacgagattatatgacagtaaccaagaaacggacatgccaatggagtgtttaggcaagagacggaactgaaagcagagatcacatgttgctcgtgtatatggatcgtttttttgcgtctatggagcgaaacttttctctgaaacatggccggcacaaacacaaccgccacgaccgtgtgatccacattcaccaagaccgtgagatccatcacagcaatcccacaatcacgaccgtgagttccacaattaccaagaccttgagatcagtcagcaccacagtgccactgccacccacaaatcaccacaaccctgagatccatcaccaagatgctaaacttttcccgtcgccgttacccaatacaaaaatggccactagccacagcagttcacgttctcaccacacagcctttttagtgccctgattatataatcttcctcgttaatcacagtttctaaatcttagttaccgaatgctaattccacttacaatcatttttatttctttacaaaatgctaattgcgacacgcactcccgaatccccgccgctagtctcgcccacagaagattcgaacacatacagaattacacggaccacaatcgtttggttaccactaatcacatattctaattgatcctgttcctgatcatgtaccgaacacctgccatgccatgccacgtacgtggagtggccaccaaaccccgcgccgctcgttgccgccggcgcgagtggctgtgccggtacacggaagacgcggcttccgtgcgcgccccgatgcgggggtggcggaaaggaggacaagcgttggcagctagctgcgcgcctccacgttgttccggaacgttccatcgcatcgttaactgaaacgagaggcagtattaatcccctagttaaactctggctaagtatagcagagacgccggccgagaggagtggggggagagggaggaggaggaggagagtggctactagtactagctatctttggagtgggcgtttcttggccggcggcgatggag

SEQ ID NO: 55643 - DNA, 251 bp, Oryza sativa
cctgcagccctcccctgtgtttagcttactcggtcagtgagttcgtcaacctaccacaaagctgaatttcttttttaattaacgatagtagaaaagaatataaaagtataacctgaatatttttattttgaaaaaaaatggattggaaaaccatgtgtttatatctagaccgaatatacgcagccacgaaaaacagtgattaaaaaagagaacaaaacaccaccacacgccgagttttttttttccatagt

SEQ ID NO: 55644 - DNA, 466 bp, Oryza sativa
atagatccaactcagtaaaggagcaatattgttatagattaaaccagagtaaaattgggtattacaaagtactgtaattacagatccaactcagtaaaggttttcaaactttggttctggttattctgaagttcagaattttggagcacgcctgaggtccaaaactccaaattactttggaggacaaaatttgaaatgcatctaaactatttcagtatttggttgagatcaatatgttgtcctggatgaaagtcatgacccttgtaaagcatagagaaattatttaatcaaaatcatttcaaacaaatatttgcagttgagacatcaggacaagatggtatcctgtttcagaaaaaaaaatagagagcatagttgaccatactttatgcatgcatatcccaactcccggaaacgctggaacagatgagaagttggagggcattgaggataatctctggaacgcagg

SEQ ID NO: 55645 - DNA, 313 bp, Oryza sativa
ctttcataaatatgtaaagctatatgtatacatataattatatttaataatgaatcaaatgataagaaaagaattaataattactttttttaataagatgaacagtcaaacatatttaaaaaaattaaatatttagaaacggatggagtattaatcaagtcagggccatcgaggaatgagatcacgcgcgccggaggtgatcggtgaacaggaggtagcttgccggcggcgggcgtctcgccgtcgccggagcttgctctgatcagtgccacccacctaatcccggacttgtgaattccggcccatccacagg

SEQ ID NO: 55646 - DNA, 415 bp, Oryza sativa
tgtcgagctacggatacccaactccaagaaaccttggttctgaagttgtgcaaaaagggtcataataaaataatagtcatttgcatgttgtacacttttatcaaattcaagtgtttggctagaacttacgattagaggtgggtattcggtttttccggtttaatcgcctcggtttgatggctccctaaaagatcggtttctgtagaatgacaaccgaagagcgtacgaataaaacaaaaaccgagaaaaaaaaagaccaaacaaaattggtttggatttttcggggttcagtttttaccgactaaatgtatgcctcgatctcccatcctcccatcatgcaaagctagccatgggcccaaaggtcgtgggctccaccacccacgcccacaagataaagcaaaattacgtgaaacaa

SEQ ID NO: 55647 - DNA, 473 bp, Oryza sativa
gttaatctatgctgcttttataggaagattatcggtgatttgctttatgttgtttggggtgggttcccagcatagaaagtgaatgtgtgattcttgaatgattatatgtgtgttgtttgaggctgagtcggtgtttattcaggtgataccacttcggaatgcaactagagttcatctcgtcatcggtaaaggcaagtaaatgtagcggtggtttgctacagctttaacctgttattttcctaccttcactttaaaattatatatcaataaccaataatcaagatagtattacaggtcgtagcaaggttttacctatctgaatcattgcttatcgttattgcactgtttatggttatactttatgctcttggttataataaccttatactggtctccatctaaggaatgtggtttcgatgttatactctggaattcatactgcatttgcatcacacttgcattgcatttgaagt

SEQ ID NO: 55648 - DNA, 766 bp, Oryza sativa
agaaccgaatcgaatgcaacaagttttgcatttgttctgtttggttccatgtgcatctctttcctatgaggccaaggagcgtgatatatgtgtttgaacttattgtacactgctgttgattgtcattttattccctacaaacggttagtggacagtaaatacccgagagactataaataattgaaaagattttatcatagcctcaagattagttgttcacatccacgctaaagagaaattgtattcaaaacttaagaagcgtcgagcccaaaagtttgccatttatttttttttgagagacacttcttttgttcttgaaaacatttttttttaattttttttgttcaccaaatttttgtttaagcaaaatctcatacagggctgatgtaaaattgcatgaacataatcaaaagatggtgtgctcctcctttgcatgttagcaatttactgatttgtttcccgggccctgacttacctccaatgagaattgaacttgaggactcacctgtcagtttgaaaactttcctgtaggggttagtccacagaagatatatatccaatgtcgatgaacatattaactctgatggttcattaatcaatctcaactccatgtctaatttgattaaagcaaacaattttaacctaagcaccatgcttaatttaaaaagtctatggaaatacccaaaccagagtatatgaaaatagacaaggtaaacataatcatgtatgatcaagccatattcacatggtgatattattgagtaaa

SEQ ID NO: 55649 - DNA, 1501 bp, Oryza sativa
tatataaaatcaaaataaggggaatatttcctatagaaaaggaatgagtaacacatttcatgaaaaatttattttagaaaatattgtaatgtattttcttttatccgtagcaaaacatatatattcaattagtagataaaaacaaattggcagtactgaaatttgcatgtgttgacattgctaatattttgtcatggtagcaaactaaataagcccaccatcttgccaaaattttgtttaaagagtggccacgtcttaggcaagatagtaaatattaaaccatggcatgattgaatagctgcttttaaaaagttaggaaagtatagtagaaattaagcaaacaccctatgcttctgttgtgtcaatgatttcttaagacagatttttgatggtacaccaaagcttcagtgtagaggattaggattagtgactttaattagacatgttgttttgcgtcgtgacggaggttcaaacgtcccaacgtcaagaaaactaacttcccaactttagcaattgattgcatgctgctctctttgaagtttggaccatacatacatacatacatacatacatacatacatacatatatatatatatatatatatatatatatatatatatatatataataagctaaaattggaacgatgtgatgaaaaagttgaaagtttatgtgtagaaagttttgatgtgatgtaaaagttggaagtttgaagaaaaaagttgggaactaaactaggccttaggtttaaaaaaattgcaagtcaagatttaaaacttttaacttagttttaaaaactttcaagtgaagattttaaaccttaactcaaatttaaaaacttttaactaaaattttgaaagctttttggatttgaaacaaaatcagatcaatatttgaaaaatatcaactcaggtatgaaaacttttaaatcaaaattaaaaactttcatcttaaaattcagaacgttcaaataaaatttgaaaactttcataccaaaattcaaaatattcaactcaaatttaaaaaaactatcaactgaaattggagatgagaatatttaatttctaaactaaaaaaatagtgaaaaaagtcaaaaaccgcgtctggtcaattagctttggaaagagtacgaattaccccctcacccaccccgtactatcgtggttgaccgaattaccccctaaactcaaaaaccagatatctctcaccatgaacttttaataccggataagttacccccctcgatccaatccattgtaagcaaagaagtcatctaaactcgaatattggatttcaaatcccgtctggttttcgcgcctcgatcaatgaaatctcactctaatactgaaactttcaggctctcgaaacactcacttcatagcacataatatgctatggtccttcaacccttcacaaccaagactatcgacgactcaacaagaaaagaaattgacaacattaaatattttttacataataacaaattttattgaagttaat

SEQ ID NO: 55650 - DNA, 1501 bp, Oryza sativa
cgaggaccgccgcccgccatgaccgctccgaggacgacgcgccgccgccgcccgccatgaccactccgatgaccactccaaggacgacgaccacgagcatgagcacgaggacgcgcgcgccgctccactccagaatccgccagccgccgttgtcccctcgcgccgccgccgctccagatccgcgccgccgccgtcctcctcgctccgccttctggtcgccaccgagagattcgcggggacggcacgcgcccccgtgggcgacgacgacctgtaccgccgcgcgctccggctctgtcgggtcggtgggagtgaaagtaggagagggaaagggaaaaggagagaaaggggaaagcgggagagagaataggttggggtggttggtttggggatcgtaccctgcactgtgagaggtatggattcgttgtgtatctatcctacgtggcatacgaggtaacgcaaatgaggtgcttgcactgtgaatggccttaggccgttactcacagcgtctaggggttgctaattggcgctcgagctcactctccccacgcatttttttgccatctttttcgcttcctcccctcacgcgtatttccttttttttccttatacttttaatcgttagcacacgtgttttcaaaaatatttgagccgaaagtttccaaatgttaacttacaagtttttcattttgaagaaactttcaaatctcgagttgaaaattttcaaatctaattttaaagttttcaaaatttttcgtataaatttaaattttgatttgaaaattttcaaagtttcagttgaaagtttttaaaattcaacttcaaagtttaaatcttaagtcgaaagtttttaaatctaacataaaagtttttaatctgttagtaaaaaaaatcttccaaaaaagaaaaatcttatcttaattatcgtcattatctaaaactaattcagttagttaggagtctaaaactaattcaattagttaggctgctcccggaaacgtgcgcgatttagcttttccggcgtctcaagtgtggaccaaaataggtttctagatgcacagatttccccaaaataggtgtgaactttgttatcggagtacactagtttgctttcagaattagtccacttctaatccctcaaaatatagatccaattctatttatatccctcaaccgtaaccgtggatatcttgatccccaaacttttaaaaccaatgcaaaatgactccctcagtggttttgaaggtgtttttcattgacctagtccaaccacgtaagttaacatataaagtccacatgtcagtgactcctttccttccttacttcactctttcccatatttcctttgcacggtggtttacttttgtggttggttactagcgatattatgagcattatctcattctcctgagtagactactttttttctatatctaatccttttaagaagtaatcgaacgggtggagaaagaccatcaagttcttcgatatgatatggtttttt

SEQ ID NO: 55651 - DNA, 815 bp, Oryza sativa
tccctccctcccctttcccatccaaaccccacaaaaccgcgacgaggagaccccgccgcgacgcacccgcagctccgccgggggggggggggggggggagcaacgccgccgtggagtcccctgccacccacgaggttcgtccgatctgcgccccacacacccgccgtcgtacattcacgctcgccgggtgcgggggtttgggttagagtagggaagggaaggcgttggtttggtcgcggggggagcaaggtgggggtaggctgggcgattcactattccggtgattattctgttctgccctaggatcaaccgggagtcgggacggttttgggcggggatctggtcacctgggtgcctcgggggcgtggagctggtgtttttagcccgcgtgcgggtggtaccagcagatacctgcgtagtcgtgttgcttaggtgatttcatctccgtgttcatctgatgtgaaatcccagggatgtgtttatcacctcttaactttgaatatactaaagtctgtgatcaagtgagttttcccgcgaggaatttgtgttgtagtcttgacttatttgtaagggaataagcctattgttttactgtgatgtgtgatctggtacagtaggttggtgttgcgatagccaaatgatgctaagtagaagaggagtaggcacttcccatttttgtttggtttcacgccgaaccctattaaccgacatacttctcaattcctactctgatggtgtttcttgctacttcacctgtttttgttctactagggttcctggtgcctacttggtctgaatggctgacctgaccgaca

SEQ ID NO: 55652 - DNA, 665 bp, Oryza sativa
cttccagattcattgtctaggtgatgtcaaatcaccacctatgttaccctttttaggagagggagtaaaaattaacaacgccatctattaaaaaacagatgtagtattcgagtggaggcaatgtgttatatgcattaccccttaattaataactactccataagattattggtgattatagctccgatatatgagtttttttcttttattcgctgatggatgagtcaccaacccaagaagatcacagagttgacaacacgaacctcctctcgtagtaatcctctctcgcctcgtgcccatcccctcgggtggcccccaccggaaatcccacggcgtgacagcccgcccaatggcattccgcccctccggattccgcgccccccgccagccaatcaccttccagataaccgtcctcccgggccccacctcctccccccgtcccgccacgtggcgcaaaagcgtgttcacgggccccacctccctgtcagccgacccgcactgtcgctgacgtgtgggcccgggggtcaggacccgagtccgcgattttataaaggaaacggctcgggcgctcgcccttacactactgttcccatttttttttgttaaccgcgaaaagtgttgtgttgtttgggtaggcagggtgttcgacggaatggcgagcgccg

SEQ ID NO: 55653 - DNA, 1501 bp, Oryza sativa
tgtttttggaaaaaaaataggaactaaacaaggccttaactatttgcaattttaaatttaatgtttaatcatttgtcacacacgtgttgatatatgaggacgagtctacggctcgggcacccgattggtttggaaaaaaatcgggcgctgacgtcagcgtatgatttacgtgcaaaactattttaaactgatttttctcttaaattacttatccaaatcatgatccgattgcaccattaaatttattgcaattaaatcttcaaaacaagaccatacatggatatatttcgacgggaaaaaaatagtttattattgaattatttttaaatgttgcacgatgttccaccagatatatcggaatgtttcactcatttaaattgggtgttgtttcaccttatataaaaacaatgtttcagcaaatagcgaaagaatgtttcagtttactacaacatttgatccatacatagtgaaatattataagtacacaagatgaaatatttttcggtggaacaaaaaataaataaattgaattcccttaatagggggtttcaaaatatgtaggttttttttgttgcaatggagtatttcagtttactgtaacattagacctatacattgtgaaacattgtgagtatactaggtgaaacattttttatgaaacaaaaaataaaccaaatttccttaatagagggtttctaaaatatgtaggtgatttgttgcaatggagttgcgtgtgtggataagtggccggtggggacaggggatatgtggtggggacccaggtgcgcacgtgatggggggagggggaagcgaccgattttttcccctccccccgcacgccccacgttgagcattctcggatatatgacgtctggttttagttaattgttacagacttacatgtaagagtgaaaaatagtttaaatattccggtgaaaactggtaaaagcagacagtagctacgatattttcgtagcattttttctagtttacaattacattgttcatggctcttcattcgcaacacacatctataattatatctgcttgacatatgtctaaataaacgaaagccagcagtaaatccttaaccgtatatgtaattatggatttgttgataaatttatactgcagattttgtttgaacatatataaaatctatacgtgagttgtaaagcagatcttgctcgtttccttgtagtatcatcgatgtcttagatagagcaattgttccaagtaatttcagtagatcctttgaaccttaaaaatcgatcggtagatcttctttactcctattgcatataagaggaagccaaagcaacaaagctcgttctcatcgatttaaacttgggtttcaactttgaaaaggctgatctcttggcgttgatgccaccattctgcgtgtattgtatgccgtcttacctctccattaactggtgtatactgtgtataatacataattacacacataaacacatcaactgctgtaagcctgtaattg

SEQ ID NO: 55654 - DNA, 1501 bp, Oryza sativa
caatattggacagatcaccaattcaccatcgctttcgtcaaccgagcatcatgtgtgtgtgctccctttctactccctagtagcttgacttgagacctaaaaaaagcacagttcctacctcgcatatgttcctagatatgctcaccacatcaataccggtaaagaagaacgatacgtgtacgtgcgaaatctcgcgacagacagataagtgcggtcatacgcaagagagacgacctgcaggcaacgaaaagctgctgcaattttttttttcgtctgtatatttactgttcagtaaacgcgcacggcctgagctggctcgtagcaggtcaatccaacgaccgcgacgaggccctgagatttcagttcacaccacggtgccagctactttacgcctcggccggctatgcagcctccctccggcaactgcaaggatgtacagtacgtgcgctgctagattgcgccttcgtctcgtttcataccggccggtgacgcggcagcgcgagcggccatggcgctctgcatgcgcaaggggaggacggtacagttgtatgggccaaaccagagtaccagacacgcgccggctgtcgcgtggcgtgtttccgcggaaatcgtagtagtaggtgtgcgtgttcggctgttcggttttggcggcttgccgtcgacagtgatgtgcccatgcactgcgcgacgcgcctggtgttttcagatgtattttctgtcctccgtttttttggcctctcgtggcgtcgtctatcacgtaaactaggctcgcgcgttacgtcgtgagttgttacttgttagcttcgcgtttgtagagttcaacgagaggacaacacgaacttgcaagcagttaaggcagaccaaaaagaaggataggcatgcgggcagtcgggcacgcacaccagtcgggagtatttatcaagtatcatgcaaatgaaaaggaggtatatgcttcgtcagagccaggtgagcccggtcaggtagaaaggagattagcactttaactactgtgataggattggacgaatgtaaaagaataattaaagggataccctctccgttgtaggttacaacacgctttgactttgattaaaatcaaactactttaaattcgactaaatttataaataagtagtttcattaaatcgataattaaatatatttttataataaatttatcttaggttgaaaatattttttttacaagtttagtcaagcttgaatcagtttgactttaactaaagttaaaacatcttataacctgaaatagaggtagtaattatttacatgatgaaaaatttaaaagtaatccatagttacagtttagagtgttgtttcggtccttctttttgtaccacgtggtactagtaccatgagatactaaaatcctgaccgttgttggtcattggtgtggttagcgcgagagagccacggtggaagggtataatcgtaaatggagggatttttggatcggtgcaaggtttggctgagttggggaagc

SEQ ID NO: 55655 - DNA, 1501 bp, Oryza sativa
cactcatgcatgagactgacagccacattcataattttgatgtcatttcagatgtgagaaatccgaaaagcattgttaaaattgatatgttaaattgcaggtagcaaagtacagctcagacataatatagtcaacagtgatacatatactctgaaatcttgtacataagaattacaataacaactagggaacccatgaaccaacttctagcgtggtctgcctcttttttgagctttgaaatttttttcttatatgttgcttcggtagccaaaatcctggcagccatctcaaattcaagtttcattttgtcttcctcaactttcgctctatcaatatagttagaccattcatattgccgcctggttggatttgtcatgctagtacgatccaatgcaagccaaagcttctcgaatgccttctgcactcttggatgccatcttggtctacccagattaaagtatcgcattggtcaacctcctgtaacattggttatttcatagtattattatgcaaattttcttgcagcgaaacaatggtgaacatactcaaatccggtcaaacaaaaaacgaacagcagaataaaatcaaacaaaagcttactggccactgcggcggatggcgcagaggatggcgccggccttgcagctgctgcgccggccacggcggcggcgaaccttgaagcgtatggcaccggcccttgcagctgcaccgccggccactgcggcggcggaccttgcagcggcggcggcgacgactcctgcggccgcggcgctgccaggatgtcaccacccgtacggcgacggttacagaagcgctcgccctcctcctcagatgaacacccgtgcggcggcgctagcgtgagatgcgatgggcgacggtatcgtgagatgcgatggggatgacctaaacgaagccgcacgtagctagaaacgttgggaccccacaccggagcgaacctcgcgcatactcccatccccatcgtacccctcagcaatcaacggccggatgaagactggtacctcatggtactggtaccgtgcggtacaaaacgatggacgagagaaaatctatacagtttaagggcatgttcactttgatgtcattttcaaccataccattatttgtcaaagttgcaaaaaaaatatatacgtttagtttgttgccaaatttgaccaatacataagaaatcctgccaaaattttggcaatattgccgtcttgctataattttggtattgccaaaacttgtaaggttcattttggctacaatctgaatatgccataaatcagaaagctaaaattgtcaaatattaagaaagatattgccgctagcctgctacactccttcctatccatacattatcgtacttataccaatttgttccttaagagaatagagaattgaagtaggaacaacttgagattggatgccaaaaaagcttacgctggaggatctatttgactagaggcggaaaaccctaatgcaccggcgcatgcaacca

SEQ ID NO: 55656 - DNA, 1501 bp, Oryza sativa
cgatttgaggacgaatttcagtctcagcgacataaatgaggggccaaaaataaacttaggctgacgttcgtaggtgggtcgaggcggaatacggagtgaaatttacgcccgcatattggcttccgagttaagtttggaagaatcacaggcaggccacagcccacgacatcccctatcgtcaattggacggactctgcaattttcagtgggtcaccaagcccatcatccgttccagttgcgttttattgagtttggaatgtagggctgttttggattgatgaaaaaaaaaagtgcccctctgaatagtaaatacgatatttcactttgtagataaaattattggcattgacgacaaccaatttatcaccaatctagggtgtgttcgggagtaggggttgggaattttcccttgggcacagaaaacagggtgatgatgaattaacgcataattacttgcgtattagtttaaaaacttgaaaaccgattaatattattttaaaagtaacttttctatagaaaaattttataatttgaaaaacatatacgtgaaaaatgaggatagaacttagaaatgtaaattagtatatggaccatagtaaaatatataggagcaacagtcttgaaggatacagttcttccgatatttctagtactagtacatcaaaaaaatgccgatccttctctgatactcccctgcacttcagtagttctgttcggttcagggttgagacttcaactgtcgttgaggctcagctactaccaaacatagatctaatctccctagtaatcaagagtgcgctaagctatttcccccactgaagaagcaaacttccagcaccaaatgcagaaagagccaagcaagattatcccagcttttcccagaagcaagaccaacggtgtccgtattccacgagtaaacagagttccagggctgcaagctacaaaagacccaatcagcgagcagtagctccgaaagtagagtggagtgcactctaaaaaacacatcagtacatcatccatcactcgcatgttagctctagtgctctgttgcagcgccatgcgtacaagccaccggcaccacactaaccaatcaccatcggcagcgacaacttagctagctccagtaatcacaggttctcgtcctcagatcactctctcaggctcccagctgcaacaaacatcgggacggttacagttttgcttggcttgtttggggaattgggcacgtaaaagtatgttcacaaggcgcaatataactgtgcaaacctggcaaaaatgcagggtcacttttagtgacgagatcaagtgggtgatcaccctaagcaagagcgactgatcgatgcttcggtttttctgcttctcttacttggaagcgttgcattggcgatatgtatatttttcttgtccttgcgtgccgtgcatgcgagtataaaacgtagacccggagttttggcatgcaaattaaccgtgtttctcttaagctgtcgatttggtagagacg

SEQ ID NO: 55657 - DNA, 1501 bp, Oryza sativa
ataaccattttcacgtcttctgcatcaattgattgaagcaccatacccaactcttgcgcgaacttgtcaatcacgaagggaattccgaacttgatcgccagtacaactgtcacaacaactccaacaaagaggcctagtccagttgtaaaaggtatactccaacgaagttgattcatcatgaccttgattttatccatgtctgcagctccggtcctaaaatttccaaatgacaaacattgattattcttaactttcattaaaaagaacacatgtatgcactaacagaaactaatgattggtacatactgtgcatactaaccacataataaaaagattaaatttcagtttagatcacttttaataactgaagtttcacaatatactagggcctaacatatatttcacataaacaccacatatagtaccattctttacactttcgataagaatttacagctatacatatcctagcgcaaaaaaaactatacataacaatagatcctaccaaacaaatagggtttcattaattagtactaactctgtctcaaacataacaatctaggatatgattaggcttatcataggactataaatttagacatgctctatgtccaaattcatagtcttgggatagatctaatcttatcttagataagattgtggaacgaaggaagtacatataaacttccacaaatcagtcaccacatgacaattgagggcacttaacttgatgaatactcagactaaaaatagtgaagtagctcgtcgcacccctaattagagtcaattctttagagtgacaggtaattaagtcattcaaaaattaaatcaacaatttaagataatcaatcaagcaatatgatatttgttgcttgccctttgtgaaccccggtccaaagtgttaaagaatgttactatatgcagtgttatgtgaaaatatgaacctataactagtccggtgtaaaattttggttagtaaagaaggcccaaaataaaatatactcttaacaaaaaagatgaacaaattgattgattttaaacagctcatacaacagagatgattagatgaatggtttctcacctcggacgagaacacaagtcgtcgagtttgccagagatgttcctggcgtagagaagaatcctttggagaagacgttcatcgcgaggtttcgtcctccgacggcgacgagcaccgggcgcgcggtcgtcggccttgtcggcgtcgccctcaacgaccaccccggcaacatccttggccttgtcgacgtcgctcgtgccatcgacgaccaccgcggcgacattcttggccttgtcctggtcgcccgcgccctcgacatcctggctgcccgcacctcccgctccggtaccgaacttgtcgacatcggtcgcgtcctggaggccggcgccgtcagccatcttggctttgtcggcgtcgtcattgatgtgcttgtaggcgatgccgttcatggcgctgctgtcgcctggtccacctccatgagaa

SEQ ID NO: 55658 - DNA, 231 bp, Oryza sativa
atgtgccatggtaaattgaagggatattactcctggataaggagtagcataacataatgtggagttcatattgatataagaaatgatggggtgggcacatctgtaggttagaaacatttgttgaattgtttgattaactctggaaatagtacttggactttatcacagtttttctgagaagagcaacaggattgttaagataattctgacattttacattgtttcctaagg

SEQ ID NO: 55659 - DNA, 1501 bp, Oryza sativa
acgcccctcatgatggctgtgtacgccccgagcgcgacgggatccccggcgaaatctccggcctcgtcatcgccgagcgagatggagagcacgtcgacgccctcgtccacggcgtcatccatcgccgccaatatgtcatcccgatcacagcctctgtcctcggagcacacctggtagagcgcgaggtgcgcgcgtggcgccatgccggccgccgtgccgaacccgttgcccatcacgttcgccccgggcacgaagttgccgcccgccgtgctcgaggtgtgcgtgccgtgcgccagctcatagacggggagcaccgggtcgtcgacccctctccacttccacttcgccgactcgaagaaggaccgcgcgccgatgagcttgttgttgcacactgagctgttgaagtcgcaccggcccttccacctggccggcggcggccccatcccggccgcgtcgaacgacgggtgcccggcggcgatgccgtcgtcaagcaccccgatgatcatcccttcgcccatgttgctcctgttccacaagccgccatggtaggccgccggggcgccggtgagcccgaccattttcggcgtgtacgtggtcatcagcttgtacgtcttctccgggatggccttcacgaaccagtccttcttggccatctcgtacacctcctccctggtgacgcgggcgcagaagccattgacgacgttgcggtaggagtagatgagccgcgtctcggcgccggggtcggtggcgagctcctccttggccgtgtcgcacacggacgccagcagcgacgcgtgccagctcgacacggtcttgtacacattgtggtcgtactcgtacggcttgcgcacgatgatgaggtagttcttgtgctcgccggtgtcgttgtgcgcgacggcgacggtcgccagaagcgacgggaggaggacgacgacgagagcaacacggatgcagaggaccgcccctaagtgcgccattggtgaacaaccaagctaccaatggaaggtgaatctagggaaaatggcggccgctgttgcatgcgaagagattgctctgttcgtcctaattttttttttttgaaaccgatgtgtttgtcctaaaaatggtctttactggaatgcatggagatgaacttgtgcctgcacgatgaacagccttaatatagcaaccattaaggttcctagcttgcggccacaagttccgtcacgcttcgcttgagcttcatgccttcatccacatgcgaaattgtgaaggaaggaaatggtagataattctgcacactatggaaatgagtaatgacagcataaatgcagttatctcctcgcttttaatacccaagctcaattcttgatttgtatctgctcctacttgagagcatttgtatctgctcctacttgagagctcttaagtgcgaacaagcatcgttcttgtattcacaacatttatttcatatggagtggtcacacttcgtgtttaccttttcgtatgtaagttcgatcca

SEQ ID NO: 55660 - DNA, 1501 bp, Oryza sativa
ccctcctaaccaatcttcccttgtcctaccacatacgtcaacctaccttcacccctccccagcctccgtctaaaccatggatccttcctcttcccatccctatccttaatacacccacccaccccggtgacataatccgaacaacttggcaaattaagatacactgcaaccaccatcgaaagtcgtcaacgaagatgactatgtgaggaaaggcaatgagttccatcgaataattgacatttaattcagaagaaatcatacaaacttctgcatagcaaattacttatttttatgaataaatatgcagacgttcttctcatagcaaaactaatttatttgtgcatagcaaaactaactttgatgaatgtgcattccagaattgctaaaataaattgttatcattaattttatgcattctcttctcggccacaggaacaggaagctcgagacaatactacagcggttactacactggctgagaatatttcgagtgacgatagatcgacacgagccggttaatgcatgggttgaaatgttccaagtccaagacataaagcgacaagattcttctcaagctagagcttgaccctctgccatgtcaagcaacgaataaagagtaaatagggtagcagcagtaataattgattgtgaaaaagaagaggagagcatatgtgcaagaagctagctagctagcagtagcacatgcatggccatggagaaagaggttgaaacaaatcaaaacaatggctagctatcttgattcttgactcacacaggtctggtccacatctgtcctgcacaggggaatcctacttgcttccaaacacccagagacaaagcccagtccagaaagccagctctttgcaaaacaggcacacacagagagattgagagagagagagagagagagagagagagtaccatgcatgatgcaatgcaactatgcaaacatgtacacaaaaagttcagggctcctttgcattgaaggattttcaaaggatttgtggaggattgaatccttagaaaaaattttcctatgaggaccgtacgttggatcaaagaatagggatatgccaaaattcttattggttgccttcgtatgccccctttctataggaaaatataacgagagctcatacctcatgttttattttcatttgagaagtccaatgcactctcttcctttctccctctagtttttctctagcaaacagttcactttaaaattccaatattttctttttcgaaaaaaattccaatatttatttctgtgaaccatccaaacgtaacgcaccaattaaatcttcgtgtgtaaccctataggatcgtgtagaacatggtatctgattcctgcaatttttcatgttcttgtgtttttagtaccccgttcaaaaggatccctcaaatatgttccaatggccaatgcattgcactatgttaggtttaacttgcatgtcaatttgatgggatgtatgctgtgtaggacacatactgtgtataa

SEQ ID NO: 55661 - DNA, 1501 bp, Oryza sativa
gcaaaaaaatttttaaaagtacgtggggcccacatgtcatcttcacatattttcttctcttttctcctgttcacttttcttcttctcctcttcacttttctcttcaccgtcgaagcgccgccgggctgcgggcgagcgcgacggcgggcgagcacggcagcggagcggcgggcgtgcgcggagccacggcccacgggtcacaagaggttcggctgccggcggcgccggccggtgacgcaagagaaggggagggcgtcgtcggcggcaggagcactgggccgcggcggaggtggccggaggcggaggcaccatcgccgtcgccgtgctcttgttgttgcagccgctgcacatgcgaggacctagccattagttgagcaccatatatatatgtttgtgtattgctatgcatgcatgcatgcttccggcgagggagacgtagcggagcctgggcgtgaggccagggaggttgggcttggaggcgatggtccatccgagcgcgaggaggtggtacttgatcttggtccggagctcgtcgtcccggcggcggaggagggagagcaagggtgcgcggtggtcggagaggagccggctatgcagctccggcgacagcagcccgccggctctccgcccgccgcctgcgtccacgcttgcccgccggctctccgcctgctgtcggcctgaagaagagaagagagaagagagaatagagaagagaaggggaaagaaaacgagtagaaaagagatgtgcaacttataagtgggtcccacgtatcttttttaatttttttttctaactaagatgccacgtcagcgaaaccactcatatatatatatatatatatatatatactgccataaacattgagtttaggggtaaacattttgtacttaagggacataaaaaatctcgctgttaagacctccggtgaacttattccttctttatctcgtagcggcgataggcccatgagaattggcgagcccaccggactcaccaaccgagctgcctttccggctcgactctgccggtgagagcggtagcgcgtggcggccgtaggcgagcgcagcgtgcggcagcatcgcccttcgcggcgaggcggcgggggcgcaaccggtgaggggacctacgttgctgccgcaatccgccgcttgccttcgccgccgcccgcgctgaatccgagccggagcgcgcgtcggttgccgtcacatcgaccccaccggcccggcgcggcgccagcactcgccgcccctccgccgtccgcgcgcacaggtaaggatccgattccgctcatgagcatccaccttttgtgacctaagatagtagagtaggtgcacgccgatagatggtgattgagattttagaggcacacttctgcacaggcacacgccatgttcaggtaacaccagaaatcccccactatattttacaggtgagatgaagcatctagatgagctgagtccgcatcgaggaataggttgatgtcatctcctgtgctgtcgc

SEQ ID NO: 55662 - DNA, 198 bp, Oryza sativa
ctaccaatatccattgcccctcacccttcatttcttgtcaccgccttcaagtctaccactctacccctttctaccaatctccattgcccttcagatcacccctccacttattttcactgccttgaaaatctacctccctcctaaccaatcttcccttgtcctaccacatacgtcaacctaccttcacccctccccagc

SEQ ID NO: 55663 - DNA, 1501 bp, Oryza sativa
ttgacaatcatccaaattcaaaaaatgccatcgacaaatatgagttctaagaaatgccatcgtacaaacgactttatcccaaaaatgccatcgccgttagggttccgtccattccacaccattaagtgttataggatgaacattgtattttaacggcgtgaaacggacggaagcataacggcgatggcatttcttggatttgaacgctttaaatgccatttgttggattatctcatttagtaaagtttggtaaaaataaataaatatatgtacattttgataactttataaaaaataatatgatttaaaatgacatgaatctaaacaacccattgtatttgcgagccgttacaaaaggaggacggaattggacaacctttttagtttcagttgataaatgagactgtgtagaaataaatgccccataacaagttaaacatcaatatgaggggcctctaaagctgagttagtttgtgcttgctactaaggctgttttcgttgcaaaggactcccaaccgctcttactagtattccatgcgcatgcttttcaaacggctaaacgatgtgttttttaaaaaattttctatataaaagttattttttttaaaaaaaagttagctaatacttaattaatcacgcgctaatggaccactccgtttttcgtgaggagggaatgagttcccatctccgagatccgaacgcagcctaactcctcctcttttttcgcacactcttcccagacggttaaacaatgtgtgttttgcaaaaattttctattgaaaattactttttttaaaaaaatcatattaacctttttttttatatttttttattaatacttaattaattgtatgttagtccatcgttccattttcgtgtcgagaggtgaggttcttaacttccaccaagaacacagcctaattgcattatgcaatactgaattctagaagtatggcttcttctgttgtactcctcctactagccaggatgcctaatcctttccctcacttcgaaggattctttctgttttgtccgggatccaaagccaacgtcgaaaggacagtgatgggggcacatatatgattataatatatgtgtcatgtgtgtgagaatttgtgatgtacagtccatccatgttagcggctaattcttttagagtttagaaccctcttcgattcgagtttagaaacctttttttaaggacttttatggtatattctactgctagtatatactaccagtatatgaaagggtagttttggtattaggtgaaaatctgaaaagggctttttggtcatttaaattagagaattattttcactgggattaatttccttcagttgttttttctgtggatatcgtcatccgcttcttcacgatacatctcgcgtcgctgctccggcgtcgttgctcccgcgccgacgcctccatcccgattcctccggcgccgggagaagccgaacctccacgcgcctggcgtctcccgcgtccccggcgccct

SEQ ID NO: 55664 - DNA, 378 bp, Oryza sativa
gaaggcttgctcgctaacccacacataaccgtgagtgatatgacacaaaggaagcaaaagaagcgtgcgagttcttggaatcttttcttgcatatggtgccaacatgaaaatccacttaaatcattgaattctgaggcacaattcgctagttcggatgtttggtttcccatgtaaggaatcttaccaactgagggcacagttaagaaaaatcttgtgcagcaggaacttcagattgctccagtttcatgattcatgggtatataaatttgtgcagctcagagaccaaatgttctgaatctgcatcagtgcgcatacttagaaaaaggacaatatgctcttatctgctcaatcgtatctccaatgattaagttgaagca

SEQ ID NO: 55665 - DNA, 1501 bp, Oryza sativa
taaaaaataataaagatatacattgaaacattatatgaattatgttggttgataatttaacatgtatgtatttgaaaagctcttaaattataaaaactataaagatataacatatttgtatgatgtttaaatatgatgattgttagtggatgataatgtggcatcttgttaattagtggattagtggatgatgatgtggcatctttgcatgttaagcttaaggagttagtgggggataactttatagaagataggattaggaacaggtataactcaggatgtaaattaggcctggtttagatccaaactttttcttcaaactttcaacttttccatcccatcaaaacttttctatgcacacaagcttctaacttttccgtcacatcattccaatttcaaccaaacttctaattttagcgtgaactaaacacactctaagtgaactgaagtcagaactcagaacattttcagaggttacctgacagtagatgagataatgagatatgctgaacaaaacgttcatgtaaaaaacgaactcagatattgagagctggcatgtactgcagactaacaccaccaagaagaaaaacgagaaaaaaactgagattagctctgcattaggctttcttcggtttagcatgttcttttcttttttgtaatggttacatttctgttaatgaaaatggggggttacacccttgattaaaaaaaaaaggttcatgccaagttgttgttgtgccaaccttcctaacaaaaaacatttttgttagccattctgcaagctgagagatgcatggagctgaagtctaaaccacacgatgttaattacagcccatacaactataggatatggattttcatccctcgagaggatgtcctctcattgtttgcatgtcatttaagtagttataatattttttaaaaaaaattgacaacatagattaatatgaaatatatcattccacaaaaatgcaagcctaaatttaacttctataagttgcaaaaaaaagaacaaaataaactaaaaatagtaatcgcacattcaattcgcagctatatttgttatttttgttacaactttagaagttaaattttaacttgcatgtttgtaaagtgatatatttcatattaatctatcttaccatttttttaaaaaaaatttatgactagatggcatgcacgaaatgagggattccctcgagggataaaatcactttctcacaagtcacaactttacatgtactgtatgttggtagcttattagcgtgcatgactgcatgggtatgtagggtagatcacccattaattcatcgtggatcgaacttacatacgaaaaggtaaacacgaagtgtgaccactccatatgaaataaatgttgtgaatacaagaacgatgcttgttcgcacttaagagctctcaagtaggagcagatacaaatgctctcaagtaggagcagatacaaatcaagaattgagcttgggtattaaaagcgaggagataa

SEQ ID NO: 55666 - DNA, 1501 bp, Oryza sativa
ggtaactagcacaacaaactgcatcatatgtaactcttgaagtcagattacaaccgctgtagtttgagactccaacagcttttacaagaccttgctcataagcatctccaagaccatcaaggtaacctgaatcatgtaagaacaatgtaattgctcccactgcttcctgagtacagttcaaatatttctattatgtatttcctccatattttaatatatgatgcagttgaattttaaacatatggttgacaaaccatcttattcaaaaattcatataattaccatttagtttgttgtcatttgttttatcattaaacatactttaagcataacttatttttgcatatttgcactggtcagacatatatgcaaaaatcaacagcatatattaaaaagtggagggagtatttaaatatgggtatattaaagaataccttcatttccccatatccctggcctgaaaaggagatgatgacaccagttaaataaactagcaacaataataaacacataatattggagtgaaaagacaatgagacaaccaatgaagttggtagagctcaactgaggagacgccaaggcgggataacgagtccttcagtgcagaaataacacttcctcggccaagcctccacggaagggctgcaaactttgtcgcaatggctacttcgacctgttctttctgttgcctttccttgatgaatctgatggtaaatgagaacttagaacaaattttgtgctaaaatcgtcatatatttggaacaacaaacagttgtacattgtataccttcctagtaaactttctgaatttatggctcctgatatcttcagaacatccataaccaaaatgcagtgttagatctttccttcaaatgaaccagagaatgatcagaaactatgaacagggttggttcttacccctgcaccatatacttctgcagtatcaaagaaggttattccgcaatcgacactcgcatcaaatgctcctttagcagccttcaatttcctatctggcaaatttcagagtgcttcatcatattaagggactgtcactggtatctttgtcattggattgtcattgacattaagcaaattgtctacttcactaacaattgcagagatttatgacatttcatgtgtttggtcgttaaaatttcgcaaagcatattacatgtggcacgtggtttcttgcagataatgcaacatgcacatcaagcacatgggatgtatgaccctgatttcagcccaacaaacaaataacaagtagcaggaaaaaaggaatgcaaaaaagaaagacaactttgttaaatatcacactttcagatcctacatccttagatggctggtgccttccaaactatacaaaaatcagactcaaaacattccaatgcgagttgcttaaattccacaatctgtaattagttcgaacgttgcgagttgcaacaacattaggacaagcagagagaacaaatccatgagcatgttcatgatcaaagattca

SEQ ID NO: 55667 - DNA, 184 bp, Oryza sativa
cccccccccccccccccccccgcggcttctcccctcgctttccccacacggccgcgcgatgacgtggcgcgcctcgacaccaccacctcacctctgaagccccccacctcacttccgaccgcctttggtccccttctagaagcttccaaaccctagaggaggaggaggaggaggggtttcggta

SEQ ID NO: 55668 - DNA, 652 bp, Oryza sativa
ttttgtttgtgctggaaaagattagttcttgttgctaattgttgcagtcaaatttagctccaggtgattctcagttgtttaggtgttacctgtagtaggtctggttctaagcagctcaaagcagcaggggcagaaagtgtgtgatcaggtcatgcttcccatgcgcacaaggtgcttgttgcattgcctccccgggtgacttgcacttgcacgcatgtcacttcaatcctctccggtgtgaaatattttgtcatgtgatttcgacaaccaaaaagtcccttttgttgagacatatcgtctacaaaccaacggtcatccgattgttcttgttccggactacaaccatcaggcaggtcactggttttggtttggtgtttccctttcaagagggcccggtgtaaatctcttcctgattagttaattagcaacttaacatgtccctatcattggttagttaattatcaactctgtccttttcctgcccctcttccccctctttctgggagagtttttcttttgtaaggtttccacttcaggtgtatgttatggtctttgtatttgtgatacaatcgttgctgctgttttgggaagaaaagtcttccaaaaacagaacaaagaaatgataagaaaacgtgcttcctttgatttcatc

SEQ ID NO: 55669 - DNA, 744 bp, Oryza sativa
tgtcctcgtcctatgtgaaacaactacatcatctcgcgagtgaatccattcattgatagtgtggttttgtgaaactacacgaccaaaatatatgtacttaaatgccaagtgttaaagtgtatgtggttttctgcaatttagaccacaaaacatgtagttttatgaaatttactcttttcattatgacattcaaagaacaatggaatatcctcactagggattaaaatagttttccccttcttaaccttcaaaattctgttgcgccgggtttcctcgagttccgcgcaaaccccgtcgaaagagagatctgttgttacccacggaatttaacttctagaactaatttcgcgcagctaaaataaagataaccatcgaactgagcgaatatcgcgggatacgatcccatccatccgtttcccgttggacggcactgatctggccgaacatttcaccatgcggatccatcgggcgagggggtcccgcagccgccaaggcaaatgggccatttccttccttacaataaaaggaaaaaaaaatcccacgcgtttttaccgcagcgattatttccttttttttttcgtttcattttcaccgctataataatagtactagtttgttccaacgtactcccgcttccatctaatcgcttctccaccggagctgctttagggcgacggcgagatcgattcgacgggaagccagccatgggaggggggtccatccgcgcggcggcgaaggccgcca

SEQ ID NO: 55670 - DNA, 1501 bp, Oryza sativa
tactatattcatcttaaaatataacaactaataaaatttaaattttattccttaggtttattttacccttcttaataccaatgtcaaaggctacatcttaactagtgaaagaattattctttctcgaatggaggatttaccaagtcatcagaagactaatggccatcaaatatagctttgaaacaaaatttaccgttggatatagagcccaacaaagaatcaaaaggttaagggcccctttgaatcgcaggattgagaaaacgtaggaataggaaaaacgtaggattttgataggaatgtaagtgtaaaacaaatgattgcaaaacacaggaaaaatacaggaatgactgtttgattgaaccacaggaaaaacacaggaattggatgagagagatagactcaaaggaaagttagcaagaggttgaagctcttgctaaatttcctccaaaatctctataggattgtccattccataggaattttaaaggattggatatgattcaatcctttgtttcaaagggctttataggaaattttcctataggattgaaaacctctaaaattcctatgttttttctccaaatcaaaagggcccaagggtagtctgaaggcttcaagaggctccgggagaaaaggagagggaagagttccaccggctatggagacgaagcaatttgtttgtggctctgagtaaattcttttctaatagaagctggaaagcagaaattccatcctcttttcttcatgtgacgagcttaaacagactgatgattatccattataccatgaaacccaactttaaaagaaaaataaaaataaactttttctactaataaaatgtggattctattaaaatgaatcttcttctttcaaaccgaaagatattcatacacttgacaattggctatagctcttttaagcaaaggccgggatgtttcattccattatctaaaaaaatacacttgacaattaaaacattaattcaatttaagatgaaaaaatataacgaaataaaatccatagcggttctttatcaagttcttcatataaaaattgaatttccgcatatattttcaacggacattcatcatagaacttttacatgtcaaagtgggcatcaaagtcgtgcaacgcgtgacaaagtggctagtatagatggaaagagtaaactatacgtagccacacgcttaataatttttatgtgttttttaaatggaaaaggtacgaattaacccccctccccaactatcgcagtcatttgaattacccccctgaaccataaaaccggatattcttcaccccgaactatgtaaaccggacgaattacccccctgatccaatccgcggtggttttggtctacatggcagtccactcagcaattcatttattagaaattatgtgagccccacctgtcagtttctcgctctctctctatctctttctctcttcttctttagacggcggcggcggatgaggaggcgagggggtggagaggcgagc

SEQ ID NO: 55671 - DNA, 1501 bp, Oryza sativa
ttagttatctttggcctatgtgataagatgaaatatgattatgaaaaatcgtcggcaggagtaaaaaacagcttcacctactaccgcaaatcatcattaactaccaccgcttatccggggagcagattccgtaaccgagctggatcctgtcaccaatgttggtagtaggagcctttggaccaatcacgcacatccaaatcggtaaaacaatgaaacctactctactaaacacagcggccagctaagccgcgaggccacatacgattggtggatcgccacataataataccatcccctcctccctctcgtctcttcctcctcctcgcgccgtcgctctcgccttgcctcgctgtcgctcgctcctcccaatccgcgctgcccccgtccctcccttcccacacgctctgccctccaaataaagtaaacccgcgcgagccgccaccggtgaggctcccgtcgccgtccgtaccccggctcccggcgaccgccgccaccaccacccagggtccccgcttcgtaggcgaggggggaggaggagacgacgccatggggttctgggaagccttcctcaactggctccgcaggtacgctcgtcgaagctcgctcttgcttggggcattgacgggggaggggatcgatcgatcgatcgatgcgtcggggatctgggttaggattagatagttttactggattggatggttttgcggcgcgcgaataagtatggtattgagataattttttccttttgcaacgttgactaacgggaaatgttgtttttgatgggtcgatacacgcatacccgcgtttattcccgatatacgtaggggaatttggcttcttgtggtccttttctgtttttccaagttcagatttggccccttttgctacttacaagtacgctgtaggaacattgtatggcagaagcttttttatctgttgaacaacactatcaaatggagtatcgtataagccaatcgaagtattatcagggcgcgtcaatcactgtattaattgaacgtgcctgcccaactgtattcattcaacgtgtcaatcaaaaattcaagggaggtgaggggatacagaatttgcagagtgattttgtatgtaacagaggggtctactctgttaattgtcatgaatattcacattacaaagttcttgtatcatggactgtagaattaggacgatgttggccatgcttgcactgaatttcaatcattggtatgaaaaagagttgtggtaggctatgattagttccacatctacctaccggcggtggccaagtaagttagtatgaaaacaaaggagctctcatcacatgcactgattgggtagtggagaacttcctttgtttctttgaggcactacttcgacgtaatgacatgtgggccaacttctggtttatattagcgagtaaaatggatatgctttgttactaatattgcttgatgaggattcaacatatattcctttatatgcagtctttttttcaagcaagaga

SEQ ID NO: 55672 - DNA, 1501 bp, Oryza sativa
acttgtatttctttacttatattaaaattaataaggtacaaaatagttccaaacagcatcctaattgggtttgccagaatagcatcgacaggcacaatatacatttgctaaggctaatcgcaaatatacaaaaacagcgacgatttcagtaaaaaaagtgaggtgcgaggggaaataaagcaccggcagctggggattgcaattatttaaagagaatcgtgcgtgcagtctattgatgattataggatacgattgcgatcgatctacgattccacgtgaaaacatggtacgcgcggagatgcatgacctcgtcgtctcggatgcgcaggaaattaagcaccacatgtagctaccacggatgaggaagaggtggggaatcagacgacggacctgggaggagcgggagagaagtcgagggcgaccaggaaccatgcggcggcggcggtgagcctcagcttcccgggcaggtggcgcagcgccatagcacagcggatcgagggaaggacgaatcgaagaaggcgaggcgtctagggtttggtttggtttgttttggggtcgctctcttcgagggggaaagtgtgttgctccgtttatctcctcttctttatgccaagtgcaagctccaaatcgtatcggtctcacgggccgggccgggcctcgggtcggttgtacatgacttgttactgtatatgaccccagcgagttaacaccaattactgtatatgactcgctatatgttccttagggtgaaatactctaccaatccattggtggctaagttaccaaaattttagtagagcacattttggttttaatccaaaacaaccattcatgtctttaccagcaaactagcggttttcgtagatagtattacacgaaactaatacattcatattaataaagttaatttctatataaatctaaacgtacacttatttagattcgtatgcaaagtagatatattcaatatcttcaactgcagccgtcgtaattcgttgatttctcggtgtgtgtataacattgttggtgttggctgcagcagccaaccatccgaacagacgcaaagcggcgtattattgcatttgacgtataaactcaggcttctttttccagaaagaaaaacataatttgattttgcagtattgtttttctttttcataatgcgatttgcattttgtgtaagacgggaaccttttttatttaaaaaataacccgttctaaaccgatgtaaccaaataacaccatcacgttattcacatcaccgtgacagtattattccactccaacagtcagctaaagtgtctataaaaggttcggattttaaaaataagttttggaatagattgtttttaaaattaaaaattaaaaaggttaaataaaaaatggtaaaatggtatagattaatccccacctttaaaatttgaatcaccacaatttagctacatatctctttctacttttctctacttctatagttaacagggaaccctgttcgtctttt

SEQ ID NO: 55673 - DNA, 1501 bp, Oryza sativa
tcaacctgtaaatgagtttatgggtcgacccgcttgcatctctaggtgcggtaaatagggccacgacgcgaaaacccatgggttaccacttatttgacatataagaagctagatttgtaagtcagtccgtttgcatccccgcagtgatcatcctgtcgtagattggcacggctcgtcacatcattactagctagatgctctgaaatcatgcttcgttatgatggtttatcgttattgttacgatgcattgttatgaagaaaaaatataagaaaattttgggagaatttttaaacaagaagtctccataatccatctcataaatcttctcgatggtatattctccctacatacaccaacatcagtcgtactcctactaggtctaaactgcttatatacataggctacccattgtgtatcgagctacgtctttttatccgtagtcaataacttgcacctttatggacttttgtctttacaaaacatattcgatgacctaaaacttttgtcttcacaaaacctaaggatactttaagcattacgaaaacctgaaattttgtgtaatcctcattccaagatgtatcttgtgctatattttctcataacatgaataccgcattctcccaaaaataccaaccgtggtcatattgctcgagggaaactccgtgatcaccacattttattctagcgagcatgtgacttctaaatgataaaatccactcttcgttatgaacatgaaaaaaaccctctcaactgcatgcatatcctttttcctgaatttttattacctttaaactctttttattcaaattttaaaaaaaatcgcaactgctaaggaaaaacactggcagtaaaaaaaaaaccacaaccttcatctgaagtttttcatcctcattttgctgacgcctttataaatccatccaaaccacactcacgagggtggcttggcttacttgttctcgcaagaaaagaaaagaaaactcacacagtggcagtaaaagtccaagcagcaagtgaccaagaccccaactattaaacaacaagtgaacactaaacacactcatcccatcagcagcagtagcaaattagcaatagccccccgacctagcttgagacgacctctcatatcataagttcataggctccattaaatatactcctcctccaacccccgagacgcgcagataagaccaaatcgaccgaggttttaaccctaatcaaccggggttttagccaaaaacacattaataccactactaccggagagtgagcgagtgtgtagcagcggcgacagtagcagcagcaacgcctccgctcgctcgatcgatcgatcgatccatctcctcgtctagctccatatgcgagctggggtgcggcttaagcaactccagctcaaagtaatcttctcactagcaagcaagctctctctcatgtcgtgaggtgtagattaggggggagatttgttcttcttttttggtctggttttttttgtggtttcttgat

SEQ ID NO: 55674 - DNA, 1501 bp, Oryza sativa
ttgtccttaatcagttaatctgatgatttttagactatacaatccactgaagtggagtatatcttttttgtgaaagatcaatatttgtgatcaatacttctccatttattagtgtgaaagatcaatatttgtgatcaatatttctccattaattagtgcgtgtacccggttgctgctccggccagcgtgattgtttgtgaaatcgatgcataaacttcaggaaaagcaaccaaaatcttgccgggggatatgatgctgctccgtttcaaactggctgcataattacaggcaagaacgtacatttgggtttggggctccatgctgtgtccatggctagatgtgtaaccaatgatggagcactagctatctatattcttggccatttcttaatccacacaaccaaagcttagcttaattagctagcaaactagctacacatgaagccaagtggatactggtaactgatactttgctagcttagcttagagggcccaattaagcagctcactatatctgcttagcataattaacctagcttaactattaccaccaatttactaatgctactgtcctgtatattaatagggttggattcttggtttgctctcgctgatgcctcaagtactcccactaatcatttttttatgctgctgctttagataagcaaaaaatcaatcaaacaattaattaattggccatcgttggtttcctcccaatctgtatagaaaaaacaggcgctgccacgtcggcacagcactgcgccggtatcgggagacgaggagaaagtggagttaattattgtgcctgcttgctaaactcgccggataattactgttagcgccgctcgttggtgttaaccccttgtatttacgcactaagagcatactattaaccagctataaacatattataataagataaaaaataagagagaacggagggttacagatctgtagctagctgcagcacggactctaagacaaaatttatatatgataggtggtaccatatgttaatagtatagtaagcaactattgtataaattaactattagattggctatagataaactagagctagtagtgagctatactattaaacttgctctaattaatcctaatccagcggtaattaattaggagtgatttaggtttggtaggactccaactcctaatttaaactttaggagttaagttatagagtcgtctaaacccagtttcacatttctagtttattttataaaagcactcaaccagtttcactcttatttttagtgaagctaagatcatcatttggttaaactctaaggaaaaataaaaccggggctgaaacttaagctgtgtcaaaaagacccgcgaagctaccaacttgtgcgttttgtaggtgtggacttggattgattcctaccgtagaagagaagcgatgtgttgcattggcttacacctggctgcgtcgtggactaactgcacggtgaacatatatatatatatatatatatata

SEQ ID NO: 55675 - DNA, 1501 bp, Oryza sativa
gctacatctaaccatatttaatagggatatgacttcttggtttttaaaatcgtgtccgaaacgactaataaacccagcccgaagggagtattatatttacctagcaacaaactcaatgcatgtaacatccctactattttttagccaatagcaaatcaaaatattgcatgtgggttataaatagttgtgtgcatggatgcatgtatcaatgtccatttactctaatataaaaataacgaatagacttaatgaatgaatataaatatgtaaatcatttagaaataaccttaaaaaatattatatatagattaatttagaatggagggagtagcatcaagagatgatgctgaactgtggatttgagatagtcatccatgaagaagtatgaacataagaggctgtttcaatttgtaccagtaccatgtcatggcgtgttaacacggcgatatgagtggcacctatgaacaggacacggagcatggatgccgcagctggctagcctgttaccctgcacaaatctcggcacggctaattaatcaagcttaagtcgttcgtcgatcgatgcaaatgcaactgcatttgcctcgatcccttgtgtttgtgtgccggacaatgcaatattgcaatatatatatatatatatatatatatatatatatatatatatatatatatatgttcaccgtgcagttagtccacgacgcagccaggtgtaagccaatgcaacacatcgcttctcttctacggtaggaatcaatccaagtccacacctacaaaacgcacaagttggtagcttcgcgggtctttttgacacagcttaagtttcagccccggttttatttttccttagagtttaaccaaatgatgatcttagcttcactaaaaataagagtgaaactggttgagtgcttttataaaataaactagaaatgtgaaactgggtttagacgactctataacttaactcctaaagtttaaattaggagttggagtcctaccaaacctaaatcactcctaattaattaccgctggattaggattaattagagcaagtttaatagtatagctcactactagctctagtttatctatagccaatctaatagttaatttatacaatagttgcttactatactattaacatatggtaccacctatcatatataaattttgtcttagagtccgtgctgcagctagctacagatctgtaaccctccgttctctcttattttttatcttattataatatgtttatagctggttaatagtatgctcttagtgcgtaaatacaaggggttaacaccaacgagcggcgctaacagtaattatccggcgagtttagcaagcaggcacaataattaactccactttctcctcgtctcccgataccggcgcagtgctgtgccgacgtggcagcgcctgttttttctatacagattgggaggaaaccaacgatggccaattaattaattgtttgattgattttttgcttatctaaagc

SEQ ID NO: 55676 - DNA, 1501 bp, Oryza sativa
ttctgaatgcattattttagcagataacggggccaggcacatcaatttaaatcccatacaattgtaacatctaagaaaccaagtacgtttggactaaaaatgctaataacacattatcactcttgagcattttgacttgtgtagtacaagcaattgggtcaggtacaggtgcaaaatttactgaccctgaactttcttctgttgtgggtagcatgtttgagcataatgatcatggaaaaaagaacccaaggtacaagttgctaattcaaaataatttggtttgtttccccacttgttcctcaggtgctttacactgactgagctctctcacacacgcatggttcgttatgtccttgcaaagatgaaccatgaagttggctttgtatctccaattcctgaagaaacatgtccctgagctgtctgcatggtcaaacatcacagtggaagcttccatcctgatgcctcccaatcctatgaaccatgcaatgttttacatcgggatcactgctcaagcatcgccacagaaatgtgttgaaaatatgtgaggtatgtcgcatggtggaaattaatgaaaaactaggataatatatatattgaatttgatgtgctcttctggtttgcatgtgtgatggactgacggcagagtgtcgattgctaactagatttaaatgggtagaatcaggaaattatcgatgtacgtgcatggtttttttcagattgtataaggattctaagtacaatggtgggtagatgcataaaacacgacgaacgtgggatcgaaaaataaaggtgtaattgaatcttcaacgctagggatagacatgagtggatatataagtaacgattgataagttctggttcaacaaaattaacaaagtacataataaacttgaaaaaaagagtatattttagctgatttactacttgattgcagactcacattctgaaccttcttggagttgaatatctgatccattggtagcctaatccaaatgaaataggcataactaaactcgggcactaaacttcccgagagctccatcattggtacacatctagccatggacagcatggagccccaaacccaaatgtacattcttgcctgtaattttgcggccagtttgaaatggagcagttaatgttataaaaccagcctcagaatcagcatcactagctaaatgcgaaaaaacgctatagcagatccaacattaataacgacactgaggcacgatatttggtaacggagattcaaaagaattacttactcgctcgtagatggtaaatttgattaatgatattttttaggcaaattttgctacaggacatcgcaattgtgtgtatttagctcacggacaccgtgaaagtgaacatttgggggaagacatcccataatcgtggatatttgcccacggacaccgcgccgtctcctctccacttgacatgctgacatggcagacgggaggctgttttttggcccggtcagacgcaaatacccctcggc

SEQ ID NO: 55677 - DNA, 1501 bp, Oryza sativa
aaaggtgaaatatgatgttggctttgtatctccaattcctgcccaaggaagccccggagttgtccggttaaatattagaatgaaagcttcaatcctgatgtctcccaaccctatataggagcagcatatgcaattttttgtaggatcattgctcaagcatatatgaataattaatagccataggaaaaggtgttgaaaatatcctgtacagtagcaatgcatactaggagtatgcagtgagttttatgtgcttttctggtgaagtggtgagcgaagaagtaaatttgcaccggttctaagaatggaggatgtgttatagggttatacccggttttacggtcgagggagagaggactctatcaacagtaaaaatgaggatgagggagataaactagacatattcccatccactttgccctatcctaaaagtttgcggaaaagctaactggagcgtacacgctggcaacgcgcacttagtacggtggatttcctttttttcgtaacttttttttcccaagacgagtgcatctaacgtaactaatacattagttttagataatgacgataattaagataagatttttctttttagggatatttttttaaataacagattaaaaataaatctatatatgaagtcaaattttgaaaactttcaactcgaaatatgaattttttgcagtcactttcaacttttcatctcaattttgaaaaactttcaactcgagatttgaaaatttttaactcagatttgaaaacttttaactctagattttaaactttcttcaaattaaaaaactttcaagttaagatttaaaaactttctactcaaatatttttaaaaaagtgtatgctaactattaaaaataaggaaaaaacacgaaacaaaaataaaaaccgcgaggggagggaaagcggaaaaaagaaaaacgaaaaagatggcaaaaagaaaacgcgaaaaaaaaagaagagagaaagtgccgcgtgggggcgccagctgttactggggcgcgcgccaattagctgccccaaaagtttggcccaagcccaagcaaaatcctggaaaaagctcgacagactgtcacggcccggtccagttcggcccaacgggggcgccttgcgccaccgtgtcggagacgggaggcggcgtggccatctccgcttggctcgacggctcgcggcgcagaatcggccagcgaggccgtcgcttgactgcctgacttccgagctcctctttgcgcttttctcctttgaaccttccagaacgcgcaaggaagatcaagcagcgcgcgacgacgcgacaaattccccccccccctcccccctgccggctgcggacgaacgaacgaacgagcgagcgagcgaagcgaggaattaagatgttcatccagaaggtgaggagatgtctccagctctagtctctcgcaccattaatctgatgtcctcctgtatgcgtggttaattttggtggatttggttgtgtgggcgtgtgtgtgtgtgt

SEQ ID NO: 55678 - DNA, 1501 bp, Oryza sativa
taacttttatatagaaaattttttaaaaaacacatcgtttagccgtttgaaaagcatgcgcatggaatactagtaagagcggttgggagtcctttgcaacgaaaacagccttagtagcaagcacaaactaactcagctttagaggcccctcatattgatgtttaacttgttatggggcatttatttctacacagtctcatttatcaactgaaactaaaaaggttgtccaattccgtcctccttttgtaacggctcgcaaatacaatgggttgtttagattcatgtcattttaaatcatattattttttataaagttatcaaaatgtacatatatttatttatttttaccaaactttactaaatgagataatccaacaaatggcatttaaagcgttcaaatccaagaaatgccatcgccgttatgcttccgtccgtttcacgccgttaaaatacaatgttcatcctataacacttaatggtgtggaatggacggaaccctaacggcgatggcatttttgggataaagtcgtttgtacgatggcatttcttagaactcatatttgtcgatggcattttttgaatttggatgattgtcaatggtattttttggattatctcttagtaaatacataaggaatcatgccaaaacttgacaatattgtcaacttatcaaaatttaattgggattattttggcgataatatgaacagcccttacatttctgaagaattatagctcaaatatggctatggccctgtttggattcggagggctatttaatagccctccggaatcttgctatttaagagtattaaacgtagattactgataaaactcattccataacccctacgctattctacgagacgaatctaacgaggtatattaatccatgatttgctacagtaatcagccgctaatcgtggattaatatacatcattagattcgtctcgtaaaataggctagggattatggaatcggttttatcggtaatctatgtttaatacttctaaatagcaagattccgaagggctatttaatagctcggagcatccaaacaaggcctatgtttagatccaaacttccaactttttctatcacattaaactgtcatacatacataacttttcagtcacatcgtaccaatttcaacccaaactttcaactttggaagaactaaacacagcatatgacagtgcagttcagctcaattttgttcggagcctaaaaaaaagaaaagaaaaaaagctcaatttggataaggctatgaataaactcaaaaaagcatccaacctaaccaccacactggcccaccagggcccacgctccactcccgtgatcatcacctccttccctttccagaaccaccttctccttccttcctcctcttcttcttcagtgtactctgcctttataacaccctactcctctctctcacctccaccatctagctcactcacacagtctccactcacacgcattgcagaggagaggcgacaa

SEQ ID NO: 55679 - DNA, 302 bp, Oryza sativa
gcatgataataaaagtgttagaatccaaataataaaaaaatggacaacatttaattaaacatttagaataaatgtcggaaaattaaaaataaataaatcaaaaacagattgttgagtttaaaaataaccccatataatgatctgtgctacgacgcccgctagtgtgtggtttgaatgatgcctgaagaaaaaaaatagagttaaaattttgcttaattgagaatagcgacactgtaaaatatgtgatggatgttgtacaacactgagttaacttttaactatgtactattaatctggtgtga

SEQ ID NO: 55680 - DNA, 1501 bp, Oryza sativa
attgccaatgactagtaatgggatcccagtcaaagaaggcttgctcagaagatcatggagctcgcttttggcaatagccatgttctctcgatcggctgcatccacaacatacctgcaggaacccaaaacattccccatggtttgtaaagtcaattattgccaccagcaacgaaaaataaaataatataacaacgaaccagattttaaggggaaaagtcagctagaggggttacatattagaatttagaacatgcgccaagtgaacaaaaaagcaaaaatagaaaaatagaagataaagataaacaagacatcataattatcttcaataatgcaaaattaaaaaagtctgatcaaataaataaaagcatcatctttttctagaatatccaatatccaataggcaaggcaaattcaaactgacttatccttgcacaaggataactacgacataaggcagagggaagaaaagtgcagtatgccttacaaaagactaagaacagtttagttgagaaataaagaggttaaactcaagaacataagatctgcacaaaatcccatgtttcacctaaactatccaggttaagcttttgaaaccagtgaatgtgcactacaatatgaagctacttctgtctatggggtctagtaattaaatttcattgatgaagtttgcctaaatttcagcagtggtcaaatcaaaatgacatgaaaataattggttagcatgtgtaagcaacaaccaactaagcatgacaactactgagtatagtgcaattcctgctgcacatgcatcaaattagacaggaaaggaacttacacaattgcagaaactgcacgacagtatctctcccacatgctacggaatcttggctggcctccaagatcccacaattttattgtgacattacctttggtcacctttctcatgttgaatcctacagtaggaatcatgtcctcactaaagcctcctgtctgcagattacatggtgatccatgagaaatcattataattcagcaagtgaataaataattaagaaactgatacttacagcaatgacattcacaagcgatgttttcccagcattttgaagccctatcaaggaaagctccatctcttgcttgaaaaaaagactgcatataaaggaatatatgttgaatcctcatcaagcaatattagtaacaaagcatatccattttactcgctaatataaaccagaagttggcccacatgtcattacgtcgaagtagtgcctcaaagaaacaaaggaagttctccactacccaatcagtgcatgtgatgagagctcctttgttttcatactaacttacttggccaccgccggtaggtagatgtggaactaatcatagcctaccacaactctttttcataccaatgattgaaattcagtgcaagcatggccaacatcgtcctaattctacagtccatgatacaagaactttgtaatgtgaatattcatgacaattaacagagtagacccctctg

SEQ ID NO: 55681 - DNA, 1378 bp, Oryza sativa
gtcactaatgttgcagcaaactgatagtaaagttatagatttttgaaatttcttcttaaaatatgacctatcaacttccatgtatactttgaaaaaatggtcttaggaatagttggcctacttgtccaattagaccgtcttaatatattgaaatcgtagaagtaactacgtcactactacgaaaatgatttttgcgtgcggtgaaaaagggatttctcatgcggaaggatgaaccgcacgcacacaggtatctacaaaaatcgctacttttgcgttcaggtgcttatgtcgtccgcatgcaaaactaaaaataaaatcaaaaacctgaaccctaacctcctcctcctcctcgtcgccgtcatcctagttagatccatcatcatcacgccttctccgaaccctaacctcgaagccgtcgtcctcgtcaaatccgctgtcgccacgcctcctccgaaccctaacctcgaagccaccgtcgccgctgtcctcgtcagatccgccaccgccacggctcttccccaccgcccaccggctgccgccaccaccaccggatccgcgtggatctatgtgggggacggccgccgtcgccggatccaagcgggggacgatcgccgtcgcccctcgctgccttctgcatgcggccgtcgacgtgagcacgtcggccgccgcctcctgcctcgtcacctcgccatgcccgagcccgccgagccgcgagccgccactcccggctaccacctcgtcggcgtcgacgccgagccggccaccgagccgcggagaggagaggaggaaagagatagataggagaggagatagagggatgagtgggaaaataaaagggagataggtgaaaattttaaagtgagtgagagggaaaagagggagggatatttttgcttgcgtacctacctcttaagaggttcgctcgtgaaaatagactcattttcgcatgcgatccatttaagaggctcacacgcgaaaatcgatttttttgtgcggtccttttaaggagccgcgcacgaaaatggaggatgattttcgcagacatgattggtccgtctgcaatttaaagaggtatatgtacaaggaaaacccttttttaagtagtgtgtgtaacattatatcaaattagaaaataaaaaacattatcccaatggtttatttaggtggcagagtcgtgggcgtcaaaaggagcggaaattgcgcggaggagcggatcggtaatttcatcatggtattataagacagagatacccacggtccattttcagtcttcagatgaacagatcggatggttgagcaaagagataaggatgttttatgtatattttgttgggtgcacctagcaaagaacgtacctgttgctttatagattaaatat

SEQ ID NO: 55682 - DNA, 604 bp, Oryza sativa
ttctcttctagatctggattctgaaagaagttcttcagctcttttcttaatttcagagccttaacgttaatacaagtaacaaacagtttgttgtttgttcccccaaacccccatgtcccaagttggatccgcccctgcaaattggccgctggagctcgggattgccgtcagcgccgccgcgtgctctgttttggccacctccgactcgcctctccaagccaccatagcccaatcaaattagtgaagccgacaagttcaacaagttttagagtcctaaatatgcatttcagagtttagtgaccaggatgacatcagactagcaagttcaagaatcaaggaccacagctgtattctttttttaagataatggaataaaacatcccggcctttactcatcatagcaccacagctctattctttaattaattattagggtatgattacttaaaatgtgcactaagcaccttccatttttacttgtcaggttctatagtatattatatacttgatgactggttaatcccattggtctggtggggagatcttgagagatagatatttatctacagtaaatcatcagcacagcagaaaatgccggcaatta

SEQ ID NO: 55683 - DNA, 1501 bp, Oryza sativa
gattttccagtgagtacatgcatgatccaaaattatattggattgaatctctaattacagttaatataaagagtatattaaatctctcatcgtttctcatgtagtgtgcaaagcaggaccagggaactaacttatgcggctactacgtatgcgagtatgcccactgcctatcaaaccaaatatgcacaacacgagagctcgatgtacgtatacataaaccattcaaaatttcattgcgtatcgatttgttaagttgtttattaatttcatatattcatacgtcattatttttcgaacgatagcgtattcacatgagggataatctcccacacaaggattttatcacggctgttcaagaacaactgatgggattcatcaacgaagaagtccttaatctcgacggtgaattctactacgacggatcgacaattcataacgtcggtccttcctcttctgacataacaccggcgtcaaagtcgtagctatagctaccgagcaaatgaattgtactatatatgcatgtatatatatatttatatatgtacacatttacttttgtgttaatatatattttggtgacatatatatatgcacataaaatgttaagtgctttaaattattcatatgtctgtgtaatattatgattatacatacacacacacacacacacacacacacacacacatatatatatatatatatatatatatatatatatacgcctatatattatgcatatatatgtattgtaacatatgtatatatatatatatgcctatatattatgcatatatatgtatatatatatataatcaaccatgcagcaaacagggccttgcaaataaaaaaaaatggtgcaccgatctttagtcctggttggtaacacaaaccgggactaaagatggtttggccggccacgtggctgatcaatctttagtcccggttggtaacacgaaccgggaataaatatcgatctttagtcccggttatttcacctgggactaaagatagttatctttagtcccggattcgtagtcccggttggacaaccgggactaaagggggttaccaaccgagactacaaacagtttctccaccagtgtagctgagacctgagaagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacaacagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttat

SEQ ID NO: 55684 - DNA, 229 bp, Oryza sativa
gtcactaatgttgcagcaaactgatagtaaagttatagatttttgaaatttcttcttaaaatatgacctatcaacttccatgtatactttgaaaaaatggtcttaggaatagttggcctacttgtccaattagaccgtcttaatatattgaaatcgtagaagtaactacgtcactactacgaaaatgatttttgcgtgcggtgaaaaagggatttctcatgcggaagga

SEQ ID NO: 55685 - DNA, 456 bp, Oryza sativa
ctcaagattaggatagagaaacgaatcaacgatgaacataagatctacttgactaaaatggaactaacgtatcattatttgtctcagtagagaagctctgcacaagccataatctcaaattggggtgtatagcttctaataaatgtttctgcattacattacatttctgataagctgaacttccacttgaggttgtgttgtgcgatatgccatctatccatgcttggaccggtattagcaaagtttttcttcttttttttttccccgtgaagatgttgcgatcttacaattagttctgaattaagtttctcctcacgttactaacacagagaacacataaaaagaaacatagttgcctgatgctgtattgcttgcttgaaccatagaaacaaactacattgtcttatttcttccatgtttcttaaaatatttgtatttctgaaaaatattgtcagt

SEQ ID NO: 55686 - DNA, 1173 bp, Oryza sativa
attgccgaccgttaacgaacgtgattgaaacgtgaccgaacgcgaacgaacgtaacgaaacgttaacgaacgcgaacgaacgtgcgcgaaacgttaacgaacgcgaacgaacgtgaacgaaacgttaacgaacgcgaacgagcgtaacgaaacgcgaacgaacgtaacgaaacgttaatgaacgcgaacgaacatgcacgaaacgttaatgaacgcgaacgaacgtgaacgaaacgattacggaacgcgaacgaacgtgcacgaaacgcttacgaacgtgtatgcacttgtactaaaagtgtgagaacgaacgcgtttatactaatacgatttactggtaatacatatatgattatatatgtaacttggcccgtttagactaatacattttcctgataatgttgcagagaagacatcgtcgtcgtccctcaagccgaagtggtagctagccatcgaaggaattcgcgcaggcaaatgatgtaaagaagtgattgttagatatttaatataagattgttagacttagcatatatgattattacaattttaatataagattgttatcgatttaatataagtttgtaacacttagcatatatgattgttagagatttaatatattattgttagacttattatatatatgtgactattacaattttaatataagattagtagcgatttaatatgagattagtagagatttaatataagattagtagcgatttaatataagattgttatacttagcatatatatatgattattacaattttaatatgagattagtagcgatttaatataagattgttagacttagcatatatgattattacaattttaatataagattattagagatttaatataagattgttagagatttaatataagattcttagacttagcatatatatatgattattacaattttaatataatattagtagcgatttaatatgagattagtagagatttaatataagattagcagtgatttaatataagattgttatacttagcatatatatatgattattacaattttaatatgaaattagtagcgatttaatataagattattagagatttaatataagattagtagagttttaatattacggttagcaaatacatcctatatacctaacaagtattttttgtatgcacaga

SEQ ID NO: 55687 - DNA, 162 bp, Oryza sativa
cttccagacctgtcaccgtgctgccattggttcgctagaaccaaatcaatccaggcttcggagacgctgatgctagtgatttttactactggactcatcatggtaatattatcatgcttgcagattgcaacactgcgatgttctcatggtgctcattttagt

SEQ ID NO: 55688 - DNA, 312 bp, Oryza sativa
caggggctatttctgcaatttttttagtcgatagattatttctgtaatattaaaaaaaaatctaaaaacgaaaaaaactcgccgaaactatctctggaccgacctagtgaggcggcggctcgagccgtattccaaccggagccgagccgagccgcgggcgaatcggcttcttcttccttctctctccccgaccaatccgacccaaacgctcctcgccgtcaaatctcccctctttctcgccgccggcgagcagcagaagcagcggcaccagcaccaccggctgtaggcgcgatcttgtaggctcatcggaga

SEQ ID NO: 55689 - DNA, 1501 bp, Oryza sativa
cgcattaaaccaagaaacccaatgagatagcctaaatgcccatatttatggctccataagagtattgatgcaattgttgcctggctctaatcccagctgcatgcatgcatgaattaatcgtattatcgatcactcaattaaaagatcaataccgtatgctaagagcagtgataactacattagcaagcactctagcacccaaattatacaaattggcaaacttcatcagcaaacactaataactaaaatggatcagtaaaccaaacatgtaaagaagcatattggctatatagactgcagcgctaaaagaagcatagtccaggtgctattgggagctgaagcaccaagcagccaaacatcagtgctctaaaaatcggtgctaggcgcctattagccgcctgggattaggcattacattgtgtactagacggctagccatccttaggtgctcttgtgcgatctaatttagtgttgtactgtctaatttttatgtaatatgcttgctaatttcctaggcgccagccctgcagacactctagggctattgtattgtctaacatttgctagtttaagttagacatgataaaatgtatagtacatagaaaatcagcagagtttagtgcatacaatggtaggaaaaggcggacgaatgagtgaactaagtatctgtggatcagatacatcagcatcgcgccagacaagtgtaccaatttcttcttcgttgtcaagctgctgaccccggaggtacatgaagcggggttgcaaagcacgttgtgcctccagaaattcatcaactgtagggttaatcagcgtgtgcacctgcatgcccagctttccaagttcagaactgacaaacaaaatatatgtacttaagagcaagtttaatagtagatctaactactagatataagctaatcaaaaagtagcattagggctcacatgtgtaacagattagttataaggttgtctctaattttcttctctctctttttctcatttatataattaatgcatttatcgtagacaggggtggagctatcaaaaatatcattgaggtcactcttcacataccatggtgcaaatgccaattctaagagtaatttattagttccaagcatatttaataatataattagcaaaaataattggtgtcatcagtaaccatacactggatccgcccctgatcttagagcatgtgtatagctaactttttatacacaagagcttaacactttttattctccaggttatctctcctccacataggtttatactagatggattatagcctacaattaaacttgctccttaacaaaaataaacagcaaaaggatacttacctccaacctcccggacgagatcaactccgggaatgggtacgatggccgctgctgctgggacccaggcaccggacaaggtggcgcccgctgcttgcctaccttcccacacagcactgcaagcaccgtgcacttcacccttgagccgctagggaaatgaggca

SEQ ID NO: 55690 - DNA, 1040 bp, Oryza sativa
atctatatgaatatggataatgctaaaaagtcttacattgtgaaacggagggagtatatgtattgtagcagtatataacgtagaagttgcagttttgtaataatttcatacgctattattgcagcaaactaaaacatgtcactaatgttgcagcaaattaatagttttatcactaaagttacaattttctgaaatttactttatttataaatattgtagtagaatgaatgttattgccgctaatgcaaagaggcgaggttgcttcccgtatcatcggtgtaaacgccagggttcaccataccgccggtaaccgcgcggttaccgggcttaccgcgggggtacggtaatgtaaataccgcggtaacctccttaaattcaaataaatttaaaaaataatttgaatttttgatgaattttacacggtttcgtacggtttttcacggtgcttaccgccggggcgcggtaactccggccctggcggtttgaaaaaccctgctaaacgctgccttttgggctgggtggggtcctcaacgttgtcattccattcggcaggtacctctgataggttgtgtcgcctctactcttttaactactccctcatcctataacgatcgtcatacatatacatatttatgtatcaagaccaataataattttattcgtattaattaagataccatgcgcacattttcccgcaatgcatgcattgattaaaacaccataccaattacactttagcatgtacacattctcccatgcttcgttaattgtattttaatgaaatccgtgtccatatgattatatgatgatgaatttgagaaattttggattccattatacgatgatatgggaaggaggaagtactaattaattaatcccttggtttgtttaagtaaataaatatatagaacgatatgcatattcattcagttttgagactagccgtacgtgcaattgggcctggcctcccctaattatgacatactaattaatcctctaattatgtaattatgtcaagcactgtgttggttccttacagt

SEQ ID NO: 55691 - DNA, 1501 bp, Oryza sativa
agaggaaagggtggagctgggatatgggggcgagaatgcaacggaaccctaggtttcctctcggtctcggatcatttaatagagccaaaaatgaaggggaaaacgccgattaatccccagaagcgaagcaaaaaaggcaaaatcgtaacggcaaaaaaaaaaaaaatcgattggccgggagggacgaaccgctcgaggcactggagatcgaacgatgcacggaaacgtgattttccccaattcctcacatttgctacggctgctgctggcctgctgatgctgatgctgatgacgacgacgatgattcatagcttgcggagagaaaaacaaaaaacatgtcggattaaattagctttctcgcagcaggatttggaaggagaattggagagaaaaattaaaaccgaatttgttctgtgcttttctgggcgcatacctcgatcagctttgattatctgctgctgcggctgctactgcttttgggttttttcggccgcatccatttcgatcggatcggatgcgtcgcaggcccgggtgttgttgtgtttggctcatggcattggctccggaggagggattttgggaggaatcgggatcgcacggcaggtctccgggcgggagacgtgcgagcggaggcgccatgttggattgcttcgaggggtgatggtgcgtccagtactccagttcctgcatgttcgtccggctcttgatatttcgatgacaagagtgcgaatgaacaaatgcgagcggaagggagatggggatggttgatgcgcgggcggtcgcgcaccagctcgatcagtttccccctctagtcttttccctctctctctataagtatattgatacgtatatacacgtacacatacaaactttatacttcctccgtttcacaatgtaagtcattctagcatttcccacttcatattaatatgtttagattcattaacatcaatatgaatatgtgaaatgctagaatgacttgtattatgaaacaaaggaagtattttactagaaaagatactagtgcgttgcaacaggtgaagattattttaatcttgttattgtcatacagtttaattgctgtgaaatttattgtagaaattcgcctggatatatatatatatatatatatatatatatatatatattaaaaaaagcgaacttatttccaaaagcgaacttaaaaacggactcatacacggatgatgtactaaagtaccggtaaaaacatcttcaatttttataatagtagagatgtgtgtatagataaaataaaccgaaagatacttatatatttaaaaactgaaataactgaaacaaaaccgaaagaaaactgaaaaaagaaaaggaaaaatcgactcttcccacgcgctccatgagagagaatctgacttagaccctgtttctttccgcttaagattattataatctagattattgagttagattactataagctagattgttataatctgtagtagaatacccggttagttgtttc

SEQ ID NO: 55692 - DNA, 1501 bp, Oryza sativa
aggatgatagaagttatattttttttttacaaaattcaaactctataagttactactccccccgtctaaaaaaaataatttaggtggagatgtgacccatcccctcatatacatatattaatctagtgggggtcatacatacatcccctcctagattgattctttttggaacgaatggagtaagtttttaggatggagagagtactatatattttgattttacatgttgtttgatgaaggcgggacatagatgacactactgtgagcaggctgctgcccatgattacagccacgtccatgcagatttgtatcaggtgcagttggtactatgactgcaacttaggcagtccactgccacctgttagatctgaatctaacggtccacatgcacccggatactgtagaacattgtagcaacaaacattctctattcctactgcaggtgatcccatatcctgtccatgcatggttgctgctgctgggccccccggccttctggggatgtgtttttttgttgctttcggaggcaaagatgagggggtgttttagtccctctcacccaaacactctctcacaggaggtgtttaaccagttgtcagttcgctgttagtttaagagtatattattatggttaattaattaccggttatgtaagagtgatgtaatgcatgtggtggagagaaaaaaaagtactcttcaaataaccactactcgcaagcattgttggtttataaataggagtacattattttcatgccagctgccaggtgcccagcttcttttattctaagtagttattgaattgcatggtgcaactaaggatcattattttttgagagatcgatgaacgtgagcatgaactcttgtaaccaattaattaatctattgtttttatttaattaagtaaggtctcctttagaacgcaacattcaaaaaccgcaaaaataggaaaaaaatgtagggatatattgctcttttgaatattttgaaacacatgattattttagctagtgctttaggatggtttacatgaaatagactacaagaattatacaagaatcacttgtggaagagtgaggaagtagagggagtgcattatattggacttatcaaaggggaaaaaaaaagagctatcacacaggattttatccaagtttgttcctccaaagggccatatagaattaaaatccgtagaaactcaattctctaaattcctataaaaatcctccaatccaaaggacacgacttaaacaatcctgcgtgacaacttgacttaacgatcttaacatgcagtactgtatcaattctctataattccatgcatggatgaatgctacacgagacatagtgacataattggatttgacacctagtgcatttcctagctccgtatttgttcttgatcgatgcacttgcacattagtatgtcacctcatgattaaactcagggaatcaaactctcaattgcagctgaattgagcattcagctgcaattgagagg

SEQ ID NO: 55693 - DNA, 1501 bp, Oryza sativa
acctaatcggctgctttctattaacagatgttagccgactagaggttagataatgatattgccggagattatgtaagatatatgataactcgacgaattacataaacaagattagagtatcataaagatggaagcactaatcccgagaacgcaagccgccataacaggttttacctctagttgaagatcgaaaccgatgcagctcaacccgaaagcaagaactcgtcgaaacaaaacgaaagtaaaaagagtggcgatgcgccgagattgtattgaacgtgtgttagtttgattacatggggctcgggtctatttatacccgaaaattacaaaatatgtccatatcggacacgactcttatctctaacaaactctaagataccataagtctttgcggcagacttttgcccaaacatatctctaaggaaattatataaaatatcttaattaatagatacaattgttttctcaggactctatccatgcgtggcaatcatcatgaagcacgtcaacctaacccgacaacatatgccgtgtcatattgtcagattcgattcaatcggctaatcccgtccgactctaactctgccgatctcagtcgtagccgattcggacttcagccgattctcactttgtttccgggacgatttccatctcgaattccatctcgatttcttctttatctccgatccttggattaccaaatttggtcattaacattattaagttattcaaatgtttggatgctcatttaattttttatgaagtgtgcaatacatgttcgacattctctgactttgtagtacatgaaaattttttgccaggtcagccgaaggaggccaaccaatttcattaaaatttgagaagaaaagagcaaatacaaagttggtttacattggctaagagagccgagcgggaacaagccaagggcttatccccaggaagggagaggagggcagagtaaccagaggaagggtcgctctgaaccgaaataagaagccgactactctctaatttctgcaactatccccgctttcttccagcagatgaactcctctttgatgtcatcggctattgtaacagcaggcttgaagcattgatcgaaaattctagcattcctttccttccaaagaaaccaacaaaccaagaataataggctatcaaaattgttcctgtagcgcagccgacaacagagcctctcctgcagccacctgtcagacaggtgcagggttttctcgccaggcgtagagaaactcacattcatccagcttctgaggatttgccaaactgcatccgtgaaagggcagacgacaaacaggtaatggcagtcttcgctgtccctttggcaaagtgagcagaggtcgccgtgaggccatccacgttttgcgagattgtccgccgttaggcaccggtccttaagggcaatccatatgaagaacctcactctcgacggtagtacatgaaaatttcatacatttctctgactttttatgtttgcaga

SEQ ID NO: 55694 - DNA, 608 bp, Oryza sativa
atccttgtcacctgtccagtctcaacctgatttttctgcattaaaaagatcccactctagctaaatggctgaatggcaatggcgctaggtgatcatttctcccacagagagagagagagagagagagagagagagattgtttattctgcagcaatcgacaaaaaaacggatcgaatcttgagcggcatttttgcaaatgcgtaatcgtgggtttagtctgatctggtgctaatttggtgggagagggtaaggaagaggggggggggggtcccgtggctgagtaggatagtgtacggctttgatgaagtccagtgcaaggcaagccccagcgggtggttagcagtagtagagcagtacagtggcccttgtttttaatgagaaaacacaccttcttttaggtgtacaatcgattgttcatcttattacttgaacctaaccactaaagcaagcacctctttcgttatgagatcaatcatgcaaggttgttagagcttctttctctgcattgctcattgcttcctctgatgccaaaatgtctacccatttttcttgattgtgctgcatgatgaaccgttgccctaacatgtttttggtgccattgttttatc

SEQ ID NO: 55695 - DNA, 460 bp, Oryza sativa
tctattttctcttacagcccagccgtcaaagctatagaaaattgtaccttataaataatatacatgtttatttttatttgttttctactttgactaatctataggatgcttttgtgcaaaaatgaacatattagtttatgcatatgcgcatagacctttattggttgtgtagcttaactcagtaagaataggtctcatatttaggtaatcattactagtcactgactgcagtccagtaccccttttaggacagccactaataaaactttgaaagggaaaaggataaaaatgaaaatgtgctgttcagtttccctaccacaaacccgaagggttatggcaaagctactagtactgttttcccttccaattgatcaagctgtcaccttgacggtattttctaacctatatccttgcttctgcatgcaggacatctggtgccatatacactccctgatgccat

SEQ ID NO: 55696 - DNA, 1501 bp, Oryza sativa
gacgggccatgaaacaatgttattccagggtatagcttcagcccagcacccggcccacgtaagacaacctgcgtgtggcatcacactgactgtgtcgacggtatcgtttgtgcaactttgtgctaaactagttggcgcaacggttggactcaacttggtccggatcggatcggagtatcggacagagtcgtcgacgtgctccggtgctgtgtgctccgctggccatcgcagattcaccgcccggccggccatacgcgtcagcagctatacaagggtgcagcgttcagtcacagcaaacctgaaagccggcgccagctgcatgttctcgcctgcgcttaattagcttacttccaccgctaataggaaagaaaactgtcggaaattaatgcttaaggagcctgctttggagtagtatgaccagcatattttccacccgtaataaacttacatttgtgatcgtgggttaccaaagttaccggtgaaatgagaaccctttgtacacgtacgtgttgtttgggagaacatcaataagctcggagttctaagttcttttttttaataatggaatataatatcccgacctttactcaaaagagctacagccaattattatatagtaacattcaagaacaaagtgtaaatctaaatgaatagaacacaccgtagagaaaagcaaagaatccagtctaacgtaaggagatcacaattattgaagtctatttgtaaatctccaaccataattagcaaaaagttgcataaccgtagtctccaattttcgacatgcaatttttagaaactcttcatcttctagttgtgcccaaaaccgaagccaatgagttgccctgaaaatgaccagcatataggaaaatgatggtgatttattaaaaaccatatcgttcctacaaagccatatttcccaacaaatgacagaagctccaataagtattagtttactcattttcttatcaactcacaaaaaccacccattaaaaatatgagataagctaactggaaaattaaaaccaaaagagaactgaactgttctccataggaatttcacaaaatgacaattcataaagaaatgttgaatagactcattcttcaaacaaaaagaacacttcaagctgccattccagttacgccttgccaaattatccttagttaacacaacccttttaagcaagtaccacatgaaagtttttatcttaagtggcaacttaaacttccaaatacacttatttatctcaatatagccattattaattaaagctaggtatatagacctcaccgagaacaagccattctgatggaaattccatctaaaactatcagacgaatcattcaactggatatgtactatagaggcacacaactcatgccaacaaacaagattctgactaactaaagctctcctgaaagaaacattaagcggaacatatcccataacagtggcaatagaagatgttttccttcgaacaattgcatacaaagacgaatattt

SEQ ID NO: 55697 - DNA, 1501 bp, Oryza sativa
gtcaaatagagttcgtattaaaaccccataatatatacctcttcagaagtgcatacaaaatcttcattggtacgtgtttctgagtcattgtcgtgcgcattttcattggggatttctttgcaatctatagttcccctaatgtcgtcgacaacctatgttttagtcaaaaatgtgtattagagattttacagacaattgatataattagtgtatagtattaaaaatgagatagttacctgcccttttccaaaaaggtaaaaaagtcgttttttttcttttattttgtcccagtactgaattagttgcctttcgcggccagaatgatatattgtcacagccaatttatctattcgcagtttttcccaataccaaatctgcaagcatttgaacataagataatgagtattgctatgaaaatatgttaatgtcaattttgtaaacatactcaatttgtgcattgttttgaaacgaacctgtaagaggcatacattcccctcaatgtttgtttccttctctctaaattttaatatgcctttcagtaactgattcagggttagactagaccagtttagttccctcattttgtcaacgtcgtcgacgagattgagatatcctgagcgcacatatctttgagttgtaagacatatgaaggatccaattgagaaaagaataaatcttcgaatgaagtggtcatcgtagctcgaggagttgattattgctacccgtaatgcttctaaagtaattgttgtttgtccttcttttttgtacaggttgaacaattcaggtttattgatttttggtgcctcaaatatctcatctcctttcgatggcagtccaagcaaacaatcgacatcatcgagtgtcatcgttacgaacgtaccattaatattgaatgctttcttctccttgtcgtagcttcttgcaatctcattgcacaagtcccggtaaatatgtattttgttaatctttagcaagttgccaagtcctgaaacctcgatagctttcttttgaggtggacttagatgtagtattacctcggacatggcatgtggagagcaaactagagttccctgattaacagaaaagagaataagagtttagtccatgtgaaaatttatgcaattgcacatatatatgattgcacattaccaaacctagagatcatttaatcctgctagaaatcaattagaaatcaaaggaaataatgcaacaaacttaagctgtaatgtatgcattaatcatttttttatcctttacaaaaatacatgagaaaagaaaagaaaattcatgctctggcatgttactcgtctgacatgtttaagtgatgtcctccatcactgttctggcagtctatatggccctctctataatttgtttaatcttcattcttatgtgcaggattcagtgaggttgaggagtttcaggggagcaacatgagtgaggtcttcgagggcaacatagtactgtcaggtctgtgccaccttcacccatgaccacatcc

SEQ ID NO: 55698 - DNA, 1501 bp, Oryza sativa
ttcagtataattcataagatctcaattgggttgacgattcaacaaatataaatcagattgtctggatggaatatcatgcattattgagtttctatgctagatggtcacagtgtgtctgtgtgtggcgtagccctgctattttacttctttgatcatgaggccaacatttcattcaacataaatatgcactgcatgtttccaatttcattgctcatgaggccaacatttccaggattcaacataaatatgcactgcatgtttccaatttcattgctcatgaggccagcgccatagttcagacagtaaaaaagacaggctcagaaagcagtacaatcgtttctaagggtttgaattgttgtagtattaacaaaattaacaaacagttggtgctaatgaagtgctgtagtgccattgagtctagatcatctccgcacattgttggctgaaatttcaacttgtaatcctgcataagccgtctccgaagaaatctaagatgtgagcttcgcattgggaggaaatctaagttatgagatgttcttttgtcaatgagatgttttatttttaatattctaagttagtttgcacggatgatcatttagaataagctagttgataaatatttattaaatgatacactatttggatatttattaaatggaactatattccaaattggtcagttaaaagaacatgatttcatcagattggctggtcagatcatatgtacagtactaggctggatctctgcatgctcacaatcgtgatgtcccactgtgtttttgatcgcgtgagatcgattcgccgtctgtctgtgcggcgacacaaacctatccttcattgatgcttcttctccagcgatctggagtacccatctatcaaaggacacaaatggatgtgcaaaatcaccatgaaaacaacaagaacatactatgggacaaaaacagtatatgattttctcactataagtatctgtagtgaaggtcagcaacattactagcataaatgctaaaaacagtacagtgatacaaaattatgatatatgtgaacttatatacaaaaacctaggcgatgaagataaatactacccttagcctgatagaacaatttcctcaacaaaatacagaaggcctcaggttttatgacgctttgatgttccacctgtgtgctgaccgtggaccacgagtgatcccctcataatattgggatggaagctttcctttgttccaagttttcacaaacttctcaaacagatcacgagcagactccaaagaaagatcagagaaaaatttgcctttttcttccttcgaccaggttgcgaactcgttgttctttgcaaaatattcatctttggatatttctttgaaatcctgtttaagtaaaaacaaaagaacaatgataagcatggtctcaaggagaaaggaaatggagagttcaaagggtgcagtatgacattatttatgttttgaacagtttaatacttccccaaaattgttgttagtct

SEQ ID NO: 55699 - DNA, 1501 bp, Oryza sativa
acacattagtcccatttcggcaagttcaactgctattgaactgaaaaataagatttccccgtttatattcaagacatcaactataattcttttactgttaaaataatatattaaagtcaccactgaggagaggaaagggaacagaaagtcaggttgggggggggggatgggaagagtggatacctgatgatttcgccgcacccagccactagcagcgccgcaggccacgccgccgcctgcgtcggacagacgcgacgcaccgcgccaccagccgcgacgccgcctgccaggaggaatagccgccgggcgcgctgccgcctgccggtgcctgcctccgaccagatgcgaaccgaagggggaggggggagatggccgggccgacggacggcgccggagggactggagacggcggcgagggcgggaagggcgggggaggcggactgcgacggagggggcggagaaggcgacgcgggcggaggagagggacggcgactgaggaggcggacaaggcggcgacggcgagcgatacggacggatgcgggcaaggcagcgacgccggggaaggaatagcctacgatgtgaaccgatgcgaaccgaagatgcgcaccgaacaaaacaccccttaccaaaattacccctaaaggatattagaagattacttatctaccctttaaaataaacggtccagattaattctactcggagtataatatttcaagtatattgcaccggagcatcactctatcatattatgtgaaattgatgcgtcaatataaaatgctgagatccaggcatcttttgtgccacttaattaattacctgggcagcaactagtattagctagcaagtgtgactgtcgattgggctatggcctgtgaaagtctattattactctcttccaattagatcgagagtgaaaacactgccaactactctcaatagaagagagaaacgaaatcaaagtggtttaagcgattaatcctaaaatataagtatttttagactctgacacagtcttgaagatgctactttgatcaataatatctataaaaataattaatatgttttaaataaaaaattacatattataatagtttgtttaatgataaatttagtaacatcaagtttacatgattgattttttttctaattctgattaaagttgaaaatatttgatttgtcattgtgtttaaaatgattatattttactatgaagggggtagcatatatgtaataataattaggacacaacagcaataaatgtaccatcccgagatgagatagatggttggtactctcttcgcgaataatataaggtattatagatagaaagagtacgagatacaagaaacacagaatatgacaaaaacctaagttggtcggtgagtgatggaaataaaaataaattgagagtgggcggatgtagcattgccgttgtatggcttgttttatacggatcaaatatttgaattaaaatttgaaatatatattatttttctcg

SEQ ID NO: 55700 - DNA, 1501 bp, Oryza sativa
gatttcaagccgctccgaaggagtgtcaccttgtggccgtgaagagaattcttagatatttagtgcacacacctaatcttggtctttggtatcctaagggagcgaggtttgatctcattggttatgccgatgcggattatgccgggtgcaaagtggataggaaaagcacatcgggtacttgccaattcttgggtaggtcccttgtttcttggtcttccaagaagcaaaactccgtcgccccatccaccgccgaagcggaatacgtttcgacggggagttgttgtgctcaacttctttggatgaagcaaaccttgagagactatggcctaaatgtgtccaaaatcccactcttatgtgacaatgagagcgccattaagttagccaataaccccatccaacattcccgaaccaagcatatagatattcgccaccatttcttgagagaccattccacaagaggcaacatagacatccaacatgtgagaaccgacaaacaattggcggatatcttcaccaagcctctagatgaagctaggttttgtgagttgagaagtgagctaaatatcttggattctcggaatgtggcttgatcttttgcatgcatgtgtttttcatttactagaataggtttgcttgccatatcatgacaaagtgaacattcaattcatgaataaacactagtcataatctatgtggataacttgaaatctatgtgtacggggatctcattctctaatgaatcttggtccttgcacaatttgctatagattcgtacattccctctctcgagggtgcctagttttctttcttttgctgcatttgtccaagtaatagtctagccatcgagttcatcctatcaaaatgttgttgaaaaaaatcttccttgagccatcctttattgtctctgccacaaaggatgtcggactgtctgacatcaagtcagactatccgactacaatcggacagtccgatttcaaatcggactatccgacgtggggccaagggcaaggggacttaacctccccgggggtaactctttcttaccccttcagtcatttgtctcagtcgtttctctctccacccctcttctccactccaaaccctagttctaggccaccaaaaatcttcgtttcggagtctccgattgctattccttcactttagggtggtttccctccctcaactccttccaaatcactggttccccagtgattctcttagtggttcttgaggtatttccttgttttccctcgatctccctcatggtgtattatttcaagatttccttcggtgaatcttcttgttttagtgcctagatctagtacctagaagatcctttgattccattggatatgtttgtgtgaatcgagatttgttggtctagggcaaaaggccgtcggattgtctgatatgctgtcggatagtccgatgtacaccggatagtccgacgtcaaatcagactatccgacctccttttggcccagtccaaatttctccttgc

SEQ ID NO: 55701 - DNA, 799 bp, Oryza sativa
aatagaagtcggggtactcaaaatcgttcatatgcttgacaagagagtcgagatgatccaaagtaaaccaaatacaagattattcgattcagattgaaaacattggttaaaagatagttcaaagcaaaacatcggtaataaaagatgatttaaagtgaaatttgctcattattatgataatagctcgtttgatttacgaggttggcgactaattaaggcttatttagttcccaaaataaaaaatttcacgcagtcatattgaatgtttggacacatgcatggattattaaatgtaggaaaaaaaacaattacacagattgcgtataaattacgagacgaatcttttaagtctaattgcgctatgatttgacaatgtggtgctacaataaatatttactaatgatagattaattaggcttaataaattcgtctcgtagtttcctagcggaatctgtaatttgttttattattagactacatttaatatttcaaatgtatgttcgtatatccaatatggcaacaaaacccaaaaattttccccaacttgtttaggcctaagtaatgcatggatagcaaagaccctatctcgcatgtggtatgtatgattaatttgtcccggccaaaattttgttttaacgcttacaaggttaatatcataagttgtagtacagttttagcaaatcttttggacaaaagcatcggccaataggaaaattgacatgcttgacagcagggaaataaactcatactttaactgtttagttgcaaatgcactatgtattgcggcaacaattaacaa

SEQ ID NO: 55702 - DNA, 802 bp, Oryza sativa
ctggtcgaagaggccggcgccggcggcgttgcggacgaagtcggtgaggaacagccgccttcgtcgcccggtgctaacgggtgggtcacctgtgcccctgctcggcgctgcgacgagcggcggcgcgcgggtcgggaagagcttggtgagcttccgcctcgcgttggcctggatctggtggcgctgcgcgaagaagccgaggagggagggcacccgggtgcccggcggccagcggcggcggagtaaggcctggtcggcgatgaggcggagccaccgcttgcacgctgcggcgcagcggaagagggacgtcgggtccggcacccgcgcgaggatctcgatgacgacgtcctccggaataaccggcaccgcggcggcggcggcggcgcccatttccgccatttccgagtgggcgaggccggcgacgaagcggcggcggcggcggcccgaggtgatgcggagaggtagaggcccagacatagttgggccgggccgggccgggcctagtttatagttggtccgggccgggccaagttctgttgatgattggtcctctcggctctctagcatgagaaaattgacatttagccattctcggattggggtttcgctagaatgccatccccgaacgtggcttcgttataatgccatcttcaaacgtcaccatcttgccacattgccatttcatccaatttcggttatttgcaaatgttatccactatgatcggacttttttgcccctatggctatttcgttgacttgcatgagagggacagatcgatctccatccagtcgtcttcttcct

SEQ ID NO: 55703 - DNA, 1501 bp, Oryza sativa
ctgtaataacattctctatgatcactatgtatataaaaaggatatctctttcgacattgttgttgtacacttgtactggctgcgaagttctattgttgccacagcaaggtcaactaaaactgacaaatcagcattgttgcatcaggcctagtgttgaatgttacaagaaatgtttcttgtaagcagtctctgtaattattatttgttgggagttcttaactgtgatctatgcgccctgcttgagacaggcatatgcctccaaactgaaataatatatacttgatagaaacgattgttcagaaatgacatgaacaatgagcatttctgtatatttatgagtaatcaagagttcaaggctgcatctacaaacatcattcatgcaaattgtcaacttcccatacctttccaaactacacctcgcacatactcggtttcaaaaaagacacctcacacatacaaaacattttatacagcctgcacgttggaggggaaactaagatgacacaatgaaagtacttctattcattttcttataagtagtacttccattcataaatactctctttcagaaataaaatagtaacaactagatgtcattgaattattccatatgtacagattgcacgttgtctaaagtatgacaaaagaaaaaaaaagtatgccaaaagatattgataaagtgattatttatctactatacaagagtattttagatattatctgaaagctattttctttgccggccatgttatctgaaagcttgttgctttaaggcaagaagaaggcctatttctttgcaggtaggcagttgcagaagtcatagatataaaatgacgtcaaatatattcccttactagatcttctatatatcttaattaacgttgctggtgtactgagaacaagggaagagaagtcaattacgcattggtacattagcataaagcaaccgcatttttatacacagacgtgcagaactctcttcagaataagttcgccagaaaaggagttttaggagtgtaatctattactcttaggcctcaaattcacaatagataatttattcactgaaaattttagttttggccattgtgtcattcagttattgttactttcagttgttctaacatttgagctaaactaagaaaaatcttgtgccattttaaccccaactctcacgatcggttgggattaagtataatcatttatgtggccaatgataaataacattatcagaaccaaaagctctaaagaaattttctctgtcaatagatgattccatcaccagaaatggccataggaggagcaataatctgcagcgactaattcgaggcagcgtatagcatcgtggcacgcagaagcttggggatacactcttctttgcctccgtccagtcctataaatggtggagtcagggtggaaggctatgcattgtgctcatcatctcaaagcccttcatctccttgtcatcttgagttgcttgagcttatagatttcgacaaga

SEQ ID NO: 55704 - DNA, 187 bp, Oryza sativa
gtcgcagcgccgagcaggggcacaggtgacccacccgttagcaccgggcggcggcggcggctgttcctcaccgacttcgtccgcaacgccgccggcgccggccttttcgaccaggccaagccgttggcggcgcgcggcgggctcctcctcgtgcgcgtcctcccctcgccctcgccggcgccgcaga

SEQ ID NO: 55705 - DNA, 1265 bp, Oryza sativa
ttttgggacggagggagtacgagctttgctgctgctatgctttcgatctgcagtaacgagctgctacgggcatgtgcatcggtgcatggtcatgtcaggagcaagctcgacaggtaactgaacgacgatagatacgtaggagtatttatcagcaaatattcagagaaaacaaaaaactgcttgcttcccgggaatatgcatcacctggcaagatttacttctcatctcgttccccggggaatttgtttcctgaacatgatcgattctgttctgaagtctgaatctaagtttcagaaataaaattctgaatctctacacctgtccactaatctacaccggacttctgcctgtatattacagttacagcatagtctatcgcagcggttgctgcctactattccctccgtttcacaacgctgtctagattcattaacatcaatatgaatgtgaaaaatactagaatgacttacattgtaaaacggaggaagtacatctttaaatactgtcttcacttttgagctccggcaaaatttcgatgctttagagttcagactgggttgtgttttatcggcaatggaatgtgattccgaagcactgtagcagttttactctagtttgctattgattctattcttagtacttaatgctagtgatttactaaacggctcacattgtcggcgctacaatgtcatgctattgttagaacacagcatcctttttttctgctttcacttgttatttttgctgaacaaaaaaggaaatcaaatctcagcttatatcgaagtgattttccccagactgaacctgaaactttgatctgcctcatccatgaccacgcatctcactacatttatggtggacgatttctctctggtgatttttgttaaacaagaacatgggattatggtgcagaacggaggacaggggaaacaaagaaagcatgccaacgaagtagcgatagcaatatatcattacacagtactcgtgcaaacttagacattgaaaaaatcacaaactcacgcactacagtccgtccataaacgatggccgacgtcgacggatcgagaatggtcgtgcctaagcttgtgttatgtgttgcaatggttcgtcgtggggttaaaggtttacgcgtttactgccaagtagagagaaacaatttagcgttaagatgaacgtataagcaatatacgcagcacgtatttctttctggactcccaagtcccaaccaattgtaggcaatcaggaatggcatggaatgcaacttc

SEQ ID NO: 55706 - DNA, 273 bp, Oryza sativa
attaaacatagactaataaaaaaactaattttataaatgaaagctaatctgcgagacgaattttttaatcctaattaatctataattatgaaaagtttactgtagcatcacattgtcaaatcatggtgtaattagactcaaaagattcgtctcgcgaattagcccaaggttatagaatatgttttataattagtgtatgtttaatactctaaatttgtgtataaacatccgatatgataagtcctgtttcccaaacagaccctaaaatataca

SEQ ID NO: 55707 - DNA, 626 bp, Oryza sativa
ctttagccccggttcataacaccaaccgggactaaagtcccacccctatatatatgtcttcttcctcctccagcccgagcaagcttcaaaatttcttcaaaaaagaggggaggtcatgccaaaatttctagtgaatttattttggtgattatatacaaatcggaggtgcctaaaaggttagcaactttatcctccaatgtttttttttcatattacatttggagctatgttttgcacacttttttgtctccaaaattttgttgttagttgatgagagagaaaatttgtgtggagaagaaagaatatatagaaatttagtttatttgctaaagaaggttttataaaatagctgagaaggaaaatatagtgaaagttaatcttgaataatagaaaacaaagtaaaatgaaaaattaaaataagtacaacacattaatattagtttaaaactttataaatagtaaatatataattattcagtgtaatatttcataatttttgtatgaataatgatatgtcattattgtgtgactgttgaaagagtttgtaattattttataattattgtatgactgtcattattgtacgaataattatgtgtgtacgattttttttcatatcatgtaga

SEQ ID NO: 55708 - DNA, 1501 bp, Oryza sativa
atactttagacaacgtgcaatctgtacatatggaataattcaatgacatctagttgttactattttatttctgaaagagagtatttatgaatggaagtactacttataagaaaatgaatagaagtactttcattgtgtcatcttagtttcccctccaacgtgcaggctgtataaaatgttttgtatgtgtgaggtgtcttttttgaaaccgagtatgtgcgaggtgtagtttggaaaggtatgggaagttgacaatttgcatgaatgatgtttgtagatgcagccttgaactcttgattactcataaatatacagaaatgctcattgttcatgtcatttctgaacaatcgtttctatcaagtatatattatttcagtttggaggcatatgcctgtctcaagcagggcgcatagatcacagttaagaactcccaacaaataataattacagagactgcttacaagaaacatttcttgtaacattcaacactaggcctgatgcaacaatgctgatttgtcagttttagttgaccttgctgtggcaacaatagaacttcgcagccagtacaagtgtacaacaacaatgtcgaaagagatatcctttttatatacatagtgatcatagagaatgttattacagtacgttaacaaagattaaactgaatctacaatcccaacaaactttttaaacagttaatggaggtatggaaatttgtgacacgtctccaaatgtactactacatccgtcctaaaataagtacagccataaatatccatgtttagcgctttgaccatccatcttatttgaaaaatttatgaaaaatattaaaaaaaatagtcacacataaaatactattcatattttatcatctaataataataaaaatattaatcataatttttttaaataagacgaacggttaaacgttgaacataaatagtgctaaaactgcacttattttgggacgaagggagtactctatactctttaaaagtccccagtggtggtggcactgaatctggcatccactattgttttttacttttttagaaattagctcctgatatcttctgatattatgaaatagttcaaatattcggttcaaacaactaaacaagtgatactaatatattcaataatattttaatatccattacatattataatatattttattttattcatagcaaaggaaggtattttgctagtccttcaaaaactttctaattgttgcgaaagttcaagggtgaattttacctatatgggcctcacgtcagcctgcaatcgctttctgggcccaatagtacgggccgcacgcaccccgtaatcccgttccgggccagcccaaccaacgcgggccccacgtcattccgaatggcccggcccaagtagaagactacatcgacagacgggacccacacccccacgcatcccccctctctcgtcgtcgtcgtcgccgccgcctcgccgtcccccgccattggagccatggatctggctc

SEQ ID NO: 55709 - DNA, 1501 bp, Oryza sativa
ggtctgacagcattcaacaccaatgacaccaagtagatgatcacctatctagccattgcaaatatgaccagaaagcaatcccaagcagtagctacagcgccaacaatgcttcaatttttgcaatctgctcttcttcggtcttaggagtagggcttctatttgtttgttcataaaggtcatgcttccatttttctgcttgatcaccagcagcctggtgcatgctgtttcgcccatcatatgagttgttaaacctgtatctgccccttcctctaccagcaaaacgcccccatgaatcatagccatttctttggccagcattcctgtgatcagaaaatcccctcctcataccttgaccatctggccttacgaaaggtccctcatgcctatcaaatccccgtgggtgataatttctcctttcttctcctattgcagaggtaggcccagcttgatcatgtttatgtgaccttgaatctggttctgtaacagaaagcacagattctttcccctccagtggcatgcccatctcattaaatggtggccttcttttggcagggtgagcttcttcctccaactggaagaacccatcatgcttccatgtagattcaccatcattttgttgttcatcctgcatagcctttccttcatctttgtttttctctctatctccaacatgctccttttcatccctttgtcttccccggtctttaaaaaacaataataagcaaacgcaaatgagggaagctgaaaaataaataagggcagaacataaaaaccaagtaggcaactcaccactagcctggcggtaatagcaccgaccaccttgcccagcactgccacgttcatcgtgctgtacatacaagcataagtagcctaatgttgtcaaatacagtgggcacttgtaggtatatgccataaacaaagtcccacaacaacacaaggtatatattactcatgcatattgagctgacgccaaagacataacaacaaaccaatatcctcgctgcatatttttgaacttcgcaacactatgagaaaacaaacattaacatgacagccattgcaataataaataaaaaaaggacccaggaaacagtaaatttaaccaaaatcatatgcaactacttaaaattggaaaatattacaagaaagtactccccacagcctacaaaatgtataaagaaggagatcaagatgtcaattcgttttagtacaacaatacaagatcaattacaatgttagctaccaccaccactacccaaaaaagaaatatatgatttagagataaattagttgttgctttttctagaggaattacttactacttaggaaagaacatctgtttaagctcattctgtgtaaacctaaatcacaatatggaggaacagctagcagaccatggatctaactaatatatacacttgactctaatagaagaaaaatgtaacattgaaatagaagaacaatatatatatatatatatatatatatatatatatatata

SEQ ID NO: 55710 - DNA, 1501 bp, Oryza sativa; identical to SEQ ID NO: 48312

SEQ ID NO: 55711 - DNA, 1501 bp, Oryza sativa
cattgtagacttgtagttgccatgcctcttccagattactttatagagaaattatattgtgcaggtttgagaattgttcaagttcgatcagattaaagggatcggctcacttttgagaattcatatgttccctttctgattcatttgtttagtactttagttcttgagcacagattattgtgagccttcatccatgaataaattatatatatatttgttcagtcattcacaaagtaattatctaaatcgagtactcagtaatatagcagttcatgtgtgttcatgttgtctaatgtagagcagtgcatgactggttagacggtgatgcatcaggcggtggctggccggacaggtgctaagcaagagcatgcgtgcagctgatcagtataatgggtatttgccgattctaattctttgtcccttttggttcaatttcccatgttataacaaaccattatttttgtatttctggcaaagaaagctaatttgcgtaaaaaatgaaggatacaacatttttgctactcaaggatgcggttgaagttgaaaagttggtttcattggttattactgggaacatgaaatgttttatgtttagattttatttttgtagcctaataaaaagcaaatcttaatttctgatctaatgttatactgcattccaccatttgatttctttagcttatacagatatgctggggatgggtgaacaggatggaaggcattttttataggcccttgtcagatgatggcttttggctttaagatgctctatgagaagggtcaaggagattttgttctgttatttaccattgattggcctttggttgatatatatgaattaatatactccataggcacaacaaaaaggtaatattcatatatgcaggattatttctttgctttaagtttttactaatttttactatggttattggtcactggtcagataagggtacatacatatatttgcgtagtataaacatattaaagaaactcagcttagtgtatgcaagggggcatggaacaactctgattctgaataggaataacttcttcctttttctgggctaggaatttgagtgtttactttttcattaacaagccttatatgctcctagctagcagctgctggtgaattgataaaattttggtgattttgtcctaacgcttcaaattttgttttgggtagatccaaggacaaatatattctccaaacacatgaacttttgttaaagaaaaataagatattttattttgatgcacaagtatgtgctatagacccaacctctacccaggggcacacgaccaaaacacattccatgatgctccagaagtctagcactactacaacatgcataatttcatctttatattggctttgatccgggattatcctagccattgtcacatgctgctaagaggcgttccttttttccttctttgtgagaggaggcaaccttcatataagcctggtggcatctctgaccacatgtttggagga

SEQ ID NO: 55712 - DNA, 923 bp, Oryza sativa
cggtcagatagcggtccatggtgatgggtactcctccatttgtgtaccagcaaagttgtaaaaacgccgcctatcaaacaatcaatgttgtaccgtagtaacgttaactgtatagaaataataggggtgttattttaggaaattttaagatacgatagatatatatactactggcctatattttacatttttttcgttttgtattttgtagaaattgaaccattaatatcgatgagagataccatatacataagataagtactcttactactcatacatatattatttgctattatgtcatatatgtcttttttttcttataaagttttctcttaaattacttatccgatatatagtccaattacactattattttcattgcaattaaatctttataacttacatgattatattttgatgaaaaatatttatgtttgcaaaatacttttattgtatatgtatgttactttgatcatatatataaatttacttttagatttgattaaattacttcttatacattcataatgctcttagttgattgattttattattgtttttagtcaatttcatagtttatgatatttaaattaaatttctagatatactcatatttttatattttggatggaatacagagagtaagaagttttgatctaagaatggtggaaattttgtaacgacaaaaaaataataagtaatgtaattatatcaggaagcccaatcggtagaggtaaaggtgaaaagaaaatcggttttttaagcgtgttagcggggggctaaacgaacactccgaagtccgaactactagcacatgaatcatcaagaattttgaattgcggcactgtatttggtgagtggtgtcaggcaagcagagtgacggtgccgtttgtttccgcccttccaattgcctgtgtaaaagg

SEQ ID NO: 55713 - DNA, 1501 bp, Oryza sativa
cgaccggtgcacgaatcttaaagccacccggtccagagccgctcgccgctggcgcggtcgggtggtcgagcccgaccggtttctccgcatctggttcagggtaaaaaccctagctcgcgcaccgcaagcggctagggaggctagcctgtgtgggtggagaaggcggtgggaaaggggagaagaggaagaagaagaagaaggcgcaaatggcgacgggggagtcgcagcaggcgtctcggcgggaggggcgagagcgcgacgagcacgacgcgtctcggcgggagcgggagcgcgaccacacgcacgggaggcgcccccactcctcgtccaggtcgcggcgggacgatcccaggtagtaccaaccaatcccgcagcgaatcccccgccgctctctcgatctggtcgggttccggttcgagctaggagaattgggggtttgggatttgttgattgcagtgtccaatttgcgttccatacttgttggacgatgcaatctgtgcgcttactaacccatttttttcatcggggattcctgttggtagtccgaggaggagaagagaggacaggaggcatcatgaatcagacagaagtcatcgccacaggagtcgagctgaagaaagtgctaaggcagttgaccgtgaccagaagagggataggccattgcaagatgccgcgcagcccgatgatcctttgcgagcggagacgaagcccctagatgatgccagaaatggctctcctgccaggcatgagagatctcctaggggaaccaaacggtttcctgaatcaagagatgctaggcggcctcgatcgttctttcaggttcttgtctttttctcaaatgtgcatcaagggactacactctttgcttccaattgtttggtagctgttaaccgtgtgcttggtagctactttcagtgtaagcaggatggttcttggttctgcaaccctactagctttgccgaatgtagcatttgtagctagctttagttaaaagccatgaatccattggtcccagctgctggtgctacaatgtgcaaacaatagtgtatatgatatgtcgggtttcttctgagaaaccatgggaaattgtgaaaaatgtggtgtttcttggctctcgagtgcttcattgcgacatattcacacaggataccaatgatcgaaaatgagatatgggtgggaaagagacaaaatggaagttctagtagaccaaactagcctggctttgtatgtttgcatacgtatgcccagacagtaacaattataaatgctggttctacttatataatatctttctgttgcccttttaaaaaatatgcaagcttgcacaatagccaattcatttaatttctatatttagttcacatatccaatatagtattgtctaaacaagtgatcaccactcactgaaatattgggtgtcacaagttacttcctgtgtgtgtttgtagagtatgtagccatatgcccatatatatatatatatatatatatatatatatat

SEQ ID NO: 55714 - DNA, 1501 bp, Oryza sativa
caaacgtatatgaactatcctgatttatgcagcagcattataatcaacagaaaaaccgaaatgctgccacacagcaagattttgcaacagaatatgatggacaaaagccattattgtagcttcaagttgagccattattgtactgaatagcagaagttgtgccaaagagtatgttggctaagcatcaggagccagcagatgaacctgccccactcattcttgcggctagacggctagtgtgcccagcaacagcaacaaaacaaaacaatattatggtcttctaatttaagtactaaccaataaccatgctaactctgctaaatatgtgcactgataaagtaccaactctgatacaagcctaccaagcttcacaaatccttaaaaaaaatgttcaatcatgaagtaagaaccattcctggattgaaataaaccaaatcctaaatcaactatgaattaaatcctagtttcctaattcattcctaaatcctaaacataaaccatctacgggcagggcagggaatgaggggaagagttaccttcgtccctcgggcttcgtctggagctccggaacggcgccgctggcgctggcgctggcgcatggactggaggcgccgagacacctagagcgggccgccggcgctggcgcgtggaggggccgaagcagcgaagcggcgaccgcgcgactgggacaggggacggtggcaaagcgcgacgcggcgacgggcgacgggcgacggggcgacgggcgggcgtgcgcgggcgcagggcgaagtcgccggcgcggcgcggcgcgtcggtctcctccctggtggcctcggcctggcggctggaacgctggatagggaacgagatgagggtttaggaagtttttgagctttttttttttgttattgggccaatgggcctcaaatagtgaggagaggaggatggtaagccttatagtttgggcttcttttgaatggtagacatttttttatttttctatttttttctatataagtatatactttatatatgtatttttttcttcaaaaatcttggatattcatttgaatacctatgaatcatggtgggcccgcctgagtcgaaccaccaagaaaagtagcaatagaagcagctgtatcggtgtatcgctccctctaccattactgttgtactccctccattccaaattaatcatcataaaatctttttgagaatattccaaaatgatcatcatatttgtgttcattcattatgtttatttgttatttgtgcattgaagtaaatgaatattgatgcatgcacccatgcacaaagtgttttgatttgctattggctaaaaaatagtggggaatgtgtatgcatcgagtttgttgctagaataaatgtagtatgagagagttattatattttcttggtcttaatacacccatgtaatatgattatcaatttggaatggaggtaatacacattgtgctaaactgaactacatctatgctgttcaagagcatgatataga

SEQ ID NO: 55715 - DNA, 823 bp, Oryza sativa
ataaattttgtttttttctaatttctttctatatcatattaatatcgacaacgaatagttcaaatgatgaatatggtccattgccgaccgatcgactgtcgttttcgaatagatgctaccaattccgatcgtttttactccgtctgactcatgagtcaacatgactttatcccaaaataaaccaatttccgaagtttgaattgtgtcttaaaaaatgaatcaacttctattttcttgcctaccatctgcctgtaaatcaagaaattttattcctttaatactccatcacctactcgtctgccaatataatttttcattaattatggattttttttgtgttagattaatgggctaggccaattaaatcataataaatttcattggcctacagtaagtgctatgggtaataataccatcttggaaatctaagtgaagaggtctcaatttaaatacggggctagttgagagtctctattgaccaattgagatggtgggcggacagctacacacatgcacgcgcgaggcgaggcgaggcaggctgcgctcgcctggttctgttcacctgcacaacgccgtgaattgatttcgtattatcctgagctgcataatcctttcccggttctattcacttgcacgtcgtgaattgattccgtcggttacgaaataaaacgttccgtcggttacggaataaaacgccatgaattgattctgtattatcctgagctatagaatcctttctcggttttgttcacctgcgcgcgcatgtgtaggggacgatgagcaggtgcctccgtaactccgtcggttacgggataaaacgcca

SEQ ID NO: 55716 - DNA, 1501 bp, Oryza sativa
aggctcgacagccggcaccgccaaccggggacacgggggccggcccccgtgcccggaccgaagtggcgctccggacgagaaagcgccctccgttgcgtgggcggcgcgacgatcgtcgcgctggcgctcgatatcgagccgggcatccgaccccccacgctcatcttcttgggtcggaggcgttgacgagggaatggcggacgaacggcgggtgacggccgccgctcgccgcgccctccgccttgacgacgtggagccggcggcggcagcgccagaggcctcgggggcggagggccgcccaccggcgcctaggcgctgctgcgccgtcatgaccaagtcggccacgtcatccagccaacgtcgggctggagtctctggatcggggacgacgggcgggtgacgcaagagcgcacccgcagcctggagcgcgccctggggcgtgctgccatcgccgtagtcgaggcggcgacgcgccccgtctcgccgtcctcccccgtcgcccgcgggcggcgatgtcgcggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttcgaaaaacacgcgcgccccctacctggcgcgccagatgacggagcgtggggcccctcaccggaagaccgcgcaggcccccctttgccggttcggccgagggcgctatgtgaggttcttcgccctcgatcagaggaatgtcagcgagaaggatcgcacaagacgcgggcgacgtagacatgttcgggctgctgagaagcgtaataccctactcctgtgttctggtggatctgtatgtgaaggaatacagagagctcgagagccagagagagttcaggctcctcctcaaaaatcccccaagaaaatcccccttcttctaggcctgggcctcctttttatctggtcagcggtcaccacaggggcctctagctgcctaagaaaggaaacatgctttttacaatgagggctagtctacagccggaagtgacccttgacaagcagtgcgctcgtctcctgccccgctcgtcagcttttccggaggacgcccatttcaaacttcatttaatggccggcgacttccttgccattcttgcgctgaagtctggaatgaatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctttgaccggtcacacaccgcgactggtcacggaccggataagcatgcgctgcgccgcattgaatgcggcgtggcgcgctcgtctaac

SEQ ID NO: 55717 - DNA, 1501 bp, Oryza sativa
gcgcgccctggggcgtgctgccatcgccgtagtcgaggcggcgacgcgccccgtctcgccgtcctcccccgtcgcccgcgggcggcgatgtcgcggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttcgaaaaacacgcgcgccccctacctggcgcgccagatgacggagcgtggggcccctcaccggaagaccgcgcaggcccccctttgccggttcggccgagggcgctatgtgaggttcttcgccctcgatcagaggaatgtcagcgagaaggatcgcacaagacgcgggcgacgtagacatgttcgggctgctgagaagcgtaataccctactcctgtgttctggtggatctgtatgtgaaggaatacagagagctcgagagccagagagagttcaggctcctcctcaaaaatcccccaagaaaatcccccttcttctaggcctgggcctcctttttatctggtcaggggtcaccacaggggcctctagctgcctaagaaaggaaacatgctttttacaatgagggctagtctacagccggaagtgacccttgacaagcagtgcgcacgtctcctgccccgctcgtcagcttttccggaggacgcccatttcaaacttcatttaatggccggcgacttccttgccattcttgcgctgaagtctggaatgaatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacggactggataagcatgcgctgcgccgcattgaatgcagcgtggcgcgctcgtctaacccgctataaatgcggttaggtgagcgcctgctgtgctcacctaacccacacacatggtgccaaaaccacagggggtcggggcgccccagccctcggggccgaaacgggtgcggcccgacccctcggggagacagagggaggggtggccgcgtcaccctcgggcccgaaccccccccccccccgagggggtcaggccacgtgggcgaccgcggttacccaagcctctagtcacgatacccccggtcccatgtcaccgacagtagcccccggcgttacgccagggcgatcgcccccctcgagggaagcgctcgggcgtgacgccactccttaggcctggtgacaggtggggccggtctctacaggcgggcagaaacccagcggtcgtaaatcgcgcgcatcggcaagggaaaaccgatcgacaataa

SEQ ID NO: 55718 - DNA, 1501 bp, Oryza sativa
accgctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccgccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcatccccgcacacgcggtgatctacgcgttcagggggggcgtgcggcacaaccgca

SEQ ID NO: 55719 - DNA, 1501 bp, Oryza sativa
acccctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccgccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcatccccgcacacgcggtgatctacgcgttcagggggggcgtgcggcacaaccgca

SEQ ID NO: 55720 - DNA, 1501 bp, Oryza sativa
aggggggtgtagaaccaattgctcttccagtcgtcccacttcttgcggaggacgcagggaatgtagcggtgcagcacctgcccccgcggctggaagtagcagccaccgaccaccgtcggcggcgacaccggctgtacagtgaagaaccaccggaacagccggagagatgggcgcaccccgatgaacatctcgcacaggtgcgcgaagatggccagcgtcattattgcgttgggggtgaggtgcgccatctggagatcataaaactccagaacatccatgaagaaattagagaatggcgggaccagcccggccattgcgaaagagaggaagaagacggaccgccccgggtagtgtggcgccaggcatccctcgcccagctcgaccacctcccggccggtggcagattccggcatgaatcggcgcggcagcccggcctgcctctcgctcacgatgcgggaaggcggcagcacgctaccatcaagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatcccttcctcggcgtctttattcccttgccagcgctatgtccggctcctcgcttcccgtgcccactaccttgccccctcgtttctcgcgcccacgcctccactaaccccactcgcccgtttgcggcgcacgcggcagatgtgcggccgtgacggttgagatggggcagatcgtgcgcgcattaactgcgttcgccaaccgagaagagcgccatcatcatgtctccaggcgaaacgaaccggcttgtcccgattcgcgcgctgctcgagtaatgcagcggtcttgaagagaccgctcattattgtcgatcggttttcccttgccgatgcgcgcgatttacgaccgctgggtttctgcccgcctgtagagaccggccccacctgtcaccaggcctaaggagtggcgtcacgcccgagcgcttccctcgaggggggcgatcgccctggcgtaacgccgggggctactgtcggtgacatgggaccgggggtatcgtgactagaggcttgggtaaccgcggtcgcccacgtggcctgaccccctcggggggggggggggttcgggcccgagggtgacgcggccacccctccctctgtctccccgaggggtcgggccgcacccgtttcggccccgagggctggggcgccccgaccccctgtggttttggcaccatgtgtgtgggttaggtgagcacagcaggcgctcacctaaccgcatttatagcgggttagacgagcgcgccacgctgcattcaatgcggcgcagcgcatgcttatccagtccgtgaccagtcgcggtgtgtgaccggtcacagaccggtcagatcgcgggttaggtggcaacaggcggcctgtcacacgcctcgccccgtcccgtcggaa

SEQ ID NO: 55721 - DNA, 1501 bp, Oryza sativa
tagagccgtaccaaagcctcatttttctctctccttggcaagctcactcttgagttcatgagatcgctctttctcacgaatgagcaaatcctcttgcctctcaagagttgcatattggtcctcaattctccctagcaactcactcaagtgtggtagtgattccttagttatggacttggacaattcgtcatccataacctcatcctcctcatcactaacaagatcaacattaaatgatttgagaggagaaggtaccttaggctcctttgccatgaggcaaatgggagcatcctcatcacttgagtagtcgaagagtctcagcggtgatgaaggcttgacggcgaacgtggcgactccttcttcatcacttgagcttgactcggagtcggagccgaagatcatcccaaggtgagcttggcaataatgttcccgcttgttatgcttatacttctccttcttctcatccttcttctcacccttcttatcttccttgatgtgggaaccatccttgaggtgagggcaatccgcaatgaaatgcccgggctctttgcacacatagcacactcttgcggaatgtcttccacttgacttgttggagtgatgcttggaagaatttcccttgaagaagccgcttcgcctcatgaacttgccgaacttcttggggcattgagagtttcgattcaatgtgggaatgactaagacaagttaggcgaaacagatatgcaccatagaggtttatccaccgtaggtttgtagacaagaatagtagtcacagcgagggatgcacataaataagaaaatacaaaaaacctttccatacattttaggcacagaaaacctgctttcaaaaaagatgaataaagtgttaactagcacaatctatcctcctacgtagacagtttgccagcagatgcagttggattctaaaacttctgcagtactctgggtgcttctgctggaccttggtgctagcatgcacatgaaatgacacctaatgcaatatttgaatacatgagaaggcaaatgagtgctgccaaagtccatggcaaatgtcacttcttggttgcgtagctggacacttgatccatatataagacaaatacatactcaaacttaaaaagaaaaggttaagcaagagcattgctacattatgataaaggtacacatcagtcacagaaacatcagagctttagggcatcgcatacctgcaaaggaaaaagactctctccaggaatagtctcatcaaatgcctgaaatcatcagagttgtgtcacttattttatattctcaaaggtacaggcaaaataaaatacatagtactattactatattagtgaaagcaataccgttccatcaatatcttcttccctcaaacgcatgacatattcaagaagttttccaccattcatgtgctcagtatcattttccttctgcttctgagccatcctagtcttgagttccttcgcgagatcattttgtgcaccattgtattgaagctctt

SEQ ID NO: 55722 - DNA, 1501 bp, Oryza sativa
caagtctgaacttttgaactccgtgacgacctgaaggaagtttctgtcgaaacaagatttcggcaatactaaaaggggtggctatcaagctagaaaagtggatgggtttggagacaaaggatttacacaggttcaggccttcttattcaacaagtaataccctactcctgtccggggatgaatccgccgagtgtattattggatgtataatctccaagaaagttgatgtctcaggaagaactcggacccctccttataaaggggaaggagtccgtattacaaggtataactcatatccttatcagaatacgagagtacagataaaatacaatcgtaaccgactaagccttagggtatttccttgacgtacaagttaagaaacaaacccgagatataaataaagatattctatctatattcggtatcctatatccagtctaaatataatcgccgtgtagatatggggtatccataatctccacagtagcccccgagacctttgcagtcaacaacatagctttctcaaaaataataatccgagtgctttaatttttccctgctaaggcctgccgagtagcgaagacaaagactgtaaagggcgaaaagataaaaaacatggtgcatcgaatagatgcacctaattaggtgtagcccccgactatatgattagttaacaaactaaacatgtagtcgagaacaaaataatagcataatcatgtatcatatgacaaaagcatatgcggcgcccaacaaggcattcagccgactgcttttcagccatagtaaaaagtatccgagtgaataacacgctaaaaagttcacaaatgaacatatttgacaggcatctgagtaaaaaactctaaagataatccatcaaatattataaaaatcatggtaattgataagtctaatagcctaggctatgactctcaccataattaaaataggcatataacacgccaagagaatgaccattgtaaaaacaagtcatcccaaattaacccagacagcttttgcagcctaaaaaagcttacaaaaatagtataacacttttctgccgggtaccttttaatttgcattgcaataattccgaagaattatataaccgcattaaaaaggattttatcagcattgggccacaccattgcgagcataaattgccaaagcaaaaatgcctaagtccctaaggagcacaacgggccacactgttaataatattgggctgaagtacttatcaggcctaggcccattagcacccccgaaacccttaacaaaaaatcccgaagtctaagcggcgcttcgtcttccccgccggaactctcgccattttccccattccgtgctatagtacagaactgcgccggcgaaactagggttcaccattccgctccaatccacctccaaaaagttcaccaaaatcctccccgcgactcaccgcttcaattccacatctctccccagccatccctcgaatcaaatcagctcattcggatcaaatcga

SEQ ID NO: 55723 - DNA, 212 bp, Oryza sativa
ctagggccgtcgtatagcctccccaccgccgccatcgcgatccccggtgccggccgctgcttgttcgtcgctcgattgccgcgaatcgccaaaggagctccgattccctcgcgtcgccggtgagctctccatttttatccatctccggctggccactttgatcgtcgcgatcgtcctctccatccctaactcctctcctcaccttctttagg

SEQ ID NO: 55724 - DNA, 1501 bp, Oryza sativa
tgatttggttgattgcaacatctttgtttccaaaatccggggcatacatcctcgtcagattgtgtaaaaaaacagaagggccaatcccttccgtccatctcatcagcttttgtgaaaagccctttgacgctgtccaagcagaagggcgatccaggcggcaagttcaattgttttgaacaaaatcattttggaatgtgatagccagattctcaaacaagctattatgagcaatgactcccaactttgaggtgtcatttttttaggataccgaaagcttctttttgttaatgtttaatgatgtacgggtaacacattcccttgtgtaacaatgtgactcacttcatatgcctatgtgggctgtgtacgaaacaatatgctgtgtcttttatggattgaccggtccccgtcttatgtaagagaaaatccaaaatatatcattgacaaatgttcaattaaaaaaattgttatcgacaagtacaagttcttgaaatgttattatacaagcgactttatcctaaaaataacacacctaacagctctccgttaagtgctataggataaacaatgcatttaacgacgcgggatggacgaaactctaacggcgatgatattttttggacaaaatcgcttatatgatagtactttatagaactcacactcgtcgatagcatttctttgatttgtgtgtttgtcgatagcattttttagattctctttatgtaatgtgtgttggtgaccaatgacctaggctgtgttcttttctgcatattgggtgagccagttcctcaattaccatagcacgtttatcaaagtgttaattgttaaaccatgcaatctttaaaaacttttcatacgatttttttaaaaaataactaaaaatatcatttttcaaatttacaattgtcaccctattttgcctcccatatgttgccaatgatcaaatcatacccccaatcacaaagctaggtataacgactccatctttaaaaccggtgcaaatcaactcctacagtggttttggaaacggtttttgctgacttgacaatttaactatgaatgactcgcttcagtcagcgtgtgggaccatcttatcatcttccaatagcagtaaaggcagggagggcacatcggcctaggataaggaccatgtcctctatccaatggtcctgattgtattggtggagtgacatggtgaaatccccaagggggttgatagggtgggtagggagggtagtagtatggtgaaataaaaggtcgatgcatggaatttagatgattgtaaggtggggtgccttgccaatttggtgggaatggattgtgtggtggaattggaggtggtggtggtggcatggcaggaggtgtgtcaaagaatactgatgtattccattcaacattatgactctgtgttggagtggcatgaaccgttggagtgaaaattttactacccaaactagctgaagcggatgcatcccaaaatcagtcacaggcatcaaacaagaaa

SEQ ID NO: 55725 - DNA, 175 bp, Oryza sativa
ccattgtctcttgtactgcaccagtggcaccgtcctccagtcctcatcctcctctcggccgggggcccatataaacccccaaggggagcgtggcttccattcgcccaagcctttcgagtcgtcttctccccttcttctcctcctcctcctcgattcggagctccacccgcagcca

SEQ ID NO: 55726 - DNA, 574 bp, Oryza sativa
gggcggccgctctccactagtggatccccccagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttgcggcgcattgagtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggcgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatca

SEQ ID NO: 55727 - DNA, 354 bp, Oryza sativa
caactgtggctctgttcttgaacgtacaggagcttcaggttcttaagctttgagaacgttgaagggaatggaccactcaagccagcactatcagtgtacctgttattaatgaaatgcaacaatcatgcatgttcaacaataggtatcttgctggtccaaattaaactttgttcttctagaagtagcatctgtcaagttagaaagagggggcttacaaacttacaatcgttgaagtttggtcaggttgcccaattctttaggaagttgaccagtaaaattggtcaaactgatgcctctgaaacaaaagaaatatttcaggagtgatataatttatttgcatgctatgctactagc

SEQ ID NO: 55728 - DNA, 534 bp, Oryza sativa
ttcccttagttagcctctgcctaggagttcaaataatctagctctactcagaccaaagtaagcaagcccatggggacaatctgctggtgcattttaccagcaacttgtcctaaacaaaccccatccaaataggtccaaagtgttgcatgtttcctactacctcggtcctagaatataaggagttttagggttggacatgggttttcataaagtaggtggaattaaatgtgggaaggttgtgattggtgagaggagaatataggtggagaagtttctatattctgggacaaattttgaaagctagaagttgttgtattttgggactgaaggagtgccttttacactcgaattaaaagggttggtattttctacagcaaacaatacggagtagatagcaaaaggcagatatgcatagtcattacttactagcatgtgatatgcagaaggtgcttgctatttaagcttcatttacatctgtaggatagcttccaaggactcttaaaaaggttgcaaactcctgtaaataaaacaaga

SEQ ID NO: 55729 - DNA, 1501 bp, Oryza sativa
aaaagataattctaaaaataaactataaaaaattaaaattaagttttggctacggctgataacctataagtcaattaaatgatggttatcaccaatgctatttttttttttgcaataaaggaccaactaaggataatttcatttcatttcaacatatcattattataaaattatctgttatactctttaaaaatgtatcaagatgtaccatatatataagtggatgtatcaaatttcagtacttgtatagtatctctttgtatatatatttctgctttttttacacactgcactatataatgtcaaattcattcatttgccaataaaatctgacagaatataaacacatgcatgcacaatgatgtaggctaccaatatatgtacctatatataatgttgtggagtatgtactgcgactggagagctacatgcatatatatatactcccaacacaactgcagcctttgcaaggcgtttcaaaaagcctccaaaagtcatggataaaaaccttaaattccttttcatgcagtgataaaagtcgttgtcttcgtcacagcatgaggcagatacttgggtgctactcctttggctcctagttatttgttgtacctactgataagataagaagttcatatacatccgtttgaaaaaggatgacgtcctaataaaaaaacatgtgagtaaaacctcaaaatcttaaattattaataggtaaactatatatgctttatattaacagatttttgattgaaacactctttcacttggttatacttttagtaatatttataaatgcataatttgaaaattcaatggtacactaccagactgtcgatgtcgtccaaagcgctaagtaaaaaaaaggaacgtgggaagtaattatactgatactttttgtcacagacaagatatagtcattttcacgctatatataaatcgtagtaagatttgtgcatacattggcgaccgatgtacctctccgcgatagaataaatcaacttttgtacacaaatctacacatagggtctacatccatatatatttaaaagtttgatgatatactcgcatatacagtacgacaaatcgacgatatatatcaacataaatcgaactatacgatttttccgtatatcagtggtcgatatattcctctgtcccaaaataaattaacatttatatactaatctagatatatatgtgctatatatatccatatattcgtgtataaaagtttgtttgatattgtgctcgcatagtacgatgaatcaacaacatcgatcgatgtgctatttaaccagctaagctagatagatagcctccgtgtttgtttccggtgagagaaatcaagagatgggtggccacgtcatcgtgtggatattgctctcggtgtgctcatggcggatttcagctgctcaggctcagcaaccaccaagaaccgatcctgtagaaggtatagtaatcaatgtcgccgcgattgattaattttacttctctcgttgcc

SEQ ID NO: 55730 - DNA, 308 bp, Oryza sativa
ttctaatgagaacccagaaatcgaaattgctcttttccttctttttttgataattatatggaaataaatccagcctctaattgctcttttcctgatttttttttctttgaaaatagtaggttctctttctttagccttttcttgagtccagaagtgtactgttccagtatgttagagtacctggtttatgtagtactaggatgctttactttgccttcatttatcaatataatgacgcactgggagagaatcaattttcatgcattagtttctggtgtaccactcactcaagtgttcccttttttagg

SEQ ID NO: 55731 - DNA, 358 bp, Oryza sativa
aaggggtcggggtgcctcggcctcggggccggggcaagcgcaaccagaccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataa

SEQ ID NO: 55732 - DNA, 1501 bp, Oryza sativa
tatatatatatatatatatatatatatatatatatatatatgacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatgatgcccgggcaccatggagcaccaaacaaatttactatatatatatatatatatatatatatatatatatatatatatatattaatgttaactcattacatcgagaaaaaaaaagtcaattttactccctcgaacttttgcactggaacacttaacctcctaaataatttcttggctcattttacaccccaaaatattgaaaatggttcaccttactccctaacaatatttgtctttttcgtctctgatctatgtataggtcatattttgcaatgaaattttggtggattgatatataaattataacttatctctcaatatttagggaaattaggtggtattgatatatacattataacttatctctcaatattttattttgaaactttttaatcggtgtttacataggttgtaactactaagactaatttaaacgtagaggttttaaatttcaagtaaatagtcatgaaaaattttaaaactattttataactttaataatggtgtcatctatggctttaaaaattttaagcttaaaatataatttgtataaagagaaacaaataaggaaaatgtaattaaccagtaaagtgaacttagctagggggtaaaatgagtcgaaaaatagtttagatgattgattcaataaaatagtttacgggagtaaattggaccatatctacagcaagagcaacccaattaaaggaaagctaattatcaatttgtaacatacaaaatacaagttaaatttaagtatttaaatctattttggaaagttaattttgtttccatcgtaatactaaaaccaaaatagcaataatccaaatgaaattcaaaaaacccaactatgaaaataagttgtcgtgcaaataagtcattattaaattcgatagtggtgtcattggagtgtttaaatcaatattaaaaataaaatatcaaaacccaatttctagcggcgcattttgcactcacagttgcaatctcgtaattcaaatcaaatcttggctgttgcatttgcagtttatcccctttctttctctctatctaaattccctctttattactcacaaaaattcaaagcacactgttcattgccatctagg

SEQ ID NO: 55733 - DNA, 190 bp, Oryza sativa
ttttttttagcaaactagacatagacaatgtactatttaacgagccagagcatattttggcttcaaacaaaaatgatccattattttccaagagtatatatgaatcatttttttgtaagactaaacagtatggatcgattgctttaggattgctgtgcctgtgcgttgtaaagtttgcacgaggccagca

SEQ ID NO: 55734 - DNA, 1501 bp, Oryza sativa
agctagcagcatgcattaatgatcgggaagggccacttcctcgcggtggttggggttggcttagctttttcgatctaccggccagatccatatatcgtcgaatggatgcatgcatgtggtctgcctctgcttgagcaagcaaagcaaagcaaccaggcgtcgtctattgccctaccatatatactttgtccctacatgccacgcaacaaaccaagaatacacgctcgctcgatctatcgagctccatatatacagggggtgactaaatcaaatgaaaatatatatggaacatcacctatagatttttttagttactcggtaatgccctactcgatcagtataagaacggatgtactataatagtattggaatatatagtactaccttcgtcaaaaaaaaggttgcagttttatatttttttttatgtctaatgtttgaccgttcgtcctgtttgaaagaaaaatatgattagtagttttgttgttattagatgataaaatataaatactaatttttttaaaaggatttcataaagttttcaaataagacggacagtcaaacgttggacacgaaaatctataactacacttaaattggaacgaatgtagtattaattacatcaaattgcatatgcctatattagcctcgatctgtaatgctgagttcatcgtcatcaagtgctactgctattctcggtagtttggctattttagtttatttgcgcgcgcacttcgcggtaatgataaattgcggatctaactatacatgatttggaaccatatcgaggacaataataatctctctatgtaatctatagcagtccgcctgttcagtttgtttcatgtgacagcgtccctccacttgttactataagagcaagtttaatagtatagctaactactagctccaaatcatttatagccaatatctataactaatataaatattcggatttttccggtcgttacctcatccatacggtaatttttcgtccctccccccctcaaaaaacccagtcggaattccatcatcacacaaatagaatcccacattgagcacaccttctctccaatctcaaatcatcacaatccaaatccaaatcaaacacaaaatccaagtccaaatctaaatcggaatcattagaaaacatcatattaacacgagatgactaggagagaaggggcgagccgaaccggaggctgcagcgcgctgctcctcgccacctcgccgtcggccacgaacccacccgccgacgccgccgacacctgtaggatcaaggaggccgactagagggggggtgaataggcggtttttcaaacttttagctaaaaccgagttttatatgcggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaatt

SEQ ID NO: 55735 - DNA, 1501 bp, Oryza sativa
cactgtaaaatcttcgacaagacgccaaaggtgataaggccgctgatacatacagccacaataatattcgctctttgccatgccgtgctagctagtagctagtagcttgtcgactgatgagagatggaagatgatattgatcgatatatggatgcaaaaattattgtggcagtttgcgacgggggtgtttcgaccaaacacaggctctggtagttccttgtaagctgaagcaactcgcagatgctctctccatttcgtgttaggtcactttaagtttctttttttaatcattttttttgaaagtttaatcaagtttataaaaaaaaatataacaacacttatagccttaaattagtttcattacgtcttacattgaacatattttgatattttctgttaaaaatatcgtctataaattaatttagtcaaacctcaaaacgactttataatatgaaatagacatagtaaataggaaaacgtgagttgctgaaaaaatatgtaatggaaaatgataaaaagttgatgttagagaaaatgttttacttatgttgacatgaataaatcctaagatgtctattttttttccacaatagttggttttcgctgcatatgtgatttaactgtgtattcttcctgagttgctagctgctactttttttttaaactctaaaacatcttggctacgactagctaagtagctagtataaaaaaaaacccagtaaactatagtatcctcttatatttaactgtgaggcttttctccgtttctcgtgaaaacgagctactccctctatctcccataaagaatgcatttttcagttcttatataacgtttgactctccaacttatttaaaaaataattataattaatatttttactgttattagatgataaaatatgaataataattatatgcgactatttttaaatttattttataaattttttaagtaatggcttgtttggtagagtttcaactcctaaatttagcttcaggaagttagatctggagtggagttgtgaagctgtttaaactcaggtccacctctctagcttattttatgagagagttctacacaactctgctcgtatttttagccgagctttagcttaagaagaggtggagccgatattctccgtgaagtttacccccaacaaatattcggaaagttgacgcattccagacgggacctaaagcttggcattatccggtgtgggggagctagagattcgtttcgtgaggcggatggcgcctttggagcgcgtgcctctcgatcgaggcgtgtgtcctcctccatccagctgctacgtctccagaagatgatatgattcttcttcttcctttggttaattgtcgtcttcttctctctctctgcatccagccgatatatataccaccagccgaagcagccattgctcctcaccaccagagcacaagaaagcataagcaacacaagggattaactcatcactcacttagctaattaaatcttcgacca

SEQ ID NO: 55736 - DNA, 1501 bp, Oryza sativa
aaaccccgaatttgatttttcttcagagcacgaaacgtgtataaaagtacacaagaaaataggatctctagtacggaagcatttatcttcttctgaaaattcagaaatgttccaaatctgaaacgtgctactgctagagccacatatgggcagtcccaatccataacactagacatggtttccataaactccacatcatcaagaaactagtgctagacactactcttccaatgcaaacaccactattccatactttaatttaatgctatttatctcacatgatgtcttagatgttgtgtagaaactatgtctcatacaagacatggttttcttctctttcctcatttattcacttgccacatcattttttgtcctaggtgacaacttatttaatgctatgaacactatcctagtcattgggttgggaatgccctaatgatttgatttgaatagttctttactacttagtactattagtacggagtactagctaatcattgagcaaaaaaaagatgtgagatgaaaacagcaactagccggggacgcgaagcacatggtataacacgggacgatgggaaaaatagatgccagaggttggtagagactgaaactgcaggcccgttcatgcttctttgtcgtgttactccttggcgaactgcccatgatctcatctcgccatcaaaccgtacgatgctaggagcaccacaagtttacggtaactcttcaaaatttactttctcggttataaaaattagcaatatagtactaaactttcttttttaaaaaaactatttttataggcaacacatgcagaaacaaatatattaaaaatgatgtatatggtttgctcccttcgtcccataaaaacccaccagtatgagaggtgatattttcaagcacagtgaatctgaacagaagactatccaaattcgttgtacttgtaaataccatatccaatagttttcagaatgagggagtatggcttatgaaatatagcaatatagtgaattgtttttttcataggcaacacatacagagaccaatcatattgagaacagtgtatgtatatggtttcatatagataaaacccatttcatctttttcatattatttttttcatatttaatgagaatggattttttagtgggagtggcctaagaattaatctaaactggctggtactaattaattatggagagaatcattaagagcaagtttaatagtacagcccactgctagctccaattcatctatatatagtcaatctaacagtcaattcatacaatagttgcttacgatactataaatatttggtcccacatgtcatacacatactgtgtcttggagtccgtgctgcagctggctacagatctgtagtccgctgctcttctctgttatcttttatctcattaaaatatatttatagctcactaatagtttgctattgtacttgctctaagaaacagcactgattgcgataaggaattgaatccctactagt

SEQ ID NO: 55737 - DNA, 1501 bp, Oryza sativa
gaagtgacaacccgcgcttcctcctcgtggcatgatacctgatacctagtacttggcacctaatacctatgggtatcggctgatacctggctatcaagtctgataccagtgggtatcaggcttgatacctcgaggtatcaaggatgatacccgaggtatcatgcttgatacctagtacctgacacctgaggtatcaggcctggtacccggtatcaactgaggatgacgtacctgcaaacaatggagacgagcagcgaggagcacagtgcggcaagctcgagacgcgtaggaagcaccttgtcgtcagtgcactggtcctcgcgcgtccccctcactctcagccttgcattctctcctcttctccgtcctcaacgaagacaacgccgatcttgctgtcgcaatgaccttccgcttgctgacgtcaccaatttcccgatggccccatgacctcgccgatctctctcaccgatgtccaatctggtgtatgaaggggggaggaggatgaaggacgccttagggttaggaacgacgtcaattggttctccggtgaccggacatgggatcgatatgggttggaggagtcggggaagggagggaggtggaggatggcgatcagctcagggaaagatggggaagaaaacggatctgagaaatggatctggaaaacagtcgtgctctattatattgagtcattccgttagaacgggagaccgttctatagtttttctggtatatttaaggaaggaagaatgaactcttcaacgtaagcactatatttatattatggtaataaatctatcctctccaatcataaatccttgatgttttgaattaggtctagtcaaactctaaaatttttaaccactaatgaattttacagtagtttaaaaacataaaaataacatgttagatttgtttattgaaaaatatttctattgggccatcttacaaacttattgcattaaacaaacctattttgataaaaaaaattgctacatccgtttcatattataattcgttttaactttttttttaaaagtcaagtttctttagctttgatcaatgttagatttaataaaattgatttggtggtgtatatatatatatatatatatatatatatatatatatatatatatatatatattctataaacctggtagaagttttaagaagaatggtttaaaaataaggaaaaatgacttataatatgaaatagagagggtactttaattatacaagtacctaaatcaccgaatgtcatataattttgtctcttttgaaatggagtaccagacaaaactagctcatgattttttttcggcgaaatctaatgcagtaacacccgagtttcttcatggcttttagcgctcctgctacacgactgaaacgatgaaaaacgaaaaatagagaagcggaactagaaaacaaaaggagaaaaagaaaaaatgaaaatcttatctcatctccctctcactcccagccctcacagatcctgaga

SEQ ID NO: 55738 - DNA, 1501 bp, Oryza sativa
tccaagacattcaggtacaaacagcatagtcattcgaatatctctcacatggtttcctctccttaatcattaatcaagataagccttataaaaagaaaagaagggtgtggggcagtaatttaaatccaaatgacagtttagggaaatatgttacctttattgtcaatgtaatgagcagatttttcctgttgcttccgatcctcgatgttctccaggtagttctcttcatcttcctccctgacatagtttgaagatgatttactaaaaaaaataaagcaactaaagttaacaaatatgatatacgagttaatcatatgagaaacctcacctgtaaggttctttcttctcttcttcaggtctccttttgcatttggcctttgtatcatccccaccaaagcttgatccatctttgtaaatgccagacataccatagtttgcatgcgtgtagctgatactcccttcgttcccatttactgctctagaccaacaagcatccatttccttacccctaaagcctctcttatctctcttatctatactatcattgagtttctcctctccatatctactgccaactctatctgtttctttgtaactgttcctagccgtatcatttttccgatttctccattcttcgtctttcttccttgtgctactattccatctatccatctccctaccttctccatgcccatgatgtgcactcgccttttgatcaaatctaccatcgccacttcgtctctcatgataagcaaggccatgcaaatcaactttcttttctaccaaactgccatgttttctctcgtccaggtgtttttcctcgctattacagatgtcagtgtgcctaccaatgtgacagccactctttttccttttcttatagcaccctctttcttcagtctcccacctcctgtttgaatacctatccggctcaccatgtctgtcatcaatcccatgttcataatcaagcctcacactgtttcttgagccatcagtttgaaagccagtttctctgctagcatgacaggatcgtaagcagtccttggaatgagcttcattatggtttcttgagccaggagatcttctagaatgatattccacaatggcttcatgagcagcatgatctgactttgctggataatcatgctcttgagatgggtttctagctagctgggaggtatgcaactcatttacatgtatattcaagtctgcatcggagttatcaccatgctcctgtattagaaatgaattaaaatgtaagtcaccatagaagagaaaattcaaaagcacgacgtgaccagtaaaaaaggaagcaagggagatctccctccttaacacaatgttcattgattatgatactacaaatttgttcgtaagcagttcaagctttatgtcaggaagcttggagcttctttcaggtaaacatttgctatcagcagcgcagtggagtctataataattcagacatgcctaaaattactttttttttttgcaaaccagt

SEQ ID NO: 55739 - DNA, 1501 bp, Oryza sativa
gggaaggggggagggggggagatggcaaggggggtcgctgccaccgctcgccgccgccgccgtggcccacgagaggggaaggagaggagggcaggggagccaccgccgctgccgacgcccgcgagagcggaggaaagggaggagtgaaggagataagggagagatagagtgtgggaggcgtgcgcagtggattccgagaagataagggtgagtgagaggtgagcggcaacggttttgtttttaaatttttggtatctggatacaccaatcgaaactaaagatttaaataatctttaatcccggttggtgttaccaaccgggactaaagtgaggatcttttgtcccggttggtgccaaccgggactaaaaatccttagccccttgacaggccgttgaaccggttggtatcatatagtccctttggagtttttttagtccggttaccataggaaccgagactaatttgatttttggccaacccagcaaatatggtttctccagcagtgaacggaactccaaatcggaaatatttgccgggagtgaattgtagtgcttccttcataaagaaaaccttaagcataagcatatttcatttttctgtttctatataaaatgagatggtcatttatgtggtttttgtgtattcgagacttagataagaaaatgtgtttaaaaaaatcatctttccatttcgtttaatagtgctattaaattattgatcgaaacttgtacagttatttattttattacttgttttttacatttatgtacaattttgttttcttcattactcccccgtctctaaatatttaacgccgttgacttttttaaacatgtttgaccgctcgtcttattaaaaaaatttataaaatatgtaaaactacatgtatatataaaaaaatatttaaccatgaatcaaatgataggaaaaaaataataattacttaaattttttaaataagacgaacaatcaaacatgtttaaaaaagttaactacttaggagacggagaaagtatatgcgagcgagatattttttttaatgaagaaatatgtaatttttagattgaggggaatatatacgtacatccacgcgttgccacgcgccccagcgccgtgccgtcgaggcatcgaaattcgaaccacgcaacacggcaagtcggcaaccgaaagtgtcaaactgtcatcaaccacatttacctccccggtcacgatgtatacagtatacgtataggtgctattcgacgctgtttgtttgaaattgaacgctagctagcgcttgcacgttcactgttgtgcacttgtgctcacctgtactccatactttttatataaaaaacaatttcttgtttgacattttttttagaaagttcatcgggggagattttctacctgaattttttttagattggaaaaaatacttgtgcgtcacaacgggtgaaaactattttaatcttattattgttatagttaaggtgaaatatattgtgataactcgtttgg

SEQ ID NO: 55740 - DNA, 1501 bp, Oryza sativa
ctgctgggctgctcggtttgggctagtcccgggtcgaacacctagatggcaatgaacagtgtgctttgaatttttgtgagtaataaagagggaatttagatagagagaaagaaaggggataaactgcaaatgcaacagccaagatttgatttgaattacgagattgcaactgtgagtgcaaaatgcgccgctagaaattgggttttgatattttatttttaatattgatttaaacactccaatgacaccactatcgaatttaataatgacttatttgcacgacaacttattttcatagttgggttttttgaatttcatttggattattgctattttggttttagtattacgatggaaacaaaattaactttccaaaatagatttaaatacttaaatttaacttgtattttgtatgttacaaattgataattagctttcctttaattgggttgctcttgctgtagatatggtccaatttactcccgtaaactattttattgaatcaatcatctaaactatttttcgactcattttaccccctagctaagttcactttactggttaattacattttccttatttgtttctctttatacaaattatattttaagcttaaaatttttaaagccatagatgacaccattattaaagttataaaatagttttaaaatttttcatgactatttacttgaaatttaaaacctctacgtttaaattagtcttagtagttacaacctatgtaaacaccgattaaaaagtttcaaaataaaatattgagagataagttataatgtatatatcaataccacctaatttccctaaatattgagagataagttataatttatatatcaatccaccaaaatttcattgcaaaatatgacctatacatagatcagagacgaaaaagacaaatattgttagggagtaaggtgaaccattttcaatattttggggtgtaaaatgagccaagaaattatttaggaggttaagtgttccagtgcaaaagttcgagggagtaaaattgactttttttttctcgatgtaatgagttaacattaatatatatatatatatatatatatatatatatatatatatatatatagtaaatttgtttggtgctccatggtgcccgggcatcattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtca

SEQ ID NO: 55741 - DNA, 1501 bp, Oryza sativa; identical to SEQ ID NO: 45720

SEQ ID NO: 55742 - DNA, 351 bp, Oryza sativa
tgctgtgcagtgaaaggccatgatggccagtacaactggggcctgtgtgtttgacgaactgggcctgaagccatctttacgggcttccggtgaaaaaacgcggcctatcacgaagcccaaagaaaacggtcaagagcggcccatttgaaagcccgaataaacgtcaactttggcccaattaaaccatcaactgaggccattctaaagcccaaagagaacgtcatgtcggcccaaagaaaccataaattgcggcccatttgaaagcccaaaggaaacttcaatgtcggcccaaagaaaccatcaatagcggcccaccaatttgccttgaataacagaaggcgtgcccaaaaa

SEQ ID NO: 55743 - DNA, 1501 bp, Oryza sativa
agttaatataaagagtatattaaatctctcatcgtttctcatgtagtgtgcaaagcaggaccagggaactaacttatgcggctactacgtatgcgagtatgcccactgcctatcaaaccaaatatgcacaacacgagagctcgatgtacgtatacataaaccattcaaaatttcattgcgtatcgatttgttaagttgtttattaatttcatatattcatacgtcattatttttcgaacgatagcgtattcacatgagggataatctcccacacaaggattttatcacggctgttcaagaacaactgatgggattcatcaacgaagaagtccttaatctcgacggtgaattctactacgacggatcgacaattcataacgtcggtccttcctcttctgacataacaccggcgtcaaagtcgtagctatagctaccgagcaaatgaattgtactatatatgcatgtatatatatatttatatatgtacacatttacttttgtgttaatatatattttggtaacatatatatatgcacataaaatgttaagtgctttaaattatacatatgtctgtgtaatatatgatttatacatacacacacacacacacacacacacacacacacatatatatatatatatatatatatatatatatatatatatatatatatatatatatatatatatatatatatatatatatatatatatatatatgcctatatattatgcatatatatgtattgtaacatatgtatatatatatatatgcctatatattatgcatatatatgtatatatatatataatcaaccatgcagcaaacagggccttgcaaataaaaaaaaatggtgcaccgatctttagtcctggttggtaacacaaaccgggactaaagatggtttggccggccacgtggctgatcaatctttagtcccggttggtaacacgaaccgggaataaatatcgatctttagtcccggttatttcacctgggactaaagatagttatctttagtcccggattcgtagtcccggttggacaaccgggactaaagggggttaccaaccgagactacaaacagtttctccaccagtgtagctgagacctgagaagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacaacagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttat

SEQ ID NO: 55744 - DNA, 1501 bp, Oryza sativa
aaaaccgccctatatatcaaatagctccgcaccatctcaactttccccacatcccaacttcacgactccttctcttctctcaagccgctcctccctcctcctctcaccatacatcttcacctgtggagcgacagcgatggcgacgagggcaatgggaggcagatctgatggtggtatgggaggaggctggtcgcggtggcgcaataaagagtgtggcggcggtgaccctcccactcccctctcccatatccagcctccaggtgcgtgctctcgacaatagcggctccctccagcctcaacatgctctcggcaacggcgtccgtggtggcgatgggggtcaaatctggtggcaggatgaccggagaccgttgacggtggaagtagtagaagtggcactgacggtgacttccccactcccctcccatcctatccctatcctagatctgaccatagggaggcggccgccggtggcggtagctcgtccacggcggcttcagcagcctccaaggtcatcgttgatgacaatgagtagtgttgatgtttgcatgtttaaaatgcagtgagaaatcaatgtagtgatcttggatgtcaatttgaatatggattggatttgaatctagctttctagacgtggatttaaaatttgaaaatgcaacaatgtctctagatgttgatttttttttcccaaaaggatatcgctggcggtcctcttaattagttgtgtctcctgcgaaaattgattttgcaggcgatcttcttaagtgtctgcaagcaaaattctattatcgcaagtggatttaaattttcatgggtgatcatattaagtggtcgtaagcaaaaatctattatcgcaaccatgaacaaaaatctattgccggctagtagtaccgccagcgaaaatcggtttaggccaccatgaagaacactcttttaagtagtgattaggagtttgtattaaggaagctcttcgagtcatgcatcgagagaattttagtcccgtgaaatttcctcctcactcgtatcgtaaaacttcctccctaatttcatggagtcatcaactgcgttaggggatcgagcagaatcaaaaactgatcgagatcgatattatcttcgtagaccaaatcacagtaccgcacgttacgacgtccagggaccgcgtcagttggcgacggcgacgtgacggagtcgactctatcgtcaccgaattgatcgatggtggccttccggaggatccggatctcctactccgacccggacgccaccgactccgactccgactcggactccgccgacgccggcgaccacgatatcagcagccgaagcagcaggaccaacgccgccgcacgccggaaggtgatcgtcatctcgctgtccaggaagaagggaagatcgttatcgcagtccggtcgtcattatcgtcgtcgtcgttccgaaattccggcggccgcggcgaaggcggtggaggcggaagattggccgtcgtcgagcgacgggatgcgtc

SEQ ID NO: 55745 - DNA, 471 bp, Oryza sativa
ttgtaaatggtgaagttcaattttgttgagctgttttcaccaactttagttattacaagggcatttttatttattttcaattaaggagcatcctgttctctgggagttgcaaaatagtagcttggaatgggcagtagattttaataggatctattttagccaaatgaagaaagaataacctgtcaggatggaaagagactgtaggaggcatgtgtattctgaatcatctatttagaacatccaagtctgagaatacagttgaggcctgacaaggatttaattgatagatatccatgcacacagcaaattatatggtttgtctaaatcataggtaactctgtttgatgctcaccgttgttgttttatctgccatggtaaaactaatcatgctttgttgtgccaccttctgacccactttactttctaaaaagtcctttcatgttcttcataccaatgggctgacaaagtata

SEQ ID NO: 55746 - DNA, 1501 bp, Oryza sativa
ggtaagggcttttacatgtttggaggtgtgctaggccggactgcctcgttctagagtggtggaaattgatgagttcacataactgaaaaggtaagttcctctaaaaaaagtaaaaaaatagactgaagagttggtcatgcattgtttgattaattaatattattttctctggttcttactctctctgctttatattagaagacgctttaaaaaaattttagtcaaacttttttttacgttctactaaatttatatttaaaacatagcaatattttcaatataaagcaagcgcactattaaaatatatttaatgttagatttaataaactaatttagaattttagatgttgctaaaattttctataaacttaaataaatttaaaggtttgacaatgagaaaaattaaagtgttttataagtgaaaaggagggagtacaacttagtggtgtaatatttttaatggcaaccatatttaacatcctcaaattttaaactaaaatttgactgcatcatgctggcttttgattaaatttgtttggtttaaaaatctatttgattcttaaattggttcaagtatttatttcttagagccctactaatttaccctaataattccctttattccaaaccctagtgaatttgagcaaattctctcaaatttcaaaccatagattattttcttagttcatcgaagatttgctatacttcaaaccctagtgaaactctttcaaattcatagattaaattcattctttttataggaaatattcaaaaattctgaaattcactgttcatcgcacacaaggtgctcgatgaaatgtctagcccaactagagcagcccaactcctacccaatcttgtgcaaagtctagatttggtcctaggggaccacaacccactcaaaaccgtggctttctttgcctcatcctccccttcacgcgcaccgcccgagcatccgacttagccacgcgccgtgtcgccgcgcgtcggcctcagggccgcttgcgcgtgcctgaccgccttggcgcaccgtcgcccgtccgacgccctcagcccaccgccgccgcaccaatcttgacgacgacaaagccgggacgacgaccgccgcaagaaatcgccgctcgacgccgtgcgcgcccgtccaaagctgccgccgagtacgatttcgcttctacccagggtgaatcgcgccaattcttgccgcacggttagattgaagatagacggtggtatctcctctcacaattcaaaccattcacccctgagccagccgttttcaccctcgccgccgccgcgcgtcgcgcccggattagcgccctcacgtcgccagctgattccaaccgcggtcaagtcaatacttcatcggtaagtattcgaacgtggcctcccgccactcaaatcgatctttcccgccctctctcagcctttgccacctttgcctcatccaaatcccaagctcatccatggcgatgacggtgtccgagctcatccgctcctccta

SEQ ID NO: 55747 - DNA, 1501 bp, Oryza sativa
caatctggttaaaataccctatacttagattgggacagtacgtaagatttggctgatttccgggtggctagtactgtctcaatcaatataagttttaccagatacttatgttgaacgaacgagtacgaccgcagtttctagaatagggacagacctagttattatgttaattagcaatatggcacctctgtatagtggttcttatttttaagtcctcgtgcaggaggcaactatagccgcgaagggaaactttaaccattaccatgtacaggtaaatggtttgtgatactcgagtataaactatatggtatatttctaaaccctgatcgagatgacgtggtgtcatacgatcagttccccttaaataccttgggaacgccagaactcctcttgctgctgttaacattacattcagagcatatgaggatatgagttcatggaacaggtgccacaattgttaatgacttaatactggaccatgactaaagccgatgattatcagcaagtcatggactgcgggtaaagcgtacatctgctacagtagaatatctttgaaactattcgaatagccgtactcatggagttgagtactgggactcatatggtaccctggttagaaatctaaagtttatatgttttataaattcttgctataacttttccagattgtctagtactgctttttgcaaagaaccctattatatgtcaatgcataacatattcccatgataacttgctgagtattgtaaatactcacccttgctcttataacccctttttcagatctgggtcaagaggaggacccttatgactattactacgaacatcccgataacttagagaatccctaaaggttatacctcactagtcagaatgtatagaaacttctgttgtgtattaattagttaggtgagtacctattattgtaaaacccttagtattgtaagactttttaacatatgcaatgaagaaccggttatattgtatgtatcaatatttactgatccagggattgattcattaatctcagtcggattcaagttattagttttgggctccgacaccatatgtgcctttttcctctataattattccatcgcaacacagggcttctcaggtctcagctacactggtggagaaactgtttgtagtctcggttggtaaccccctttagtcccggttgtccaaccgggactacgaatccgggactaaagataactatctttagtcccaggtgaaataaccgggactaaagatcgatatttattcccggttcgtgttaccaaccgggactaaagattgatcagccacgtggccggccaaaccatctttagtcccggtttgtgttaccaaccaggactaaagatcggtgcaccatttttttttatttgcaaggccctgtttgctgcatggttgattatatatatatatacatatatatgcataatatataggcatatatatatatatacatatgttacaatacatatatatgcataat

SEQ ID NO: 55748 - DNA, 1086 bp, Oryza sativa
cgtcacgcttcatcaggaaattgctaataaagcatgatactccacaggttctcgattctttttcttttttcagaactcgttaaaattggttgatttttttccctgaaacatcatcataagatccgcatgaacatttcaggcatcctctaaaacaaacatttcaggcaggcatgttgttacagttatacaagcaaagttttatgatactgagatgctcatgcgccgtgcttcgttaacatctttcactttgtaagtcggcacgccctctccaggcctccactaaagaaaaccaaatttcaatgagcggagaaatttataaattagcgagaaaaaagagaaaagaatgaaaaggattttaagaatgtgccacaaccatgggtcaatctgcttatgtcaacactggatcaaaaagaatgacaatacaatgggcaggcagggatcaatgcttcttcaagtatagcttagtatattcctcccaacctagttcctcaagcctttttgctttctccaacaccatatccctcagatcatgctggcattcagttgccctgaaagcaagtcgggtgctaacatctactttttatgaggcaacttaattagcctacatcagacaggtgtagtgtaacaactgaaaataggtccctaactgaaaacatgctagccaaataatcacttgtgctcccagacaatgtaactaggttttcagcaggtcaaggcaaaatgagaaagttgtactgatgactaatgacctactgcaaatttcgagcaactgtaacgtaacattgatcattcttttcgaacagattgatcaattgagaacttttttcatgattctacatttctactgactagctttgttggcaatttggtacattaccaaaggtctcatcagtctactcagttactcactggcttgctgcagcctggcagatatcagctcaaaccactgcttatgtataactccaggaattaaggaattaacatatgtgagccaggtcgaacatatgcaacttactgctatgaggtatctattatcaattgcatacatacatacagttaccctaagcaaacttcgaaatttgcagg

SEQ ID NO: 55749 - DNA, 1501 bp, Oryza sativa
attgtgatggttggaatggtcggaaataccctccaaccatcattgggagctaatccacatcgtccagaagaaaccctgcatccagcggcgatgagggaggttcggtcgaaccccctggttgggccgaacctggggccggcccaaccagcccatggtttggctggcggcctcctctgttattcttctccagacttttgaattttggcctagtttgtcgtgtcaattctgagttcttggcccattcatacataagtctggttctcgacatcgtccgattgatttatcgtttgtattgatgtcgattctcctccactttattgtcgttctctacaaaagattagtatacctactactagtggaatattattattctaacatatttatgcattgcaagtatcactagttctcctctattttggtaatattgacggtcgaaactgatcgataacaaccatcaacagaggccatcttgatcaagggatttaatgcatgtgcgtggcctcgaagggaggccttggactcggcctcggcctcggtctccctgcaccccgtctcgacctcgctggctgtagcatcctcaacctctgcttcccttctcctcgcgactgaagctcaggatggagaggaaggtgcccgtcacggccgtgtgcttgggggagaggtgggggagaagtttttattttatatttttcatgtgaattacatgtggaccccacatattttttttattccctccttgctgactaggatgcatcgtttgcatgattttgaacacttgacgtgtagacggcaactagacttattcccaattttattagcctactcgttcactatgggaagttggcagatccgacacatagtgatgtggaaagagtccacactgactcccttacctagtggtcggatctgactcgtatctctaaactgcaaaactagatatgatgactcccccaactattaaaactgtctaaaatgtctctctcgattgtttttaagagcggttttcactgacatggcaacaatgtggtagcccagtcatcaaataaattaaaaataataagtggagcccacatgttatcacatctctctccccttttcttcttctcggcctgatagcagcagatcactaggacgacaacggggagcgacggcggtggtggcgggacgatggacacacaatgaccagcaaaaccctctttaaatcatgccccttgacctcacccttgaaagggaacccatccaccgcttgacccaatcccttgtgccgctcctttcctcactcactaatggccgtatcgcatcaacatcacgcctcctccaccaccaccacgccaccaccgccaaatcgaacgcgagcaccaccaaaagcaacaacagcttaggtattcctccaagccatcttctctccctctattgctgctgcatcacggtagcggctctagtggttctcgccttttgttgttggtcgggccactgttgcccaaccgggtcactccattct

SEQ ID NO: 55750 - DNA, 1501 bp, Oryza sativa
gagtcagcatgcggatcccacgtgtcagtgtcatgtcctctttattctctcctttttctcctttccccacacgacgcccctggggcagcagcaccatcgacaccctctactgtttgctcgcctccacaagttctccatcgactccatggacacgctccggtgccggaccgctagcaaacacgcgacacaacagccagtcaggcagcgagcggcgatggccgatgggcggactgagggaatcgaggcgatatggaggcggagtggattgcggcaatgactagcgatgggcggacttaggggattgtagcgacgaacggagatggtcgagggagagaagggggtcggtggtggtgtgctttgcagcggcatcggtggcgctggacttcgtggaggggaatgctatgatccagtgggtgatggggtccttcttcatcttctccagctacttcattgcgctgtcagtgatgccggcacgccatctcctcaacctctcaccaccctgcaggtcatgccattgacgagctcccttccctcgaggtcgtgccgccaccgctccatctcaagtcgtgctgccattgcgcctcaagggcaatgagctgtagatcagtgtaagccgccgctccgtcttgagggcgcaccatcgttgtgcctcgaggccgtcgctctgtcttgggtgaagccccgtcgcggatccctctcatcagccatcacagctgctcggactccgcctcgggccacgctggcacctagctctgtgctcgtcgaaactgccgaccgtccttgcccactctagcttgttggcatcgtcgtcgtcccgaccatagagaaagaggagaaacaaggagtatatagagaggaaacagtcctgacccatgggtccacatgctatttttattatttttgttattgtaatgacaagtcagactcagagactaagtcaattcgacacgtcaatgaaaaccgcctttaaaaccaccaaaggagttatgttgcactggttttaatagatgatgggtcaaaatatctggtttaatagttgatgggtcaaaatatttggtaatttggttagggggtatgaatcagattgcacctgaaactgaagaagtcaaagtggacttactttccaaaggagtcaaacatggggtatgaatcagctttggtgcaggaaatatggcccatctgagcccatagggagttcacattttcttacataattaactgggtttggcccaagtagttatattgatggctggctttgtattccagcagtagtgggcttctttaatggcccaaactgtgatattctcgttcggccaagggcttctactagtttacggaataagtccacttgctgtccctcaattttacgtcgaatctgtatgacatccctaatccccgatatcagaaatttctaccctttatgtgttcaaaaccgtgcaaagaaggtcccatggcagtatgcatgagtggtttcactgacgtgtcatcctagtcagtaacg

SEQ ID NO: 55751 - DNA, 1501 bp, Oryza sativa
agaccttccatatatttatatatatggtacgtagagagaagtaagtgaagtatgtataaataaatgaacgaaagctgcatgaaaattgcaaaagcaggtgtatccgtgtagtacactactccattcatttcatattataaatcattttaacttttttctttaaccaaatttatagaaaaacatagtagtatttttaacacaaaataagtaaactattaaaatatatttaatgtgagatttaatgaaacaaatttagttttttagatgctgctaaagttttctataaacctagtcaaacatttaaaaaaattaaccagaaaaaggttaaaattaatgatttataatataaaacggtgtaagggttatctatatggattagtataattattactcctattcaacgatgagttagtgtatgcgtactgcctgtgcaatgccaaactactgccactattttggtactatatgctgggtccgcatcatggatcgagccgtacacaatccaagtatctacgtacgtgcatcatgcatggctgtgtatgtgactagacccagtgtcagtggcagagttagaaattatcttaagtatatgacttgacagtagtaatatactacctccatcccaaaatatgtagctgtggatatccatacccaacgtttgaccgtccgtcctatttaaaaaaattgtgaaaaaattaaaaatatttagtcacacataaagtactattcatgttttatcatctaatagcaataaaaatactaatcataaaatttttttcaaataagacgaacgatcaaacgttgaacgtaaatagtgtaaaactacacttattttaggacgaagggagtatttcaacacagatatcagatatgaggagtgtcactctctcgtacgtgtacttgcaggttgattgtcacctttcacactttaaccgaatcatcacaaaaaggaagatgatcgaattggtcgagcacaaaatttatttcgaagtgaattgtactttggatcagtttttattacttaaatcgcatattgggctaggcattcacaattcttttcgttttattgtatcttgtccttggcctcgaacaagatgcattttgtcgcttaccatcgttgttttcctcctcctcactggtggtgatattctaaggcggtcgcggtgagtccatgcatcatgacgggagagttggagtggaggtgaggaggcgtagtgagtgagagccagagcggtaacgaggaactccaattgccccctttttattagaagaaaggtggcgtgggaggtgagccacagtaatagaggacgtcactggtgtctggtgtcgacggttggtcttatgataggaggtttgtctccaagggaaaactcatgtagtggatgtagctagccacttgaaatagtggcgtgaattgaagaaacctaacgggcatctcacacagacacatatttaggacccatttaaatcgtaggactgataagaatacaagtgtaaaata

SEQ ID NO: 55752 - DNA, 1501 bp, Oryza sativa
agagaacatgagagtggaggattttaaaaagtaataatataatgaagaaggggtcatagttaattgcctacatgcgcatgtcttatattatgaaacatctagaaaagtggttgtgccttatattatggaatagagggagtatttattttattcttttttcctattctattaatacgataaaatataaattaattattatttttaaatattatccttgaaatatatatcgttttaattaaaaatcatgctcggtagtcgagctcgagcttttgatcgagctcgagccgagcctgctagacagctcgaacattttataggcttggcttgagcttatatcgagctcgctcaagcttgacttgttgacagccctagtcttgaggctaattttcaacaccattctcaccctagtcttcgtccttggtgtcactatcgtttctcatgttatcaccaaccttcctatttcaaatgacaaagggaatgatgactattaattagaggggcattgtttttttcttgtgcttatgccaactaacttttatagattctttttctgtctctaccattgccatgatgatatggcaatttgcctcaacagatcaaaactcctcttaatgtattcttttaggaagggcaacacaacaatattgtaatggacaacatatcgacccaccacaccttttcgataccaccataatacttggtcctttccattaacaaaatatactccctccatccacaacaattaggcatatttcatagtttaattttttaaaataagttgtttctatttgtaatctttatatattctaaacttgaatgtagagctaaattaaatatttgatcagaactcgaggaatcatcttaatactcattagttacatgtgtacatacactacttatctttgttacatataatataagttaattttttattagttttggtgataaaaataatatgtgtaacttttatgaaaggaggaagtaaattacaagactattaatagcaaagacatctccctttatttgtagcactttaatgaaagcatcatgtatcatgaatatattggttggttgaaaggagcttttcaccttaccctttccctaactcaagtttcatgctgatatggacatgcgaaaaaaagtaaattacatctgtggtacacacaactcgagattgcaaaaaaaaaaaactagaaatttaaggtagtgcatgcttgtgaggtagttgcacgattaaagccctgccttttgttttagaaaaatatatggcacaaataatggttatagcttataaatttataattcagaagagatctgaatcgtcggataatggacgcaaacaatatttattgtttccaagtttgttagtagtaaactacagttggcacgtaggagtagcaggtacgagccaactatgaagtagttgtttccaagttggcaggtatgagagccttgcttcgttgcatttcaaagcaatcctatttgtagtctagtcatcact

SEQ ID NO: 55753 - DNA, 1501 bp, Oryza sativa
aggttgttggattgaaatatgcgtatcaaaaataaaattttcagatttagaaatatgactatcaaaagtagatggagagagtagtatttagaatttattggtttgtattctctccgttgacgttaaaattatttggcacagccaacgaggtccacgacatggtggcagccagccagttggagtagtatgcgattaatcaataaggttagtctgctctcatatgttttaaagaaacattattatctgtgcaatgaaattattcaagtcactgttgatagttctggaattatatatattggtgaaagagaatattagaatggcataaagagctaacccatttcatccttgatgtcccatcgatcaacaaattaaagcaaataaatttcaggccctgtttattcatatatatttttgttttatgtattgatttataccacgtttaatgcactacatatatgcatttttaatcgcagctcggatttgttatggtaatatatatttcttcgaggattaggaagacactattaatttataatgatgtatgtttccactattttccttcttcgaattgctttggtgaataggcatataaaacatctcacacatttataaatataagtttggtatacatgtcttgatatcttagcgcagatcaaaattagcgtacacacaccctctacaaatttatatcttagcgcagatcaaaattagcgtacacacaccctctacaaatttattctaacatgttaatttcaaagaagaagaacctgaccaaccacatcagtttatcaacatttcctttttaatttatggttatgtgcattcctagtaggtgcagagtttagatgtatttattaattattatactcctttatgatctttaaaaaataagtttgtcaataagaagcaaatgcgctctaaggaattcatgctccagacatgctagaaaggcatttgatattttttttagcgttgttttggtacttgctatttcttggatttgtagtttctcttaaaagaaaccttcacttggtaccatttctttcatattaattgactttgacgtctaaaaaatcttacgctttttgaaatacaagtttgagaaaattcaataatagaaaaaaataagatttaaatatgaataaaacccaaaaaatatattttaatagaccgtggaaaaaaattaaaaggagagataaaaactcaaatgaagttttatgaggttaaacctcatgctaaaattcctttaaaatcttcttgtcttaagccattcaataggaataatataagattgttatattagggtgctaatcctatgtttcaaaggatcaaagaggatatttttctacatgatttaaatcatataaatctcctatgtttttccaataaataaatgtgttttgtttgttcctttttttcggtgtgcacaacaccgcacaaggtatataatcttgttaaaaaaaacacctacatgcaaatataaattaaccaaacaacattt

SEQ ID NO: 55754 - DNA, 812 bp, Oryza sativa
cggcgcgatagagtgcacggggaagggaggcgaaaaggggaaatgtgagaggaggacgcgaggttgctttttgaaagcatggggagggtggacaagaccgggaggcggccggatttctcgccgacgtggaggatggagagagagagtggggggattcgaattgaatcccgctcttgcgggcgcgcgcgcgtgagcggggaaaggcggggcgtgggggtggcgacgtgggggcgtggagcgcggagtgggcgcgagagaagcgggggaagcggcggcgatgggtggcggtttcggcggcggcggttgagggaggccgcctctccggctggaggttaggggcgaacccgacaggtgggccccacctgtcggcgcccgggtggagagggggaggccggatggacttcggcgggtgggggagggaagaaatgggcccgcggcgcaaagggagaaaaaaaggaggaaaaagaaaaagaaaaaggatttttcctgggatttaaaattgcacatgctcatttttaaatgggttaaaattatttccaaggttctgaaaattccactaaaaatcctgttaatatattggagcatggggaactcaagaaaaattctacaagctatttccgattattaattgcatttattaattatggaattagctctaggttaatgaaacaatttcttcgcgcaatttatttaaccatttttttaaagcaaggaaaaaagggggaaacttcagggcgtgacatataggtgcacacctttttttctgtcttggtgattaagtcggcgaccacgtgcactttctcatcggcagc

SEQ ID NO: 55755 - DNA, 396 bp, Oryza sativa
ttttagtcccggttaaaaactttttgatctgtagtcccggttggtaacaccaaccaggactaaagatcatttttagtcccggttcaaaaaattgtccggacgagtcagggccccaattatctttagtcccggttggtataaacaaccgggactaaaaatagatttttagtcccggttgtttataccaaccgggactaaactttaccccaagccgcgcgcctgtcagtccacagtcgtcgtcatcaatcttatccccctgccccttcctctccccctctttgcattaaattaacagccagcctagatatctccatcgtctcagaagtctcccctctcctatccccttcttcctcccccttcacctctcctccccctccccgcctcatcctctctagg

SEQ ID NO: 55756 - DNA, 1501 bp, Oryza sativa
accggatgtggcagtagttctgcccattcgatttagagaggaaattaaagacgaaccacatgcagctacacacataataacacctatattgatcaaagcaaaatggccgtgtgctctatcagtattaaatcaaggtgattaatttaacgttgacattgttcttgatggccctgcagcgaaactgcggctaattacaccacatgtccggcatccagggcgccaactaattatcatttgacgaggtcacgcatcaattcatcatgaacaatgatgcatgaattatcctacaactgggggcaaattaagggaaaataataattaagtttcaacgagtttaagaacatcaacagcttattaattagcttaattaatctatgtaagattgtaaataatactctctctgtttcacaatgtaagtcattctaacatttctcatattaatattgatgttaattaatctagacatatatatctatttagatttattaatatcaatattaatgtgggaaatactagaatgatttacattgtgaaacggaggaagtattatgtgtagtagtataagtatatatatttgggttgagtgtgacaattaatggctgtaagctaagagatcttttgtctcgtatcttgaagacaagctacgtgcttaaaggactaattaatatactgatgaacactaatattaattggtagtacgtagctagctctgtatacatacttgcacgagggtggacatactgtagcattgtaccaacattatttaacttatcttaattaactactccattcgtattttaatgtataacaccgttgacattttgaccatttgttttattcaaaatttttgtgtaaatataaaaatatttatgtgatgcttaaagaacatttgatgataaatcaagtcacaataaaataaataataattacataaattttttgaataagataaatggtcaaacatatctcaaaatatcaacagcgttatatattaaaatacgaatggagtagttaattagctacatataatattatcatgtggttagcgtttaaaagttattgtgtactatttttttaatagaagtacatcagcatgtacatgttgattagagtagggccatttatttaagaaaacagtgcatttcaataatcaacattattatagcgttttaattagttttattttggtcagcttgttttaaaacgcacataacgttgaactagaaattcattatttatgttaattaagtaaaataggtcaaattgattattgtttctaaacaagcacaatccctacaatattacaagttaactagcagcattttgtgaaaaatttgcacatatcagtgataattttgaacaaatatatcgttaccacaagtatgtgctaaattataactttgaactaattcttaattatcctacccaaaatagtaaaatgcacacatatattccaaacacttgtggagaaggagtttttactcccggttcgtaacccccc

SEQ ID NO: 55757 - DNA, 1501 bp, Oryza sativa
cttacaaacttgttaatctggttagatttgatagacttgctggaattggaccttgaaaagaatttccttggaaccttctacaggttaatgttttgattagatcataaatatatgatgtcaaaaggtaaaattatacaaatttatcactcaggcaatgtgttgcactcctgttaggactagggctgagaatatgatatgttcttgtcctaatgtaagggcaagaaatgaaggagaagcattttgtgctacagttccattgattttctgttataataaatcaggataaatatttaaatggagcaagaggttgataattaatcttacaaatcttgtaaatttggaaagctcccaaaataatcaggtatttttcctgttaaatcattatctgatgcccacctgcaggcaaaatagaatctgttacttcgagcatatggaaccaaaatgaaaataacatttgtgacactccaatagcttacagaatcttcaaattcttaagctttgagaatgttgaagggaagggaccactgaagccagaactaataatatacctataaaaggaagactgcagtaattaaaaacaactttagatgggcctcatcaaaattttagttaacaggagtctaaatttggaagctcaaaatggacaatgggattacatttgctcgagtttttccaaattgcccagttctgcagggagttcaccagtaaaattgtttgaactaatgcccctgaaatcccaaagaaacatgttgactacgattttgtttatgtacagacagaaaatagcataaattcgcctctgtaagaattaagcatgttacaaaacactgcttaagaatctacaattttgttattttggatagcagataagaactatttattactgtttggatctgatgcaagcataagaaactcatgtagaaatgataaatttttataaaattcttaataagttacagttacacatttgtgtctcctgtgtaactaatttacttcagatagtccgtagtataaacttcaactccgagtagaaaaaatagtctgtaatgtaaacttcaactctgaagaaatttaactaagatatctcttacaatgatagaagatttctaagattcccgatctccttcggaagaggtccagataacggattgagggacaccgccctagtaatttttttttcaacattatgcgattactgattagagaaacagaaagtaacaactgatgaatgctaagagaaaataaaactaaagcagtgatcgaaatcagattcttacaagtactgcatggcagaaaagtttccaataaaggatggcaggggacccgtcaagtaatttcgccgaagatcccttcagtaatatcaaaaccatcaagctaaacataaacacttcataatcaggctcctgtaccctgattattcttgctagtttttctagatgaggaagatgatagttcttcgctagttattaggatttttttactgaacgcttgagtaacacaa

SEQ ID NO: 55758 - DNA, 178 bp, Oryza sativa
tagtgtctaaacatccgatgtgatagggacttaaaagttttagtcacatctaaacagggtataagactcacgaaaataatcgtgtaacaccttgacaattgtacaaattctataaaaattacacatatatagagagtttagaaaatattgagtaaaaacacaaataataccagggaga

SEQ ID NO: 55759 - DNA, 1501 bp, Oryza sativa
tgtccgacatgtgctaaaaagtcaacggtgtcaaacattttaaaacggagtgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccaagtgcttcaagcttttcatgccaaggcctgccgagtggactgtaaagggcgaaaagataaaaaacatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacacttgacaggcatccgaatataaaaactctaaagattacccatcaagcattataaagattatggtaataaataagtcgaatagcctaggcaatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgccagcgaactagggttcacaactccggccaaatccacctccgaaaagtgcatcaaaatccttcccgtgatccaccacctcaattcctcacctctctcaagccatccctcgaatcaaatcagcacatttgagaaaaatcga

SEQ ID NO: 55760 - DNA, 461 bp, Oryza sativa
gccaggttcagttttgaaaatattttttggaaaggtctattttcgaatgtcaccggttggtgtgaaactatacctttgttatggccactttgtattgattactctgtcctttgataccttgggttacaatttgactagttgagctttatatattggttcagctagatatattagatataattgcttagccatgcttagaaacattagcacactattgggataactaatgtttcactactacttaatgatggacatgataatggtagctcacgatggctaatcatgattggttaattaattaatttgccaactaaaacttgataaatgtgggttgtgagcacatggttttgctggtcgtgctcatgacaattaaggactggttcacgagtttcggttgtgaaacattaaccgtgcaaaccacaagccagtatgggcaacaactttatcttttgtatagcatg

SEQ ID NO: 55761 - DNA, 160 bp, Oryza sativa
ttcttttataagaaggcctgaacctgtataaatcctttgtctccaaacccatacacttttctagcttgatagccacccccttttattattgccgaaatctagtttcgacagttggcgcgccaggtaggggttgcgtcaagcttttcgccgatcagtgcaa

SEQ ID NO: 55762 - DNA, 1501 bp, Oryza sativa
ttgggcaagaaaaccccggcagctaagccagcctaagtttacgtacgtggaacagtatccatgcatcgtgtttgatgattgattcttttaattatcattgcggatttggctcactccgaacgaaatccatccaaattataaactcgtggagaggtagacatgcaggcctgcagttgcaggacacatcgatcgatcggcctgattaaaatccgagacaatgtcaagcgattagtactactccatgtcccatcaattttgatcctgacgaactaatcaacttctcttattacggttaacaaaatcatcaacttatacctttgtccttttcactgtgcgttatttgcaaaacaaatccgagacaagctcaagcaatcgatccatgtaggagtttctggcgccaattaagagaaaaatactgaagtagccgacttgagatagcggaaaaattcaaagattatggataatccgatttctttttctaatagctatttgaggctatggacgactgaattaactactgcaaaggtaattaaaattgttgctttagaaagaaacttgctgggtggcccgcgcaattgcgcggctagcacccatataaaattatatattttttaatatgattttacttaaaaattattaaatagttatctcgttgtcttaagattttgaaagaccaaaccttatcatcctcgtcttatcattctcgtgtttctaattttatagtttttaaaagtcacaccagtggctaccccttacttctgtcatattattctttgttagcttgctcgatctatcaccgtttctattcattcttagaaacctttaaaaattggaagtctttttaaaaattggatgttaagacttatagtttttagagtttattgtcctgttgggcttcttttgtataatttccagaaagcctgtcaaacgttgtcattatactcctctacgaccgtccactgcatcttctctttattgtcattgctattttaaaaatcgaacataattatcgtttaggttcatttttctaccttatagaagtttcgccaaaacgttagcgactttgtcactgtactcctctatgactccctgttgccgctcttctttattgtcattgagattttaaaatcaaatatgattatcattagggtttatttttttactttttagaagcccgaaccattaaaaatttgaccttatagtttttagagtttattgtcgcattgggttcatgttttttataatttttagaaatcccgtcaaacgctgccgtcctttacgacccgtccgccgcgtactctttagtgtcattgggattgtaaaaatcgaacataacttttattgaaatttatttttcaatttctagaagacccaccaacaattggcggctctgttattgtactcctatacgacccgcttgctgcctctcatttttattgtaattgagatttcaaaaatcaaatatgattatcattagggtttattttttttactttctaga

SEQ ID NO: 55763 - DNA, 1501 bp, Oryza sativa
tctcaggaaaaatggtgtggttaggatgcaggtggcagttgatgagttagcagatttaccacctagtgtttacgttgttgtccgaaaccatggctatgaaatcttctttgaaccggaattgcctgaggtggatgggaaaggaaagaagaagattgatgatattgaccaggacggagaaagaaaaaatggtggtgatcatgatgttcacatggaagatagggacccaaaacgccaaaagaatggttctgatgggtcgctaaggatggaaataggaggcttagcgccagctaagctgccctcaacgcgcaccaataatatggttctagataatgaagcattttcaccgtctcctagctcagatacgcctgctacaacaacggagttggaagcgtttgcctcatactcctccgtggtgttggaaacgcccatgagtcaattgggagcccaagggacaggaaactccgagtcaaccaaggaggctgtcggtgaggtggtgtactccgacgaggtttcgacacagctagcgaagttggcaacgactaaggtactttctactgaggttgctgtgcagctagcaggaacagatgaggtggttacgaatggcaaagagcaacaacaagaacctgtcagcatggcacaagaattacagcatgtttcagctagcttcttgtctcccgtggagcatgtattggactgcaacgtgcagtctgaattgctccccaagaatagccagcttgcaggcgatggaagagtaacatcgactaagaacttgatggcagtactagcaaccaatgaagaccaacttagtgcctccagtgctgccacatctaaagcccaggatgcagcacaggcagttggagctcgatccccgacaagaaggcgacctcgtcgcccagtggaccctattccaactaggcaaagtgaaagacagaaggcgatggcaaatgcagatgcgccggtggcaaaccgggcagagctgcttaaaaaggttcataacctcgagacgctaacaggtaacaagtttaataccacaaattctgttgcttcaattccagataagactcttgctgcaaatttttctaaattaggggtttctctaggaaagaatgatttagaaataaaggagtccattaaccagattaaaatttcagaagtggatagatttgctactctttatagtagtgctgtagcgtctactagtaatgtagataaaagcaatgatgaattgttaaaattgtcttctctccagcacttatgtagtgactggctagaagaggctgagagtaatgacgatgagtctatggattctcaggccatacctcaaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatatgttaaggagcaaaatttggatt

SEQ ID NO: 55764 - DNA, 1501 bp, Oryza sativa; identical to SEQ ID NO: 55632

SEQ ID NO: 55765 - DNA, 1501 bp, Oryza sativa
tataaaatcaaaataaggggaatatttcctatagaaaaggaatgagtaacacatttcatgaaaaatttattttagaaaatattgtaatgtattttcttttatccgtagcaaaacatatatattcaattagtagataaaaacaaattggcagtactgaaatttgcatgtgttgacattgctaatattttgtcatggtagcaaactaaataagcccaccatcttgccaaaattttgtttaaagagtggccacgtcttaggcaagatagtaaatattaaaccatggcatgattgaatagctgcttttaaaaagttaggaaagtatagtagaaattaagcaaacaccctatgcttctgttgtgtcaatgatttcttaagacagatttttgatggtacaccaaagcttcagtgtagaggattaggattagtgactttaattagacatgttgttttgcgtcgtgacggaggttcaaacgtcccaacgtcaagaaaactaacttcccaactttagcaattgattgcatgctgctctctttgaagtttggaccatacatacatacatacatacatacatacatacatacatatatatatatatatatatatatatatatatatatatatatatataataagctaaaattggaacgatgtgatgaaaaagttgaaagtttatgtgtagaaagttttgatgtgatgtaaaagttggaagtttgaagaaaaaagttgggaactaaactaggccttaggtttaaaaaaattgcaagtcaagatttaaaacttttaacttagttttaaaaactttcaagtgaagattttaaaccttaactcaaatttaaaaacttttaactaaaattttgaaagctttttggatttgaaacaaaatcagatcaatatttgaaaaatatcaactcaggtatgaaaacttttaaatcaaaattaaaaactttcatcttaaaattcagaacgttcaaataaaatttgaaaactttcataccaaaattcaaaatattcaactcaaatttaaaaaaactatcaactgaaattggagatgagaatatttaatttctaaactaaaaaaatagtgaaaaaagtcaaaaaccgcgtctggtcaattagctttggaaagagtacgaattaccccctcacccaccccgtactatcgtggttgaccgaattaccccctaaactcaaaaaccagatatctctcaccatgaacttttaataccggataagttacccccctcgatccaatccattgtaagcaaagaagtcatctaaactcgaatattggatttcaaatcccgtctggttttcgcgcctcgatcaatgaaatctcactctaatactgaaactttcaggctctcgaaacactcacttcatagcacataatatgctatggtccttcaacccttcacaaccaagactatcgacgactcaacaagaaaagaaattgacaacattaaatattttttacataataacaaattttattgaagttaat

SEQ ID NO: 55766 - DNA, 1501 bp, Oryza sativa
tctacaactataatttcttaaaatctaaataagaacctaaattgtttaagagagcctctagcagctgaggattttagaagaaactgcagctacgaaaacttctgcaaacataccctctcagtccggtcttagtctccggtcttactccggtctgatcgggctggttcggccggctcggttcagtgagctggtgattagtatactagtaggattaatatatacagtgataagcattgtttgagtggtaaagtggtttggctaattggctcgtatggtcgcatctggtttgtggtttgtgaaagtgtcaactgggcaaaggatagtctcatcagatgctggcgagtttggcggtcgttttcacgtgacttgtgacggtggtggtgttgcgtggtagcaacagctggttgatcctttttttgttactagtttggctaatagtggattttatttaatctctggtttctttattaaaaaaacttttaagctctgaaggggtcaatatcgtttgagtgcctatttactttgatcagcggaggctcataatttgcggtaactggtgctctctttgtacagctttaaattcaaaaaaattttgagttagattttcctaagagcaagtactagaagcctctaaacacaagcccaatatatcatgtaaacttagataataacgtggaggagagaaaaagaatagagagatgactagagtatccacttcttatgcaaggaacaacctccatagaaactctaaaaataatagagaaagagataaattgattggtgaaaaatatattgggactagtgtcctacaggcaatatactgtatatgttagtttttaaatttaagagtatataatatcgataaataagagctgatcactgcctctactataaaacttgatctaacttaataaatccatagatctagaactatgattacgttgataacatttgaataaaacattctgctttcatttcaaatgaaatttaaaattttaaatatctataacatgcaaacttatttttttctgtggatctgagatatgaatctataccaaacatgatataggtagccgaatgtccatgatatttactataactaaaaccttgaatgttcatgccaagtgtaagaacatctttagaccttttcaactctgttcataccgttttatatatagatactcgcacacaatttgcgtttttaatagtattttactcacattagggattagggatttatggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatg

SEQ ID NO: 55767 - DNA, 1501 bp, Oryza sativa
gcgcgcccatggccctctcctgcgccgccgagtgcgcgctctccctcgcctgcgcgcgctgggcgctccgccgcctctccctgtccggcgccgacgacagcgcgtcctggcccgcggcctcgccctcctccttcgcgcccgtcccgcgcgcgtgccgctccgcgctcgcggcctggcagcaggggcacgacgaggcggagcaggcgccgacgccggcgccgtcgcggctgtgcccgccgtaccgtctctcccacgaccgcgcgcgcggggaggtcgtgctcgccgtgcgcgggctgggactcgcgcggctcgaggactaccgcgtgctcctcgacgccggcgggcccgagccgttcgcgggcgggcacgcgcaccgcgggctcctccgcgccgccgtgtggctgctcgaccgggagggccccgcgatccggcggatggtggcgaaggccgggccggcggggtgcaggctcgtgttcgtcggccactcgctcggcgccggggtcgccgcgctcgcggccgtcgtggcggtgaggtgctggctggagcggctcggcctccgccgcggcgacgtgaggtgctacgcgatggcgccgccgcggtgcatgtcgctcggtctcgccgtcgagtacgccgacgtcgtccactccgtcgtgctacaggcaagcctagcctcccaacaacattgttgcctctttccccttagctgatatcgcgtccatttctagcattgtttatcgaacattctgcaataagaacggaatccgacctcgattcatttcgttgcaatgattttggaattcgaatcgcacactcaattcttgaatttggatgcaggacgatttcttgccaagaactccagcgcctctgcaacacatcttcggatcaattttctggtaattaaaacagctaaaaatactcttgttatccatgtgttccaacggcgttgattactggttgttccagctgttgattcaccaatttttttagaacaagtgattcaccattttttctgtttcttgcattgcagtttgccgtgcctgctgtgtttcatttgcatgagagacacgtttgtgtcagaagagaagcttaaggatgcatctaaactctacgctccaggaagagtctttcatatcgtggagagggagaactgcaggttaagggccaaaattccaaaaattaaaacttttttaaaattaaaaaaacaaaatccttgtgtgctagtatggcattagacattagttagaagcttccgaagattagctgttatatttacacttgattttaattggcattgtatccacattggctgctatgcagatgtgggagacttccgccgcaggtcagaacggcagtgccagcagagggcagatttgagcatgtggtgttgtcatgcaacgccacttctgaccacgggattatttggatcgaaaaggaggctcaaaaggctttggatgtgagtaatttcgtctttgcacatgcctgcctgtcaatagtaaaaaaa

SEQ ID NO: 55768 - DNA, 1501 bp, Oryza sativa
tttctccacttggaacttccaaataaacctgtattatagcttaaaaggtaatatgagtagctacaaggaagaagactaaggaaaaattggaaaaaaaaaactttcactaaactaaacaggaaaataggcagagaggaaggttaaaaagaaatttaattgttagtagctacaagtcagacaaatatatctggaatatataaacaaggttacaagagttaaaaaaaacaaaaaccaaaatatgtaattttaaagggccaattagttaatctctaaattggcccttaaaacacaatcaacctcaataacaaagggagcctggatgcatgcatttatgaactattccctctgcataactatatcggccgtgtatttttctcgcattaaaccaagaaacccaatgagatagcctaaatgcccatatttatggctccataagagtattgatgcaattgttgcctggctctaatcccagctgcatgcatgcatgaattaatcgtattatcgatcactcaattaaaagatcaataccgtatgctaagagcagtgataactacattagcaagcactctagcacccaaattatacaaattggcaaacttcatcagcaaacactaataactaaaatggatcagtaaaccaaacatgtaaagaagcatattggctatatagactgcagcgctaaaagaagcatagtccaggtgctattgggagctgaagcaccaagcagccaaacatcagtgctctaaaaatcggtgctaggcgcctattagccgcctgggattaggcattacattgtgtactagacggctagccatccttaggtgctcttgtgcgatctaatttagtgttgtactgtctaatttttatgtaatatgcttgctaatttcctaggcgccagccctgcagacactctagggctattgtattgtctaacatttgctagtttaagttagacatgataaaatgtatagtacatagaaaatcagcagagtttagtgcatacaatggtaggaaaaggcggacgaatgagtgaactaagtatctgtggatcagatacatcagcatcgcgccagacaagtgtaccaatttcttcttcgttgtcaagctgctgaccccggaggtacatgaagcggggttgcaaagcacgttgtgcctccagaaattcatcaactgtagggttaatcagcgtgtgcacctgcatgcccagctttccaagttcagaactgacaaacaaaatatatgtacttaagagcaagtttaatagtagatctaactactagatataagctaatcaaaaagtagcattagggctcacatgtgtaacagattagttataaggttgtctctaattttcttctctctctttttctcatttatataattaatgcatttatcgtagacaggggtggagctatcaaaaatatcattgaggtcactcttcacataccatggtgcaaatgccaattctaagagtaatttattagttccaagcatatttaat

SEQ ID NO: 55769 - DNA, 1501 bp, Oryza sativa
cctaggtttcctctcggtctcggatcatttaatagagccaaaaatgaaggggaaaacgccgattaatccccagaagcgaagcaaaaaaggcaaaatcgtaacggcaaaaaaaaaaaaaatcgattggccgggagggacgaaccgctcgaggcactggagatcgaacgatgcacggaaacgtgattttccccaattcctcacatttgctacggctgctgctggcctgctgatgctgatgctgatgacgacgacgatgattcatagcttgcggagagaaaaacaaaaaacatgtcggattaaattagctttctcgcagcaggatttggaaggagaattggagagaaaaattaaaaccgaatttgttctgtgcttttctgggcgcatacctcgatcagctttgattatctgctgctgcggctgctactgcttttgggttttttcggccgcatccatttcgatcggatcggatgcgtcgcaggcccgggtgttgttgtgtttggctcatggcattggctccggaggagggattttgggaggaatcgggatcgcacggcaggtctccgggcgggagacgtgcgagcggaggcgccatgttggattgcttcgaggggtgatggtgcgtccagtactccagttcctgcatgttcgtccggctcttgatatttcgatgacaagagtgcgaatgaacaaatgcgagcggaagggagatggggatggttgatgcgcgggcggtcgcgcaccagctcgatcagtttccccctctagtcttttccctctctctctataagtatattgatacgtatatacacgtacacatacaaactttatacttcctccgtttcacaatgtaagtcattctagcatttcccacttcatattaatatgtttagattcattaacatcaatatgaatatgtgaaatgctagaatgacttgtattatgaaacaaaggaagtattttactagaaaagatactagtgcgttgcaacaggtgaagattattttaatcttgttattgtcatacagtttaattgctgtgaaatttattgtagaaattcgcctggatatatatatatatatatatatatatatatatatatatatatatatatatatatatatatatatatattaaaaaaagcgaacttatttccaaaagcgaacttaaaaacggactcatacacggatgatgtactaaagtaccggtaaaaacatcttcaatttttataatagtagagatgtgtgtatagataaaataaaccgaaagatacttatatatttaaaaactgaaataactgaaacaaaaccgaaagaaaactgaaaaaagaaaaggaaaaatcgactcttcccacgcgctccatgagagagaatctgacttagaccctgtttctttccgcttaagattattataatctagattattgagttagattactataagctagattgttataatctgtagtagaataaccggttagttgtttctttcctagattatttgg

SEQ ID NO: 55770 - DNA, 1501 bp, Oryza sativa
gaggaggagccggggagcatcccgccgctcctgccattgtcgcccgcccgcgctcctacccagcgatggaggaggaagtgggagaggaggagagaaaaatgagtgggggattgagtaaggagattgagagggtgtggaaaaatgagaggtgagagagaagttgaggagataacgatggggacttaaaattttaaagatgctgagcgggaagagacatttttgcatgcgcccgcttaagaaatccacatgctaaaaaatgcttgtgttttgcatgcgggtgtgttaagaggctcctatgtgaaaatatatattttttttgcatgtgggtctcttaagaggacttttatgaaattaatctaatagatcatgttgatatatttttctaagaaggtaattaattttaggacaaaaataatatgaaacgaaggctgcatgttctgaacttatgagtagtggagattcttcaaaaaaaaaagagagagagattggtaaggttaatttgatcaaatcaaaagctgcatgttgttaaatatttagattaaccgtgtgagaaggtggcatttttaattggcaccgtatctggtgcaaaccagagttgctgtgcagccttgcaaactttcaatcaagaccacatgatgctcatccgatggctagggacagaggtgggttacttttgcacttaaccgcccgcactcatatctgctaatctgttttttttatgcaaatcccccctgcttcgtgtggccgccgtcctctgccctctgcctcgcctctccctctgccctcccgccgtcgccgctcgccgccgcggccgcgtccccgcccagccgactcgatgctgtcgctggcctgccgagatgtgcctccttccgtcgccgctcgccgccgtggccgcgtcagccggctcaacgcggtcgctggcccgccgagctgatatgcaatggaatcgtgttctgagattgacactgatgtactgattttgtaatctaaaactctgaaagattgtgactgcaaatatgcaatggaattgtgtaatgtcatttgataatgagattgagtcaagtggaaccataaaattttttttcttgcttgtggtgacagtggaacctatgggtgtgtaagagcaactccaatagagtggctaaatgactggccaagttaaattttagcaagtatgggagaaaaataccctccaacagccggatggctaaatcgcatacttcactggtcaaacttggagagtctccctgcctggctatttgtgggacccaccactccctctcccacccatctatctcccccggcttgagcacgctcgtgaacggcgacggcatgaaccgcactgcacgacagcgacggccgacggcacataggagagaggcgccggagccagccgcgaccgacgccgtcgtccgcgccgaagcccgccgcgaccaccgtcgtcgttcgcgccggagctagccgcgacctcccctctctgccttcgatctccggccatggc

SEQ ID NO: 55771 - DNA, 1501 bp, Oryza sativa
ggcaagcaactgcgatgaatcattgaggctctgttagatggatctggggattattttttgcttgggctctctgttctttctcctttttgatgtgtgcaatctctttgttcatgaaaaagctaggtaatagatttgtttggacaattggttgcgttctcctttctttttcccttcgtgatgatgaatatatgcaactgacatgttcctgaaaataactggcaataaattgatttgtgtggagttgccatacaatctcaaagttaatgtccacatcatatatcggggcaaaaacagtacatccacacaaagaaatgcaaagggcacaccagtctttctgctactaaattaacaccgttaattcatcctaacagagtaagggcaaacagaagcttcaatttgaaaaaacaagggcaaaatcacaaaccctaaaaagaagaggtaaaatcacaattgaatcagaaagcaagggcaggaacacaattgccccaatcttaacacaattgaatcaggaatgggcaacgctaatgggtgggtgatcaccccccctccatcccccttctcatcccctcttctcttcctactacaccataaatttgaaaaaaaaataagaaaacaaagttagaaaaatttatgtacggaaatactatatatatataaatatttgaattcaaattcaaatttgaatagggtatataaacttttgacttataaactttgtgtctataaactatatgtgtataaactttagatgtatagaaatactatatataaaaaatatttaaattcaaattcaaatttaaatcggatatataaacttttgacttataaactttgggtctctaaactttaggtgtataaactttagatgtgtaaacttgaggtgtacaaactttaggtgcataaatttactaaaatatgaaagtaatacggtgaaaaaaaaaaaccacgtggagaggagaggttgatcgtgcctcgcaagcgatcgcgcggtaggaatttcgggagaggaatccgttatcgattttgctatatctcactcgaaagattttttcttatctctcactcaattttttcactcaaaattacagtatattttttttaagtcacagtgtaatttatgaaacttacattgtaacttttgtaagctacaatgtaattttttaatctttgcatgtaagttttgaaatttatattggattttgtctttttcttgaagatatggtaatttagtgttcattatggtgttttgagttgctttttgctttttactgtgtctattggattttaatcaaaagattaaaaatcggtttgatatactcccgtcggttagcgcgtccgctgcctgtagacacacctgacgttggctctctatgtcaggccggattgggccgaaaggtacactaatttggggtacaccgatttgggccgagggtgcacacatgtaacggaggtgggaaaaagtccactttacatcgtcacaattggtcgagttttaactgtg

SEQ ID NO: 55772 - DNA, 1501 bp, Oryza sativa
caacatgtgttcttcaattccttctcaacgagctcttcctcttcttttatcattgccggtttgcaattagcaaactcgtcatggtaacctgcgctccctcctcacactccgcgccttgccgccgccgccgcgacggtgctggcggacgcggcgggtggcggcgcctcttccctcccacatcccatcaacactagtcctttcccctgatccttgagccaccttcaccttcctctttcttccttcatttttcctcaagatccagatccagttcttcttttttcttgcaataactgccccttagctagaccgctagtagactggccagcagtgcccgcaagcagtgggaggagcgacgcccggtggctaaactggcctgcaacgtcttatcttccgggctagcaggatggtgggttggtctgctagcttgcaagcctggttgtgagtggtgacactatgaaaaggtctgtggttcctgcttgcccctgctagttcggcggcatgggagtacgaagcggaggcgatcagtagttgcatctagcggcatggctagcagcgacgacggatgacgaacaggactgccggcgttgggcgggagaaatttgagattatactatcgcaaaagagtggttctataataccatcacttaaactagcttcgataaaataccactatgctagaataccattttggactattttacccttgtccttcttcttcctccctccaactcctcatcttcatatcaccggagaccatggcccatggcaatggcgaggagagccgagggagcaacctcggtggccggtagcgggagcgcgtgggtggcggtggtcgtcgcgcacaaccgacgtgagcgcacggccgagctgtgtcaggtatgggagtagcgggagttggcgccgccgtcaccatccaccttcaccactgagggtgccgtcgcgtccaccgctgccatcgcgccaggctggcgtgggagtaccggctgacgtggccatccatcgccacctccgagcacaccagacaagccccgccgggagtagcgggcgtcgctgtctccgtgtcacggtggcgacctcacctgacgacaatgcatgacaagcaacaaaggctcagttgggaagtcggtccaagcgcacaagacgaccgaacacgcgattcccggagagtgagtggacccagtagtcataggctgggccactgtcagagagagagaggctgaatagtgaattgctatataagccgacagggtagcgagttggggaattcgaagattgtattacaaacaaactcaaatctaattccaactctcccctgttcttcatctgttcttcatctctagctctgttcttccccttcttcctgcttccgatccaatttcttccttctttcaagtgttttctgctgcagagaaactaggatcgtgacattttggtatcagagccgcttcgatcctggagaaaccacggtacacctcccgtctgcaacttcaagttgaagata

SEQ ID NO: 55773 - DNA, 1501 bp, Oryza sativa
caatagtcccggatgcaataaaaaccggggctaaagatgatctttagttccggttcaaaagggtaacgggcatatttgatctttagtcccgctttagtcccggttcgaatgctgtcaggtcatgtcaggccccccccgattaccaaccgggactaaagtcgtaactaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcagaggtgcctaaaaggtttgcaacttcatcctccaatgtttttttgtcatactacatttgcacctatgttttgcacacttttttttgtctccaaaatttagttgtaagttgatgagagagaaaatgtgtgtggggaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataaatgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgtgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggtgatttattgaaactcgtcaagaacattcttccggggggaaacaaattgcccgagacaacgtacgaggctaagaagatagtctgcccgttaggactggaagttcataagattcacgcatgtccgaacgattgtatcctatatcacggtgaggagtatgagaacctagaagtatgttcgtaaccgtg

SEQ ID NO: 55774 - DNA, 307 bp, Oryza sativa
ttacaccaagtataacggaattgtttcactaagtagatcgaaaatgttttagtcgtttaaatcgggcgttgtttcaccttatataaaaacaatgtttcagtaaatagcgaaagaatgtttcagttcaccacaacattagatctatacatagtgaaatattgtgagtacactaggtgaaacattttatgtgaaacaacaaataaaacgaattcccttaatagagtatttccaaaatatgtggttgatttgttgcaacgttgtgcgtggtggggacacgtggcaggagcgacgcagtggtggggacaca

SEQ ID NO: 55775 - DNA, 1501 bp, Oryza sativa
acgaccactgggccgtgcttgggccggcacggcacgcgaatggctgctgcagcacgaggtcatcagccatcacccatccacggtcaaatttcctatgcagccagcaggtagcagcaagtagcagctcgttttcttcatcggctcatcggtagcacgtagcagcaaccagcaaggccatcagcccagcaggccagcactagcatttggcaagattgttggctgactcacgccgccacgccggtgggctgcgtccccgcgacgagctgacgaggaggagcaggatgggcgtggctgtcactgccgcgtcaccgcgacgggacgacgaagccgcaagccaccgctgccgcgtcgccgccagagtttcttcttagcgcagccggcctgctcccgtcttttgggtcgtgcttgtgccggcctggcacgaataggcccgtcgggccattgggccgtgcttgggccgcgtcctgaagaggccgtgctgacacggcacggcacgacaagtgggccgtgctgggccggaacggcccaatttggcacgaagcacgctgggccgtgccgtgctagcccggcacggcccaagtcccagctctagggacagaggtgggttacttttgcacttaaccgccctcactcatctctactaatttgttttttatgcaaatcccccctaatcacagctccgtccgtccgccctccccgcgtcgtttcatttctatagcacacacgattcgccgccgccgcctgcctgagtccccgccgccttccagcgactcgccggcgccccttcgccgcgccaccgccgccatgtcgcaaaccctcccgttgtgaggtcacggtgtagaacgtgccgctgccgccttggagtccggcacgcgcgacgtttcgaattccaacgcgacagaccctgtgcaggaccagcgggcgagcgccgttgatcctgtcgtcgccattgatcccatctccgttgaggccgccgccatggatcatgccgtcatcatcgtggacgagggccaaacaagctgtgaactatgaaccgtggaagtgtacttgctggaagtccctatacttgatgtattcctgaatgagacatgcttattttcgtattgtgaacattttaatcttaacctgtatgctcttgttatgggtagatgctgccaaaatttagtaaaaaagggtacatgctgccaaaatctgaactgcaacaagagcttcttatctgagacatatttgccatcaatatattgcaatacatgaaactgaacctgtatcaaacctatcaagctgttgtgctctagcacatgtgcagaaaatgcacaacaagtagtttgacagtttgacagattacaaaattcgtgttggtttcagttcatcttttatccgaatgcgtgaagctgggcatatattcagtttgacagattgacacagaaaacaactggtagttcattcaggctattattcataagagcatctccaacagactacccaaatccgactctccaaa

SEQ ID NO: 55776 - DNA, 1501 bp, Oryza sativa
ggtccgcagtcccgacgacggtcggccgcgcgtgcgcctcccctgcgttggcctgttatccccgccgcgcctccccttcatgtcgacccgtagtcccggcgacattccgcggcgcacgcacctccccttcgcgccgccgcctgctactcccctgcgtcgcgtcgccgtgcctccccgtcgcctgttcgtgtcgccgccgcttgctcgtgccaccggcacggccaaatcctctagccctaggttttgggatgggggaggggaatccgtagctttccaacccaattcgcacagctacttgagtgatttatttactcaccaggggtataacagtcattgacaaattacgaaattatttttttattttcttccccctttgtttaactcggaaattctagccccactaacagccgtcaaaatcgagggcaaacagctacttcattttgaaaaagcaagggtaaaaacacaaacctaaaaaacaggggtaaaatcacaattgaattagaaagtaaggacaggaacacaattgccccttaagaagggcttaaacgctaccaataactcaataagagcatcatcaatagtgcctctaatccacttccaatttatatttttaatgattttagtctaaaaatccggcccaacggcctccctaccttgtccctaaatctttgggaattttcttccctttgattttcgctctaggcatatgagggcgaggcctcgctcccaatcttgcggtcacgtcgttgtgaaacatactaggtctcttgtgatgcctacgcatatatcgaagcgggttgttcgatcggtttaggttcgccttgcctacacatggacttatgttttaggcaccatagaatttactaatggtgcatattaatagcagaagtcccaaaagcagcaaactagtagcgaaggtagtttgatgaaggctcccatttttcaggaattcctagacgagaagcggtgctttattactcccaatgcaacaagcatgcaacttgacaaccatgcgggtgccaccactgaaaacaagaaaaggaggagggggacgcaaaatagacttattccttaacccccaaatcatctcattctcctctattcggaactccggcgtcgggcatggccatcggccgtcgccaagaacggcgcgccactcctcggccccggcggcggaccttcctccagctcgtctccgcgggctcatctaccgctgccacgcgcgcgcgcgcgcgcggggtgtcacaccgcgacgtcaagccacagcggagcaggaggccggccgcctccacgccagcttcgaggagaacgtacggcggccgcccccaagtccatcccattcgccgcgcgcggccttctccgacctcgacctcattgtcgtgtaccccgcgccggcggccgggtagaacgcggtggtgcgcgctgccttgccctcgtttctcgcccccctccttcgccttgccgtgtcgtgctgcatctgtttggcaggcaacgcgtcggc

SEQ ID NO: 55777 - DNA, 1463 bp, Oryza sativa
aataaccttacaaagttgcatgaacaaatttaacttcactaatgagttacaaaattaacaaataacactattcatttttttctttttctgctatgtttctcaatttttcacagatgaagttcagtttatccttaaaactttacatggttgttcaatttgtgagatttttttttccaaatcttttgaaaacttttatatctttgtttgaaatgtaaaaatgagaaacatagaagaaataatgatattttttaaaaaaaataaaaaataaaatctcatagatagctaaggtaatagtactttgacaaccatgcaaagttccatgaataaacttaactttatttttgagatataaaatttgagaaacatagtagaaaaagacaaaaataggaatattgttatttgttaatttatatatcattaatgaagttgattttgttcatgcaactttgtagggtcgttcatttacatattacctacatgtgtgattttttaaagaatttttaagaacttttataaaaaaaaaattcaagtttccacctaggatgtgatttccaccatatactttccccatcaggaataacactatatgtgcatcttcggtaagtgtaagagcatctcaaagagaatggccaaatggctctccaagctaaaattggcaagtataaagaaaaatgccctccaacagcctctctattctgttggctaagccgtatggctagccaaatcacagcactcactggccaaacttggagagtcatttcggctggccatccatgggctccaccactcctaccatctctctctgcccaaatagcagaggaccatggcagtggtggtgttacagtaggcttccttgtcgttcgccgccgtcagctctcgccttgtgtgcgtgggatctgtcgcctgcctcacgcgtggggagccacagttgcttcgccgcccgcgcgtcgccgctgtcaccgcccgcgcgcgcgcgaagccgccgccgccgtcgccccccgcctctcgcacacgggggagccaccgcagccgtcgctgctcgcacgcgcggggagccgctacagccgttgctgctcacctcgtcgccgcccgcgcgaggggaagccgccgccgcctgcctggcgtgcggggggatccgtcgccgccgcagtcgatgggctgatgcgggagaagagaaagagaaagaggaggaagaagaaggcaatggaggttgacatgggtcccttttttattttggagatgtaaatagagagactattggagtgaatacctagtttgactgcccaaatcagttagagagttggctataagagtatttaaagagtctaatttagagatgctgttggagatgctctaacagagaagaagggaaaacggttcaagatcctaagaggtcaccgaaagatgtcctctaggatttgaggtcttacgaaatatcctcctgatctccaacagatcagaca

SEQ ID NO: 55778 - DNA, 1501 bp, Oryza sativa
gacacagaaacacatgatctttattaattgaattaacaagatacagtttccatatataatataaaatatgcgcgccattgcctgtcgttgaacagatccgacatcagtgatgtggtcttctgattcctggggtctcgagagactccccgttaattacctccgcagatttaggcctacaggagcacctcctattaagctgcttgtggtcgtctcatcgtcttcgcttcgcattctccatgcatggttatgatggtgatgtagatgtgggcgccggcaatgcatccacggccttgtcggtccgtgcgccgatgttggtgatgtagccttagggtcggcttcgcccgccctcgtcgtctaacctcatcggtcttgaacgacgtgtcggtgtagattgcttgaagaagacatgcatggaactgcgtagcttggacggctcgacgtcatagcaacagcatcggaatggtgttaaaggtaagatgagttggtgaagtcagttggtgtacacaacagccgaataaacatggctgggcatctcctgactagatgggatcaaacgaacgaagagttgacgaagacagttggtgtagacggcagccggattaaacatggttgggcacctcctaacccgtcatgcctcttatacaacagggacttgtaatgaagatgttgatgaagaagtcggtgtagacagcagccggatgaacgtggctttggcacctctttcggatgatggatcagcccataaaagggctctatgagggtgccgataacaacagcgaccttggaagaagtaaatgcctcatcggcggaacggctgagggcatttgttggagtagattcagcacgaacggttccctggcatcacagataacaccattctttcttcatgttgacgtagacgagcgacgctccaatacgcagatgagcgacagcattaatctccacgaagagggagagcatcacggacgggcggcatctcaccttggcgtaataaagtgaaagcatcacggatggacaacacgacgactccgacctgacgaggtgaagggcatcgcggccggatggcatctcgtagccttggcgcggcggagagaaagacatcgtggatgcacgaaacgacgacctcggcttgacgacgatgcacgggcaccaagcagtagtggcgctccgacgttgcataggttgagtagatgttgatgatgtcgcaatgcataggttgcgaccagcaaagtaaggacgctcgacgtcttgtcgacgtcgtagcactaggtagatgcgatcttcggcacgctccggctgggtggcgtcacaacggccttctccggcaggtggcaggtgatggttagttgacggagatgagctctgcttggcagcgcctcagcgactcagcgaagaatagtcatcgcggacggataatggcatcacaagtccggcgcaatgaagcagaggtgtagtagccgaacggcatgacgacagtgtgcgggctccgggtagcggcgct

SEQ ID NO: 55779 - DNA, 1501 bp, Oryza sativa
agcagtgatgaggctctcgtcctcgacaacggtggcctcttactctcatcctcgatggcggcctctcacgctcgtcctcgacgacagcctcctcagcttactcaaaggtggctcggtcggcctcggcttcctcaacggcgatgcggcacaacatcagtagccacccgtcctcaatggcaacgggacgagcttggccttggcttctttaatggcccacgcagagcacaacacaactgcagtgaactagtgccaagtctagcgatgcccggtcaccgcagaggaggaagtagttgagactatttttttcccattttttcaatatttaagccaatatgttttaagtgttcctttgtattggatcaaaatgttgcagtgagtttttgtgttgtttcatattcttttccttttatgggtgagatctgtggatgtttcaataattgaaacttgatgtttcaaatgctacactaaaatgttccacgatgtgatccgattgtgtttcaccattttaatttattaaaatatatatgttttgtttgagagctgaaacattttcattcaagcaataaaacatttttcccgattgataaaacatctaaaacattttcaatgaataaacatttttcaacaatacaatgcaacaccgatgttttacaaaatatcaaatgtccgatttgtagcaatcccccatgtgtcgtgctatcaaattagcaaccaccgttacatgatggtggtaacatatgactttgtttggccgccgcgtaactggaattaattattgcaccttggaaaattcttatatatattagctatgtttcaccatggatacacatgcatccgggcgtgttgatcagttactccgtttgtgctttttttcagtgtcaatgcacatatatgtagtatcgatttgttctaataatatgtttgtaaaaaatatatatattggaaatatagttatacatagcttgtaaaaatttgattctgccatccgttaggatttatcaacattctttggaaactattctggaacatgtaacttttaccacatatgtttactccggcaaaattggatttctcacacactatttggaaagatcgataaagggttaactaattaatatttatatcaactagcttaatgcccgtgcattgcaacgggaattaaaaagggaaccaactgtacattgtaaagcctaaaaaattaaaaaaaaaatatttgcatcgtaaaataaattttcattgtttgatggcttagggttgtgagactgtttgagggacccacatggtagtggactagtggtggtgggtggtggcagattcaccaccatcaccattggaatattttaaaagagtatggagtatagatactccacatcttgaattttgaagtactacacaactttcttcagaagcagtgatccctcttttgccatagactgaagatctttgctgcaagaaagccattgcccctcgtaggactgaggtccatacaaccttataactg

SEQ ID NO: 55780 - DNA, 1501 bp, Oryza sativa
gaaggaagtatgtgtgaagagaaaactagcaaaaaaacagaggcgagaaaacaacgtcagaaagagagaaaaaattgactttttaacggtcaccaaccacaccaaacagaactcctctcctccattagtcaacaaaacagaaacagcaggaagaagcaaagatttggatggtgtatcaaacttgaacttgatcactgaacttggaaaacagaagatgtctgatgctgttcatcgccgtaatgatgaaattcttgctctgaactttttcttttactgttcatcacaaaaacgtgggtgttctgacctttggtcttctcttcaatttaaaaaaaaaaaacagtaaacggccaagaaaggaacgaattaataatatccgaggaatccgaggattaactctcactgctaactgctaatttgtctctaagctgttgcaatttgcaagttgcgtcaattatatccatgctaaatgctacacatcaactcatcaaacatgtagtaagtttcatgtctctctaaagtcgcaaggaaaaggaaagaagatccaggcccatctctgaacctccaagaattagagacccctaaatattacagtttcaactgtaatctgttgcaagttgcatcaactgtacccatggtagatgctactacaaacaaggaagcatcatcaagcatgtagtagtcataactcataagccatgtctctctgaactccgaagtctcaaagaaaatggaaagaagagaggaacatgcttgtgtgcaaccatgaaaatctatgtcttttctccaagaacatctctccagcagaaaagaacagcggtgtctctgtaatctgtgaatgcatgtaattaactgataaatacatatatacataccttcgactggatcagttgttgctcctgccggcttctgagcctgagctcgagctactgcaacccatgagcacgcgatcaccagccagcacaggatgagctgatgaccaccatggccgccgctgctgctgctgctgcagcgtatcctcatcatctctttgcctctctgtgtctctgtgtcacgttatctcgctctgatcactctgtctgcctgtctgtctgtctgtctctctgctgcctaaaaatcgattcttgtgacaggtatatatgtacaaattaatgtacttttatcagcgtgtgtttctgggtttaatttagtgatcgatcacatccaccatcatcatatacatatcgatcgggaaggacgacgacggggtcgtccgatattttttttccaagaggcgaccttctgtggttatatcaatcggctacttgcaacccatcgttgtggctagtactgttgcactggactctaaaatgtacaccccggaagaatgacgaggtcatcgtccaatctctctcaaggacttgtgcatggctgggtgggtgccaatctcggtcctaaggctcagccactcaaccttgctgggacacagggccgtcccgtgaaattccggggccctgtacatata

SEQ ID NO: 55781 - DNA, 831 bp, Oryza sativa
taatagtctacgtttaatatttataattaattttcaaacatccgatgtgatagggacttaaaagttttagtcccatctaaacagggccttaagctgcgtttgttgggtgatcggagagaaagcacatcgttttccgtgtgcacgcttcccaaattactaaatagtgtaatttttttaaaaaaaatatagagaagttgctttaaaaaaatcatattaatccatttttcaaaaattaaaatagttaatactcaattaatcatgtggtaatggctcacgaacgttttgcatatcttctcaatcttctctctccccttctccccaaactcaaccttagtcgcatttcgatcggtatatacttaggccatgtttagttcgtgtgccaatttttttttaaaaatatacaggcgcacatttgaaatattaaacgtacactaataacaaaacaaattacagattccgtctgtaaactgcaagatgaatttattaagcctaattaatccatcattagtaaatatttaatgtagcatcacattcttaaatcatggcgcaattagactcaaaagattcgtctcgtaatttacatgcaaactgtgcaattggtttttatttttatcgacatttaatattttatgtatgtgtacagatattcgatgtgatggaatttttggaagtttgaagggaagccttagtcgcgtataaataatgttggcgactttggagcacgttgaagatgggagcaacagggacaacgtgattaaactgcagagtcgtagtttgatcgtcagtgcttacgcagcatgcacgcttaatttcagtatttcacacgcggca

SEQ ID NO: 55782 - DNA, 1501 bp, Oryza sativa
ctcatcatctctttgcctctctgtgtctctgtgtcacgttatctcgctctgatcactctgtctgcctgtctgtctgtctgtctctctgctgcctaaaaatcgattcttgtgacaggtatatatgtacaaattaatgtacttttatcagcgtgtgtttctgggtttaatttagtgatcgatcacatccaccatcatcatatacatatcgatcgggaaggacgacgacggggtcgtccgatattttttttccaagaggcgaccttctgtggttatatcaatcggctacttgcaacccatcgttgtggctagtactgttgcactggactctaaaatgtacaccccggaagaatgacgaggtcatcgtccaatctctctcaaggacttgtgcatggctgggtgggtgccaatctcggtcctaaggctcagccactcaaccttgctgggacacagggccgtcccgtgaaattccggggccctgtacatatactctctccgtttcacaatgtaagtcattctagtatttcccacattcatattgatgttaatgaatctagatagatatgaatgtgggaaatgctagaatgtcttacattatgaaacgggggaagtagtggataaaccaaataacgtacacattaagggcttattcgtttctaagaaaaaccaaaggatttccaaaacagaggatttgaatcctgtatacagcattcggtttacaggattgagctataggaaatttgaagggaaatttccttttgtgccagctgtatcggtaaaacacaggaatttttgcatccagtatgacctcttgaaaattttcctggcgcgaaaagagcgcgccacgagcgcactgcgcgcgtaatcttttcgctctcacgacaaaaaaggtaggtaccgctgaaaggaaaataaaaaaaatcacaggaggcaaacagactcgcatagaagccatcgcctttgatcccatctcctctaccacttcctctcctgtctccacgattgggtactggacctcctctcccacatcgatcgccggcaccggatgcaccttcgccgcctaggtgacaggacgcaacggcaacaacgggaagagccacggcagagatcggcaaggacgcgttgattgcaggtttggtgcctcctcttccgttgttatgcatagatctgatgccccatgctgcttctttgcatacaccttagcatttgggtcgctgcggatggggtcgtagctgtaacacacaagggttcatagtgtctgcccaatggcaatcttgtttggttcagagaagttgttgccggcgggcggcggcgatgagcagcaacaagtagtaggcgagctagccctgttcatagtgtctaccgtacgttctgccgtacctatcggctgccgctgccatctgtttgtctacccctctgtcggctgctctcatcctttgctgtggtgtactgtggtctgctccttgattcgtcctgtgcttcagcgattgaccgctctctcatg

SEQ ID NO: 55783 - DNA, 1501 bp, Oryza sativa
gtcaagtcgtcatggcgtacgaaaagaactccagttaagctggttcgtacttcgtgttggtagtatttaaacgtgctggcgtaaatttttttttttaggaaactggcgtaaatttcagatcactcctataaggaacactccttttggatgccactctgacgtgctctgttttggttgctctgtatactctatggcgataaaaaaaaatttaacgcctgggaacctttcccgaaacatttgcatatgaattccatatttgcacctcggcgcatgcatgacatatgacagtatgatacaggatgacataaaacacaacgtagtgatttcgcacaaaatggaggggggggggggggggggagggttcacgggagaacagcagaggagacagtgttacctcaaacagagagagcgcattgccaaagatgaaatccacggagccttcgatgtagcattccttgtagtagtgccggcccgagtgatcgtacagcgtgtcctgcgcgcccaggaacctgcaccccacgaacgccgcgttgtccgccgacacccgcagcgccaccgcctgcttccccgacgcccccggcttcggcaccggcgacgtgttctgctcaatatcatgaccgcgaattgaggagaacgaagccatacagccccgacagaattacggcggtggatttgttaccttgaaagtgatgttcctggcgaggaagtactgcgcgttcacggcgaacgacgcggagctgtatgtgccgagcggccgtcccgcccggccggacggactgtccgcggtgtcaccccactgcacgatcgtcttgtcggcgccggcgccctcgagggtgatgaacgcgcgcatcggcgatatgttcaccttctccctgcgagatcgtcgttgtgcatggtcagtactctctcgtaagcaccaacaagatcagagtcccaatgcgcgcgcgtgcacgtacgtgtaggtgccggcgttgaccttgatgacgacgcggacgaggttgatgatcgggagcgagtcgacggcggcctggatggtggtgaagtcgccgaacgccgggttcttgtcgacgacgagcgagtaggaggggaacgcccgggcgagcgcgtggtggaccgtgctgtgctccagcccgcccatgtaccgtacccactccatgaactgccgctcgatcgcctccacccgcgtcgcgttctccgggaacgacggctgctgcttccccgccgccctccctggccgcacgccccgtgtgtgccccgccactccgcccggcgccacggcggccagggcgacaatgcacgccacgagccggacgggcgccacggccattacgacgccacgcgcctacaggctactcgaacgggcgccgggtagctagagaggcgtgtgtggcggccgggcgggttcggtgatggaggcaggcgaaacgagagggggaaatttaaggagctcgcggctctaccgaccgatcgatcacggttcacggggcaagggagggacaag

SEQ ID NO: 55784 - DNA, 700 bp, Oryza sativa
cacatctatgacactaaacatatatattgttagcttgattcttagtcaaggtttgcaatgttgattttcttaaaattgtggcatcttatattttgaaacggagggagtatcttcttaatggcaaaattgcatttgaggtccgcgaaatattgcctttcgtctatcaagctcgtgtactttctagtttgtacagtgaatttggctttgaaacttggcaacatgataaatatagttggtttcagtgcaggtcaactgtttcagtatttttcaataccacacgtgccatattttgcaaaagatacatggggatgcatcctaaaagggggatatattctaatctttcagatcataaaatttcaaatctatattcactctacaaaggcctgtattgtatctggcacatgggccattttgtcatcaacagcaggtgtaatgaagggcctaattaaacatattcaagtagttgagggacttgagctaacaaatttaaagtattgagattttattagacaaaatgcagcagtccaggtacctcaattgcaattttgcccttttgttttcagagtcgtgtttgagaatcagacaagaatataactgtttgctctaatgtttacaacattgtcatggtttatggttgatgaccttttgaattaagatacttctattatttatagtctgttgctttctttcttgttttagg

SEQ ID NO: 55785 - DNA, 734 bp, Oryza sativa
agcattcgtcacgaaacaccgtacgagaacgatcgtaccttcacgacgaagagcacgaggaacgtgagcaccgcctggatctcctgcagcagaaaaaaaaacacaccaaccaccaccgatccacatgagccgaaatagttcgatcaccacccaaacggcacgatccggatcgtttacactgcaaatagatccggtatctcatctcagtatctcacccggcggaggaggaggccgtcgtcggccgagggcaccgtgctgcgggccgcgaagtaggagaagaaggcgacgaggtggaggaagtagtagggctcggagatggccaggtctagccacgggaacgggtggctccgcctgctcgccgccggcgccgacgcctccgtcgccgtcgcaacctccatctcctccgacgcttctccgctccgctgtcagtttgaactaaaagcccaaaataaaactaaattacgccttctaaaaggaataacgtattctaactctacgccttctagcaggatttcattgtcctattgataactacgcctccgaagcgagcttacgtattgacgaatttacgctttctggtcagacttctgttgtcccactgacaggtgggcccatctatccttgataaacccaaaggccacgcacacgagtcactgacacgaacgggcactcgcttctccactagggtttctcgccgccgccgccgccgctcgccgtcgccgtcgccgccggat

SEQ ID NO: 55786 - DNA, 1501 bp, Oryza sativa
ttaggtacgttttctggagttacatgtttagccatttaggtacgttttttaggtgcaaactcgaagacaagtatctaaaaaaaccattagagctaatatgttgtatgaaaatatttccaaatacgaatctagtgacactgtgtgcaaacgtatatattttaaatttagattagtcaaataaatagttgttgactttaggggaaaaggtattatattttcaaacaggcgcagtatacggttatatcgatttctaccaccctctctctattttctctcacctatatgtttaattaatgcatatctcttatagcatttgcgaagaatagactttttttgcgaaaattgcaaaaatcgcctcataaatcatttgaagtttgacattccacccccataagtcattttgttgcaaatacccatctcctatttaggtttgttgcaaaaaccaccctaacacgcatgtacttaatcaaatcagtttgtttattgttgatgtacggttatcacaggttaaattagtcaagtcaatattatcctagtgtttgcattagacttattttctatatttgattgaactttttttttcatatatagcgaaactcagtgtgacaacgtttaagctctcgtctgtaattttatttgtggaatctcaccaaaagagtatcaagaatactctgtaagtatttaattttggtaaaggccatattaactgttcacactttatgaaaacatattgattcggttacgcatgtatttattggggtggtttttttaacaaaaatatgtaggtggatggacatttgcaacaaaataacttacgaggtggaatgccaaattttaagtaactttatgtgatggtttttgcaattttcttttttttttcattccctcctttttcacatgtggaacaaaaaaggatcatcttacgcagtgtgacaacacacgcgcgtggcgtactggaatctgggcgtagaaacggcgtccgccgtacgcgcgccgccgttccggccgcgaggcccgcggcgtcgtgtaaagccagatggtttggctggtaccgcggccgtgtcgccaaaagccgcgagcagctgcggcggcagcgcagcgctgccgttatcagagcgccccgccgctccgggagccgcgccgttttcgttctagtactagcacagagaaggcgggcgctcacggagtcgcggtcacgggccggcggcgtgcaaagcggcaaaataacgtacagggagaaacagaacggcgcagcggacgcattagcgctttgccaggacaggatggcgggagaaacaatagatggaggaataatcaggggatccacctaccgtttactattagtgttgtagagtcttcaacgtgtcccaaaaaaactactactagaaaagaacggaagcgattttgtcagatatgttggacagttcatatttcaagttggaatagtaagtgtaaaattggaccacgggcataagctgaaagtagcatggatggcaaacca

SEQ ID NO: 55787 - DNA, 809 bp, Oryza sativa
ttttggtcaggacatgattatgaaaagtttggaacattatgtaattatgtaagcagctaagagcatctccaagaggttagccaaatggtcttatggctagctagccaagaaagtgcctagccatatttcctgtgcactccaacagactagccaaattcccaaatcacactctccatagttcatattttttggtgggccataatagtgagtgtaggtggggaatggctagccggatggcccaaccaatggctagtctgttggaggacctctttttttttttttttttgctacgctagccaaattttgggatggctagtcatacacgtagtcttttggagatcctctcatatgcctgctctctgctagttttggtctctctgcatttgtttcagaatttaaattgtttagatgtgaaaacaaatcaacactaaaccaaaagatggatggtgtcacagacgcacagtttgtgatttgtggacctagtacatgacaatatctcatgcatgaactatgaggtgacaatgtggctcaagggtcaatatttccctttcatttgatcgtcatgtgtattttgttaggatagattgcagaattcagatgtagtatgataacagtacattgatgtgatgagcttttcctaccagcaataatgttcgtatgtagggcttgaccatatgcttaattcaatcatgattacaaactacaaatatatgcgagatatcactgaatgttcctgttgccagttctgaccattgtttgttatgtatgtttctaattgctgatctctatcttgttcgacatcttccaga

SEQ ID NO: 55788 - DNA, 1501 bp, Oryza sativa
ttttcctcgctcgcgagaagtgtactaatttttatccttgcatatataaaaaaagctaattaaaacccaaaattgggtatgttccttgcatccatttgtgatcagctaacataagcttttcttctctctttacacctttagcatgatgcatgattactcattgatagtgtgatgataagttgataacacacacatcaacactgccatttgcatgggatgcatgaaccgagcctagatgccttcgttttcctagggaactttgctttgcggctcagttggggtgcattgcatgttggacatggacagtgccacatattagtgaattgatgttaactaaagtgcaatcttttacaccctttccggcctcttaactgaactgtagagattgcccctgtcacaagcttccctttcacacataagatatggtgccctacgattaggagaacctgcatgctcctttacaagctagctagctacatgcagtgcaactagctaggagagtatcacctgtcaccttcttctaggttgcaaatttttaaaagatgagattcaagttgcactttttaaactttagttaccacttttgagtggttagatgctcatcactctgtgcctataaatatggggacatgatcacatcttgatgcatctatcatatattgtggatcagactaacatatacacaggttcctgaagatcagatagatgcagcaccaggaaactgcagttatccaaagaaacacaagcaggttctctcccaaggtaaaagaaaaatctcaactcccaagttcttcccaaagacaaatcattttgaagttgtagacataaatattagactctgcatatatatgttgtttgtgttgattcttaataccatctaagtagttagtttgctctaattcccacaacacatcatcactgatgtcgtcagtttcacattgactggccattggccaatactgtggatatgcacgaagcacaataacataacatgtatttattcatatatcaaattagttatccaccctaataattaagttgaaatttgagcatcgtacgtggaatgattttgaattatcctaagtctcaaattgactatggccctacttaaagagatatatacggagattttgagaattagctagtacgtatcgatcgagatggtgagaatgtggagaaaccaaatttttgactagttcattttctggttctgtagaatgcaaatgtgaatccggactggtattctgggaatagttgtagctgccgactgtcaaaagaagaactatatttggttctaatagcatattaagttttacatagtagttgattcttctatacaaaataaaatttgttgattcactaatataatttaatttgacaagcagagacagataatgagacatccagaaatgaaaatacacttctatattctcatgcatgcgtccatatatacaagtctaagtcacacatgcgttttttcagggagaacaagagcttcacg

SEQ ID NO: 55789 - DNA, 1501 bp, Oryza sativa
tcttgagtacaacgctagtaaaaatattaaaaggagagcaaaaagaaaaaggaaaagagattcctttaagcacatctaaattttatttttttttcctcctcttctctcctctctctctctctgggtgtgatgggagaaaggaaaagatacagattgtattctaccgatggaagaaaaagaaaagcttggaatctctaaagcatgtgcagaaagctttcaattatttgcgtaaactatctgctcgttaatttgttaatctgccattaacttcacctcaacttgttactccaagaccatgtttattcagaatatgttccccttctaaagtgcatgtcatttaaattcaaaatatgacggttcgatataccacggtcaaaacgaatatgaaaaatattctcaagcccccaaaagtttcatattcgagtcttattcagaccaaatgcttttcttaacaaatattaataagaatttcacatgaaccaattcaattcacacggaaatcagagaggttaaagcatttcaaagaagcccccttacagaaaggtaaatgatacacgtcaaagaaacttatttacatgcgtcttagaaaaactgatgtggcatgctacgattgtttcttgatatttcataactaattgcttactaaattcaaaaaactgtttataaaagttcagtaaggttttgtaagtacatactctcgcttctcggtcccaaaataagttcatttttcacctattacacatataccagtataaaataaacaaaactataatactctcactttattaaaagtttttacgcgaacactttattaaattttaatataattagttctatctttatttgctctcaatgcatttattctctactttcacaaaattcgatgtagtaaatactcagaaataaacttattttggaacaaacgggaaatgataaaaataatcttatgagggtgcagtatagcattactcttacagaaatgcctcgtggaagagttacacaccatggtcttaggcgggcctcacaatctctgatggtaaagtgataatgacacacgaagatcatcataatgttttgatggatggatggatggagagtactcctacgaaattacatgcgccaatctcctataacaatctagaatgattggacatttcatagtatccgtccagattcgttgtaatatgaaatgtcttatctaattctaggttatattatgggatggatggaatataaaaattttttgaaaaaatgtttgtttttttttttaaaaaaaaaagaaaattacatgtgccaaatgtgcattcgccggcgacgtcgcagccgggaactttcctttttcccgcaatttattagcgcgcgcgcgccgcgccaccgccgtcctcgcgtttaaaggcgacgagacgacgaacaacacgaagctctccttccccccctcacctcgatgtcgccatcgagctctacgccttctcggctatagcctagcttgcttgcattgagc

SEQ ID NO: 55790 - DNA, 1501 bp, Oryza sativa
ggagttaaatatcctgaattttcttataggaaccacctcctttgtttcgacacaatattttctcatcaattcaaaaccacatgttctcaagtaattttattttagaatttaaatgttacaagggtaattataagaaaataatcagcgctcgaatcacacaaaatacatttaactttataatataataaaaaatattttaataaataacaccaacacataaatattcataataaaatttcacatattatataagaaggtgcccgcgcatgtgcgcgggctatctttctagttgaaacaaaagttgttcaacctggctagggtcagggatcaccggtgtcgtcgtattcgtcttcgatcggggggctgtattccgtacgcttcaccttgcaaaccacgtcgccactattactgtccttgtcgacgccggcgccttggattggtccattactcagcgccatcaatccagccacagcgtcttgagcggcaagttcgttggctgctcgctggcgacaggtgaactgtaagacatgcatgtctttcacattgatctacttatgtctttcggtgggaggcaacaggtgcccatgcatacgtttagctaattaccattgatcaactgctgtatacattgtgttcatacgtactttatcaggataatggaattcaacggtctcccaggagtcgagcagatagcagcagcagcctccggggaggacaacaaccttcggcctcccaaattggaagccgccaatggcagcgtcctctggaatcgatgcgggcggtcgtgagggcctcccgggggcaggcgtctgctacagcctcccgatgttgaggcaaacggtggaaggaggcaacggcggcggcggcaacctaccctagcgccgccgtaatttttcttccttttttttctttcgctcggttcgctgcatttgaagtggctacaccggtctagacgtcgtttggattagcgtccatccgcggacgctgtttacaggagcgtcctgatgcggaagctgtttagaatagcgtccttcttattttggtaaatactcacaaggaattactaattatttaatttaaatattattaattattataaataaaaaattcggctatttttttaagctacgctcaatttgcacttggcgacatgaatctaaccagttgatctatatttactgtgactctaaccagaacctaactagttgagtgtctttgcacttggtcacattatgacactttttttttacgtacctcacttcgcgcttggtcatattatgactatttttttttgaatcactgactcaacacgtgtacatgagtctctgactaaaaaaaaatgcctattgtttggagagttgcttataagggtaattgtgcatacgtgtatatgaacgtatgtatgtgttatatgttttttttaaagaaacaatatgtcacatgtcatcttgcattatacgaaaagaaaaacatcatgtcaaatgtgaagaagacactgtca

SEQ ID NO: 55791 - DNA, 1501 bp, Oryza sativa
acatataggtccaggggacacggccgagtaacgtgggattcttttagatagattgatttgttttttcttaaaataaagatctagtggttaaaaataatgggtccactagattaaatgaaaaccgatggttggatgttaaagctccacgtgccgatctagaagcgtttgtaggagcgccacgtggcggcttgagagcgtttgtagaaagtttaatggacttttagtatataatagatagatagatacttctcttagcgtattggtggcgtagtgatggtctgactgcaccaggaaggtggacgttgtttctagtagcgtccagacaatttctagtagcgtccatgtctggacgctgtttgaatgagcgtccaagtctggacgctgtttctacccgcgtccatcctattttagttaatcctcctagagaattactaattatttaatttaaatattacttattattataaataaaaaatttggaaaaaatagtcataatgtgaccaagggcaaagacactcaactggttagggtcacattgagcgtagctcaactggttaggttcttgtgaccaagtgcgaagtgagcatagctcaactgattaggttccttgtggtgagttgcgctcgtggtgacttcgtcaatctcaagatataccggcatggtcttccggagatgctcatagttgttttagttgctgtggtgggtgcatgttccggtgttgaggtgcatgtggtgacttcgttaatatcaagatatactggctcagtcttctggagatgctcataggtgttccgattcaaagctaaaaatacttatatgctagtaggatggagggagtatcgaatttgcatttggaaatttttaaataaacttggttaaatcatattgaagaatactgttaagaatataataggtgttgccgattcgacatgttgagttggagataccatcaaatcaaatttattcaaaataattaaacagtgaaaaataataactccatactttatttaaagaaaggaaatccaagctacatagtttttttttaaagaaagtaaactacatatagttataaactagccctccatcaaagaaaggaaatccaagctacaaagtttctttaagatgatgtatcacaaaactaaaaatttagcaatacatttatcataaactatacaagtttaaggctaaatatcacaaaactacagatttaataataaaattatcacacaactatacatttaagggtttaaatccttaccactaatgttatgtgtgagttataaatgttttgttttaaagaaaggaaactgcatagttaaacgaagctacatagttttgttttaagaaagtaaatccgagctatattttgtccttttgagaaagcatggaaactacccttttggcggcatgaacaaactaactagagtatgaaacctcttcatcattgttcccttgtaatttcctacgaaatagaccacacccaacgaggcaacccggccca

SEQ ID NO: 55792 - DNA, 1501 bp, Oryza sativa
cacatcgatcaattcgagcagggggaggggaaggaggcgagatctgggccaaaaacttacaggggaatgagagctccgaaggctggatctcgaggaaactcgcgctcatctggccacactcctcacgaatcaagagatcaaactcgagcaggaggaagagaaacccaacaagaaaaagaaaaccagaaacgaaaaagaaaagaagtggtttttattgctcgctttccaccggattcgatcgggggaaaaaaagccaagaacacgggggcttctcctcgctccgatccgaccaccaatcgacgcggaatctctcctcccccacacggatgaacagcaaaaatcgtgggggaaaatctccgctcgcgagctcgtggatgcaaccgcgatggatggatggaagcttttattaaaaatgggagaaatttcgtcgagtgaatgaatgagttggtgttcgttgggaccctgcggtaaaatgacgataatgccctcggtttgggtgggtgtgagcgcaagggggtgaggggtatggatggtatttaggctgagctggggcgaggcgtgacgtggcgctttaatgggcgtgcgagggtggccccacccgtcagtaaataaatagattaaagtgcaggtgggagaaacaacgtgtgtgcctctcactgattgacgatggctttgctcaaattcaaataaaattgatcttccattccattcgctgcaatttgcgattccgtttggtagaacgaatctcaaacgaaacactttttgagaattccaactcttcattgaacattttttttcaactatataaaagaagtacaattcacttgtactcccgcacttacaataggtggtgggctaggaatcctttccttgggcaggtacttaaaataaggagcggaacacgtgattaaataaatattagatataaaaattttaaaaataaactagctttcttatataatttctttttttttgaaaaaacgaaccgtttaaccatccgagaaacgtcgcgaagaaaataaggaagtaaaaattgggaaaatatagtataaaacatagacttagtgtttcaaaagattttctttttgttgaacaattttcgctcgtacgaaaatcatactacttcctcgtctcataatatagcaatctagtatggaatgagacacatcatgtatagatttactccagtattatgatatgtttcatttgcgtaactatgttgctatatatattatggggtggacaacaaaaaaaacaagacattgacacattgtcttaaaaaaaaaaaagaagaagcgggacattatgggctcggcccatataccatgatgggcctaatgggccaagcccatcaaggcccacacccacgcattccccccctctaggcgtctacataaacgtgcccttgtccggcgtcgccgccggtgaagccgctagggtttatcgccgccgctccgaccacttcactagggttttgcacgcggcggcggcggcggcgaga

SEQ ID NO: 55793 - DNA, 1501 bp, Oryza sativa
tcccctcgtcgagcgcctcccggaggcgccgcttcttctcgtagtgctgccgctccttcccctcgaggctcttgcggtacaggtactcccgccggagccgcgtgttccgccgcagcatctcgccgccgccgccgccgcgtgcaaaaccctagtgaagtggtcggagcggcggcgataaaccctagcggcttcaccggcggcgacgccggacaagggcacgtttatgtagacgcctagagggggggaatgcgtgggtgtgggccttgatgggcttggcccattaggcccatcatggtatatgggccgagcccataatgtcccgcttcttcttttttttttttaagacaatgtgtcaatgtcttgttttttttgttgtccaccccataatatatatagcaacatagttacgcaaatgaaacatatcataatactggagtaaatctatacatgatgtgtctcattccatactagattgctatattatgagacgaggaagtagtatgattttcgtacgagcgaaaattgttcaacaaaaagaaaatcttttgaaacactaagtctatgttttatactatattttcccaatttttacttccttattttcttcgcgacgtttctcggatggttaaacggttcgttttttcaaaaaaaaagaaattatataagaaagctagtttatttttaaaatttttatatctaatatttatttaatcacgtgttccgctccttattttaagtacctgcccaaggaaaggattcctagcccaccacctattgtaagtgcgggagtacaagtgaattgtacttcttttatatagttgaaaaaaaatgttcaatgaagagttggaattctcaaaaagtgtttcgtttgagattcgttctaccaaacggaatcgcaaattgcagcgaatggaatggaagatcaattttatttgaatttgagcaaagccatcgtcaatcagtgagaggcacacacgttgtttctcccacctgcactttaatctatttatttactgacgggtggggccaccctcgcacgcccattaaagcgccacgtcacgcctcgccccagctcagcctaaataccatccatacccctcacccccttgcgctcacacccacccaaaccgagggcattatcgtcattttaccgcagggtcccaacgaacaccaactcattcattcactcgacgaaatttctcccatttttaataaaagcttccatccatccatcgcggttgcatccacgagctcgcgagcggagattttcccccacgatttttgctgttcatccgtgtgggggaggagagattccgcgtcgattggtggtcggatcggagcgaggagaagcccccgtgttcttggctttttttcccccgatcgaatccggtggaaagcgagcaataaaaaccacttcttttctttttcgtttctggttttctttttcttgttgggtttctcttcctcctgctcgagtttgatctcttgattcgtgaggagt

SEQ ID NO: 55794 - DNA, 1501 bp, Oryza sativa
ttatgcgttttttatcccatcattattaatataaaatataataatataataactggagggtgcataacttttcaaggtgatgtaatacatattctttttcaccaagaaggtgctataacattactataaaaaaaaagaaggtgctataacatttttttttgctactatgtattattggtgaatacgctctagcacaagatattcatttcattagtaattgttaattaaggaagacacacttgtagatagtatgtgtattccatataaacaaaaacatgtaactattttttctatccaaaaaatatataactactgccacaacttagggccattcttttcctcttaaggattattaattatgatatgtcacttctcaagctacttaaacaacgcatattttaaaaaataagttatttatcagcatttcttacaaaaccaacatttcacttttatttaattcatccatttatgtccttaaataactacagtaaactcaattccatctataaccctatcatgtatgtatttggttgaataggtagagtaggtcaggttggatcgaaccaattttcaaaatgtttagtttgaagataggtgggataaggttgattccgtaacgagaatattcccccgaaatccgagttagcttcacaccttaaaatctagcatatcaatccaacacatttactctctattattgacatgtgggccataacctcccatacctaaaaaagacaaaaccactccatccctcatggcaaactgataatgggaccaccataaaaaaaacaaggataagtctaactcatttcaccttatctctaaatcaaacacatgctaagcaagtgaaacccatcctaccataaagccaagtttcatccataatccttatttttcatagttgcctccaatttcactctgagctaagtgaagcagtgtccaatttcactctgaaccaagtgaagcagtgagtgccctgatccaggcatgatttgttttcaaggttatatccctagtcagtctatctatctatctatccatctactcactccatcctaaaaatcataattttaagacagaatatattatatcctaagacaactaatctggataagactttgctatcttaggacgtatggagtatatatctatctataatctatctatctatcttccccttgttgatacaaaaacccaacccaacggtaagtgaggattaatcaagcttaatctcaccactaatcaatcatcaccaccatctaatttaacgaccacggtccagtaggcccacccccacacgtgggcccccacctgggggtagcatagtagattctctccctcggcgaagtatatatagccatggccacctcccctccaacctcaccaccaccaccactcgcctccgacgagctcctcctccctctcactctcacctgcgtttgtcgccggcggcgaggaagaagaagaagagagagagagaagatggtggggatgttgccgg

SEQ ID NO: 55795 - DNA, 1501 bp, Oryza sativa
ccagcacctcctccgccgccgcctgcgcattcgtctccggcaacatccccaccatcttctctctctctcttcttcttcttcctcgccgccggcgacaaacgcaggtgagagtgagagggaggaggagctcgtcggaggcgagtggtggtggtggtgaggttggaggggaggtggccatggctatatatacttcgccgagggagagaatctactatgctacccccaggtgggggcccacgtgtgggggtgggcctactggaccgtggtcgttaaattagatggtggtgatgattgattagtggtgagattaagcttgattaatcctcacttaccgttgggttgggtttttgtatcaacaaggggaagatagatagatagattatagatagatatatactccatacgtcctaagatagcaaagtcttatccagattagttgtcttaggatataatatattctgtcttaaaattatgatttttaggatggagtgagtagatggatagatagatagatagactgactagggatataaccttgaaaacaaatcatgcctggatcagggcactcactgcttcacttggttcagagtgaaattggacactgcttcacttagctcagagtgaaattggaggcaactatgaaaaataaggattatggatgaaacttggctttatggtaggatgggtttcacttgcttagcatgtgtttgatttagagataaggtgaaatgagttagacttatccttgttttttttatggtggtcccattatcagtttgccatgagggatggagtggttttgtcttttttaggtatgggaggttatggcccacatgtcaataatagagagtaaatgtgttggattgatatgctagattttaaggtgtgaagctaactcggatttcgggggaatattctcgttacggaatcaaccttatcccacctatcttcaaactaaacattttgaaaattggttcgatccaacctgacctactctacctattcaaccaaatacatacatgatagggttatagatggaattgagtttactgtagttatttaaggacataaatggatgaattaaataaaagtgaaatgttggttttgtaagaaatgctgataaataacttattttttaaaatatgcgttgtttaagtagcttgagaagtgacatatcataattaataatccttaagaggaaaagaatggccctaagttgtggcagtagttatatattttttggatagaaaaaatagttacatgtttttgtttatatggaatacacatactatctacaagtgtgtcttccttaattaacaattactaatgaaatgaatatcttgtgctagagcgtattcaccaataatacatagtagcaaaaaaaaatgttatagcaccttctttttttttatagtaatgttatagcaccttcttggtgaaaaagaatatgtattacatcaccttgaaaagttatgcaccctccagttattatattattata

SEQ ID NO: 55796 - DNA, 1380 bp, Oryza sativa
gagacagaccatgcaagagcagcgcatgatctctcggcttctttttctctactccctttctgagtcctcgactcttttttctacaaggatttttgagggtttttttttgttctggtcttattttgatccgaggcgtggttggggttggaatgtgacgcggtttggagatttcgcataggtatttgtagtcgctcagggactcgtattgtcatacataaccaatcaatttatgccaggtgtctagttaatcaagctttgtgttttttttttacgcgaaagctttgtttattcaaagacaaccaagactatatattcatatatactcctatatttgcaatctcacaagtacacaaactagtaccaactgttatggcctagatgaaaaaaagatgttcattagttttgaccaagtattataatttggctagagaacactactagaaaactcattttcggcatcgtaggggattgattttcgcaggcgggcatgtaatttggagccaaaaccccgccggcaaaaaaagtacctggggtggagggggcggtccgcctgtgaagattgatctttgcaggcgcctgcgaagatcgatcttcgcaggcgacgcttatatggcccgcctgcaaagatacccctatatagtctttttcctccccgagccctgttcattctccccgacgtttctctctcctaaagtgacttaaatataggggggaggttttgaacttcaaatcttcgggggaattttctacggtacttagatctactcatttccacactaggtatgcaattttttaagcttttagaccttaatttgtgatggatttatgcatccaaaattgtgaaggaagagctccatgttttttaattttatttcttttcatatgttgatgttagatgtatgtgtaatacttgatgcctcttgttgtagtggtttaatatggtaacataaattctcttttttttatttttgctatcacatccaccacctagttctagatctagatctagatcttgtcatatatagagagagaataaaattttaaatgtctatttattcggtgcaatcaaaaaatagttatagtattttgtaatatgccgatgatatgatttttttagattttcctaatgtactaatttggcatgtctgtgtaaaaaaaattgaaataaactttgattttttattactttacacttaacctttagttaattagttttgaatagcgataagttttttcaataaaccctacaaatttggtattaattgtgcaaatattttacgtatattttttttagagatatggaaagtcgggaatggatgtatcattggccgaggtttttgtctccatatagaaacgaagtggctaaatttattggtattg

SEQ ID NO: 55797 - DNA, 1501 bp, Oryza sativa
atgtctaaatgcgtaagaattgtctgaggtagtctgataattagattgcggtactaagctgtagcatgcccatgtcttggcacaaacttatttgttctggtcttaacaatcaatcaatcaatcattgagaatttcatggtttagtaagaaactgaattatctatgatagctatttcacttagtttgatatgcctttagtgcttttagcactttcttgagactgcagtttacttttcttattcacgatgaagactcagttaaatattgattactactggaagctaagttaatgctgatttttgagaacttgggcatttcaccaccacagtttcttacatatttgtcttgcctattcttctcaggaccccagcaagtttgctgttgctgcccctgttgctgctgctgacagtggcgctgctgctgtagcttcttccaaggaggaagagaagaaggaagagcccgaggaagaatctgacggtgacctgggcatgagcctcttcgactaaagcctctgatgccatatctttgccaagtcgaaagttttgtttcagttctaaacatcaaagtctgtctataatctttagcatttcaagcttctggtagtcaagaactatctaggccttagcgtgtatccaacaatgttatctttattatgcaattcaattcagttgtgcccgtattcctctggtgtcatggtgtgtttgtgcgatgatcatctttctgttcatcctcttgtgcaattgttgctacagacgatttgaattggaatcaggttgatgctcagctcaagaactattttgatttagggaactaccagactggacttttcaccttttggtcctttgtaaaaacattatacaaatagatccttaaaaaaacttattctaagaatgaatcatttttgcggtgccaatgtcatctgcatcgtagtccaactgtccaacatgacccgttgaaaagtcactaatgtggagggagacggtaccaatatcgtttgtgccaagaacctatttgttaaaaaaataaaaaaggatccatttgtaataaaaatttacaaataagttctcggtgtcaatgacacttgtgccaaggatctatttataaatatttttttattacaaataggtccttttttattacaaatagatcttttaaaaattacaaatatattctatttgtagaatgatttttctaaaaagatcgaaaggtgaaaaatccatactaccagacgaccaaagggcgtagtgataagccatacatctctgatcattcagtcccttgcaaaaattgtcatttaagtttcgttaatgcaggttctcgtgggcacaaaaacgctagcatatgctttcttcattctaggtgaagtttgttgtctttctgaaaaaaattgcacaaattttcccagtaagatgcagacacatgcatcaagctgcagggttcaatcctgagcatcgatttttagattggacggctggtaaagcagcatgtgcttgctgcagaa

SEQ ID NO: 55798 - DNA, 291 bp, Oryza sativa
cccctcctgaaagctaggatattttacttgtaccaaaaaccaagactggttagaaaatctttagccaggatccaaacacaccctgaatgtcacaggttgcaaaaagggggggaatgttccatacataccggcggtgaggcagatcatccagagatagaggaattccttgtaaggcaatcccctgtagacctccttcttgcgatcgtaggcacagccggggcaaccttggtggtagtcccccttgagcaacggcacctcctcttccatcccctcctctcccgcccggcaagg

SEQ ID NO: 55799 - DNA, 598 bp, Oryza sativa
tctcttacatagatactaaatttataaacatttttaaataggaattaatactcatgttggatccgttttgggtgtagcatttaatactactatatgatatggctatcttgatgatatatttatcaacaatattaaattcggcagtatttgtttttcgtgaaagatagcatatcttgaagatatatgcgttgaatctcgttaaatatgcatctatatggtatcgatcttagaagatttgcatccacgtcatccatgatatggcctcaatgttttcacccattgttaagtgtaagtacctagagctatttcctaaatgcaatcctgacaaaataaattcaattcaaggtgtcaattgggagcggattaagacggcccattttgtttgggctggagaatctagctagcaccatgttactactcatgacggcccagtgggccactctttatccaagtattcggccttggcccagctaagctagcgcctattagggctcgcccccctgcccgtgcgcgccgccacttccaagttccaacctccgccctctcttctcttctcctctctccttctccccgagctgcccctcttctcttcctccga

SEQ ID NO: 55800 - DNA, 1501 bp, Oryza sativa
ggcagagttcagggcaaggatgagagaacaggctgatgcccctgaagatttacccccacaacttctctttgttcatcaggtactgttaccacacttgttttatgtttacttcctctcattttcatatcattgtgttcaccattccttgtgtaattaaaatacatgtttgtggacctcgagatgtatttcaaaagtacagacactgttactgagtgaaatcataaatgtgatgttgattgttttatgtgcagggccagaaagacttgaaagaattgcactggcatccacagatacctagtatgatcatatctacggcagctgatggattcaatatgttgatgcccagcaacatcgatacaaccattcgagaagctgacgcatagatttctacagtagttgtttatctgaatcaaggtttcatgggttttttttttttttgaagtggatgagtgtaatgatactgcatgtctacaagtatcagtttttgatagcttgtatcctagtttcgttgtcattcatagtggtaggttctcagttttgcactgatgtcgcccgaatgaggataatcaaaagtatctcgatcaactgaaatgacatgttatattctacaagataagattaataattgtgcatctctgtgtttgcattaggtaatattcacctcgatcgtttgtatatttttgcctgataattaagttggatattaggtccatcggccagaaatctgggtcttgcagcaaaataagttgcccaagcatcattcttgctgtaaaatcttgttcttagaaaaccaagtggcatgtacctggtggtgttaatgacaccaaaggtgccaatataagttgtttattttataagttcctttatcgattgctcgcagaatgtaatcatgttctcctattatagcttggatgcgatgcgccactttcggcacttgacaatcaactatctgatactcctattaatcagcaaagtttctgacactgtaatctgaatatttgttactgttatggcatcagaacgtgcaattcgctgactagaatcaggatggatatgttgtgtgtgaagctctggttggccatttgatatctttgacaaactttattcgtttccgaaaatttggcagccgcccatgttgcctttccgaagatgcttatgctgttggttcgttttgtgaaaaaaaatcagaatcagaatgtcatcattctccctgaaactagtagaaaagagcatagcagcagcagcagcagccatcgatcacgatcactgcactgcaagccttcaacctggagcaagtgagccatgccatattggcatacgatacgcgagcaagtgccctcctttttatagccaacagcaagagcaaggcagatattagatagaatgaaagttggggaatcaatcagcggcagcttaatcctctcgtcatctccatcaatccatcgtcattaatcagagaatttgcttcttgtgttactaataatctttgaggggaggcaat

SEQ ID NO: 55801 - DNA, 1501 bp, Oryza sativa; identical to SEQ ID NO: 21831

SEQ ID NO: 55802 - DNA, 1501 bp, Oryza sativa; identical to SEQ ID NO: 21832

SEQ ID NO: 55803 - DNA, 1501 bp, Oryza sativa; identical to SEQ ID NO: 17400

SEQ ID NO: 55804 - DNA, 932 bp, Oryza sativa
ttcctgcacccccaaacaatgattagccaaaacatatgagtatgagtatacatagcaacatatatatgactatacatagcttgaagaattaggaattaggtggtaactttactgttatttccgtttccaagactaaaaaactagttaatataaatggaaactagagaaatttgaattgctacatgaatgatgaacaacatttcacggaaccaaatgataaaattatgcaaggtacaaattccgctaatgagaaatagaaacagctaatttacactaaaacttatacaatgtagagtatacttttggtgctattgtaaattttacaatcataaatacataccatgaagtataagaagggaaataacgatgatattggcaaacctgaaattcaattataaggatggaattcagtaaaaaaaatattgtaaggatgaaaggttaaaaatctaccatgaaaagctcacaggcccgcatcaatggaacaagctaagccaatgacaagataaataaagatgcaaaagagatgcaagaaacaacaatttagaattttgcttcaatagttcgaccaacgattacaagcttgaactttccttttagccccttaattttagacactaatactctctttatttttttaacttttaacgtgacatttgaccatttctcttattaataaaatttatatgactcatatttttttcatatttatactaaattcttaaataagacgaatgattaaacattatgccaaaagtcaaatgagtcatctatataaaaagaaaaaatggaggtagtacaaaataatcctctataagataaattcaggtgaactagaaatgactgataaagcattcacatcttgcaatgctggtggaaatggaaaaaaaatggatatgcaaacataatagggtccgtctaatacttagcaacca

SEQ ID NO: 55805 - DNA, 1501 bp, Oryza sativa; identical to SEQ ID NO: 21838

SEQ ID NO: 55806 - DNA, 1501 bp, Oryza sativa; identical to SEQ ID NO: 21839

SEQ ID NO: 55807 - DNA, 439 bp, Oryza sativa
cctgcagccccgtattattttgtttctggctttccaatatttccgatattattttcgtttccgactttaccatttttgatttcgtttctgagaaaaatatgattatggaaatggttgaggctgtttttcgatcgtttccgatcgttttcatccctagctgagacgtactctaaacacacacagtttcggttgaaatttatggaactgctgggtttaggctgcagctggttgactttagttaacagcacacaatttgcctaaaatttaaggaattactgggttctggcagattaattagttctcttacaattgcagcagcaatggtgcctccattaagtttttttttaatttgtatgtacgtaatctgtcaatgggatgtacgatagatgaataatcttgaactacttctactttttttaaaaataaacttcaactaaat

SEQ ID NO: 55808 - DNA, 1501 bp, Oryza sativa
tatctccaaaccaggaatataccattccaaaccaggagctaatcaaattattaccagttatagcatcatttattatggtgagaagtgtgagactaatcacgaaagacattgttagacccgcccataaccgcgggcacggctattcgaatagttttactctggccagaggtgtaccactgtacccacaagacacaacccaccagcatgttaccgtgtccgcgcagacacgtcaccatgttgagtgattgtgacaagacccctcgcataactcaactcaaagcagtgcaccgttcccggatcatagtcacccccttataaacaaggcatggactccccagcgacccccgtgggcttatctccgccacttctcagtctggtgctccgcaatgagccttgttatacgaagtgtccagccgttgcccattctggcttgtggttggcacggttaatgtttcacaaccgaaaatcgtgaaccggtccttaattgtcatgagcacgaccatcaaaaccatgtgctcacaacccaccattatcaagttttagttggcacattaattaattaaccaatcacgattgaccatcgtgagctatcattaaatatccatcattaagtaatagtgaaacattagttatcccaattgtgtgctaatgtttctaagcatggctaagcaattatgtctaacatctagttgaaccaatatataaatccaaccagtcaaattataacccgaggtaatcaagaaatagggtaatcaatgcaaactagccataacaaaggaataggttcacaccacccggtgacattcaaaaataaatgcacagttgaaataaatagagaatttaaatataggatcaacatgctcaaaggaattgtgtttgggatctgtgtgacttgccttgcaataaagggtcttcaattaatcttcttgaacacttccggcgcactcgcgaactttcgaaacgacggaaacgacaagctaacacacaaaacgaggaaaaagactaagaaactccaaataaacaatacataaaaagtaaacaaacatgtagatcataattttagatgaattttgagacttgaacggcctcattctgacttcatatgaatttattacgaattttacaagattaaatctaattaaagcccatttaaaaaggattaaataaatttaattcaatttatggataattttaatatgtagatctttattttatacaacttttgcaacttgaaccacattaaactgagttacaatgaattagttatgaatttttaaagattaaaccggattaaagcatttatatggattttaattgaattatgacgcaataatgaattatttttgaaaaggaaaagggaattattgcgtcatcggctagggttcgcggaggaccgggtgcatggcgacggttcacgaaaacgaacggccgagattcatccatccaaaacggacggccaagatccatcggtccacgaccggaccacggcagacggcaacga

SEQ ID NO: 55809 - DNA, 1501 bp, Oryza sativa
gttttgggtcaattgtttagttttttttttgtaaatggtcaattatttagttgaactgtacgctaacttttagtgctataaaaagaacagggatatccatgtaaaaagaagacgacgacgacgacgactagggtagaggccgtgacattaaacaggcaaagatatgggcctagacagaggggtaaatgtgttctgggccaactgtgtgttgacccgctacaagcctacaatccatgtcagcaacggccacgcaattgcaatcagattaagattattagaagtaatttgaaacaaaattaatactccctccgtattttaatccgtattttaatgtatgacgccgttgactttttgataaatgtttgacatttcgtcttattcaaaaaaatttatgtaattatcatttattttattatgacttcatttatcatcaaatattctttaagcatgacataagtatttttatatttgcataaaaaaaattaaaaaaaaacgaatggtcaaacgttggttaaaaagtcaacggcgtcatacattaaaatacggaggaagtagattattataatcatattattcaaattagtataatctagtaatctcctccaaaaatatgttctttttttattcttgggtggctaaaaacccacggcccctacatacttcaaagaaagtactcacttctatcatttgtacctcttagctcttatcgcccctactccagaacagatcgagagttagagagacctagcgaatcatggcagcactcagacgggcgtcgctgtttaggcgaacaaaacagctaagggctttatagactttaatctttcaaacctagtattttgtgtctccaataatctagagagaaacaaatacttcttatgtttcgtattatattagggcagtcccaaccctccacctaggatggtttctatggcattaactacattgttatgtaggacttttaccttatgtggcactatattaattaagagagagaggagagaggaagaaactgggtctcatgcaagatccaacttcaacacgagaacctatgcactagacattatcaagttttacatcgggagagaataatatcttcataatagatgaagaataaatatgattggtagagaagagagatgatgtatttattaatggctcactttaagaaatcatgggttgtggagtgtagtttctattatgatgtcttattgacatggcaccataaatactgcttatggacactatgggttgggactaccctaaatcgttttgactttttttctagtcaaacttttttacgtttgactaagtttatagacaaatatagtagtaattttaatacaaaacaaatatattatggaaatatattcaatgaaactaatttaatgtttaaaatgttactttttttataaacttaatcaaacttaaccaagattgactaaaaaaaatcaaaataatttataatataaaatggagagagtagcttatactactactc

SEQ ID NO: 55810 - DNA, 355 bp, Oryza sativa
  unsure (1)..(355): unsure at all n locations
atttgtcatatatttagttgtatntgatatatntgcactgtggaagatcttatgacatggatctgaaaaaagaaatcaaaagttttgctgcatgcttagcaaccaaaatcagttactggtaattataacggagataatctgcattttatcctaatgtggttgttccacttcatcaggaattaatagtctcttttgttactttttgaagtcaaatttatatttcctctcttaaaaacttgtgcattagcagaagtatcaatatttagcatgactcatagtgagaaaggataattcttcggtaccttgtattaattctttttgtatagttgtaaagtaacttgaaatgtattttagg

SEQ ID NO: 55811 - DNA, 970 bp, Oryza sativa
tgtggagtgccaatagctggagtagtttttgtcacttagtgtgttgcttatgcttcaaaaattttcatttcttgagcatgcaacgaaccattccatgtaggagccccttgcctgacctggaaaacatggtaattttggaaagtaagcagacaatgccaatattttactggattatcttgacatgttggatatcttggttaatcttgcctttgaccagctggcagccatgcatgcccagtcattgaggcaaaggtaaagacaccaccctagtatttactcatgcttgtgtcagttgtagttttcacatgttgactattgtccgctgagagactccagactgcatgaatgtgttatgcgcaaatgcagtttgaggaatccctcctcatggatggttggtacttaccaccagaggaaacaggaatggtgataagttggatggttacaccgtggtctcttgaaccgtaaacaactttcatgttcttctcacacaattacacttatatacgagttttattggatatagtagaaacttatggatggcattcttttattgaagactgtgtcagtgtactaaactacaaattaatccagcttactaccaatgaaagtggtaactgacaacacattgatcacttgcagagaaggtaaacaatacagctgtataatgctagagaaaactaatacagctgcataagttttatacttttacacttatacctattgaattcagttgtcttttgtagaaacttgtggttgatattctctgttgaatagtgaagtatatcaatttaactaaactgcataagaccctttttgtatcagttacatatttgatcacatggacataaatggttctgacttttaaatctagccatgaatttgttgattctgttgtgatccaatacatgttaacagtagcttgttgctaagttccttgaattgagctcaagcatctcttttattgtgaaaa

SEQ ID NO: 55812 - DNA, 420 bp, Oryza sativa
aaaaggattaaaaaacctcgcctgtgctgcgctgtgaagtgcttgggcgagtttgaacatattttgacaaactagccaagaacccatatgttccaataaaaaaacaaattatgtcgtgtgttgttattgtgggtggggaactaatcctccacacacgtaaaatggagaaacggattaacggatgattaatggagtattagtttaaaaaacttaaaaaatatcaatatatatttttaaaattaacttgcctataatttttttaaaaaaaatacacattgttaaaacattgtttaacagtttatgaagtgtgcacgtgaaaaaatgtgaaagtagaatgttgagaaagggggaaaagaatgcaccctaaatctaattcaacaaaatcaacgaaaattcaaccttttttgaaactgccacgca

SEQ ID NO: 55813 - DNA, 215 bp, Oryza sativa
cgatatttctctcaatatgaaaagcaaatctgccactgaatgtccatgaactcatgtggatgtttctttctgcagatacaagctggtatttctgcactggaagatgccctgaaagcaggttatgaagacttcaaggtaaccagacaacaactcttttgcagtacagataagcattcttcatgactagtgacacattttgcttgatttcatgaaga

SEQ ID NO: 55814 - DNA, 536 bp, Oryza sativa
taggaaaaaagttataattaatggcaagactagaaaaacaacattgattttaacgaattactttaacttggttttggacttgcgagtctcgaatatttgtgcacaaaactggggcgtcaacctgcagtactgaatactagtaaacagtaaacacatcatcagtagttcagtactactacgtaacacagcgacaccgaggtttggccagttgtgttattgccgctgaatcccatcgtcatattcagttctaattaatctcgactgtcaccactcatcacagccacgtaatcaccgttctcgccagcttcagtcccagtcaaaacttatacaacgcagatttgccatgtctgatgttgtcatgtccaacattttcccaagttcttagccccaaatgcgctgtacaagacgccatgcatgagctagctcaattagagaggtacaatgtatagctattacaacaagggagtctgatacgaatgaacatgcagcctgcaacaacatgactatactcgcataattatgtttgaacgaaaaca

SEQ ID NO: 55815 - DNA, 250 bp, Oryza sativa
atacatgtagaacaattgataatttgtcgtttgattactgcttagccaagtcatcagcacgtaaacacctcggcaattgataatcatatcctgtccaaatgcgataggccttgactcgtcacttgtcaccatcaaggtttcgcatggcggcaaccattaataatcaataatacaaacaaataaaagtactactaatacaactgcaactgtaatcaaattcataatttcgctcatgatgataatttatagt

SEQ ID NO: 55816 - DNA, 956 bp, Oryza sativa
tgggttgaaaatgatctctcttgatggtttaccgcgaaatactggcagtcaacaacgaaaagctgaaggcctcctcaagatgaacaattaccactagttctcaagagatcgctcagaattgaaaagaagcacatatgagttttcttcatgtatgactttgactgtttagcgtgaaaatctcgctagcaactacacagtaagagttaaatgctccctcaatttccccaaggatataagtaattaacatgcaaaaatatatatttaaaaagtcatgaacatcgatttcttccatatttcatgttataattataatttccaccaaaactctttaaaaattttatgtaccacatagccctaacctggtaatcgaaatcaaaaaattttcccttgacctaagggtcaagaaaaatccccaaattataataggcaaaaagtatggcccacttgtcaaagtgtcctctcttattaatcctcattaatcaaaccctactaatcttaatcttggcatccaaaatttcctaaatctatggtgactttatcaattttttcatgatttgtcggtccagtcttcgaacatgctcatagggataggatttgcgtgcacgtattcatatgggtaagtgcacgtgtgttgtgattgtctgcattatactgtataattgaaaaaaaatcccaaatccttttctcctctcataaataagcaaaattaaaacaaaaaaaattaaagcatcactaccatcaccaccaccaccgcgcttgctcttcttcctcccccgttttccccaaggcgcaaaccaccacgaaagcccccgaatccgcagcgcgaatttcaaagcagcctcccccccaacctccgatctcccgctccctcgctctctctctctctctctcgcgcgcgcgcgcgccatctagggttagggtttcgagaggatcccgctgcttgcgagtcccgacca

SEQ ID NO: 55817 - DNA, 441 bp, Oryza sativa
aaactcaaattcaatcctaaatctgagcctcaattgggcaaaatttgacagctccgtgaacggatccacctgtcattgacgacagtagaccagagggcccacctgtcagagagcaaatttgacaccaagttaacgcagcgaggccgactcaccctgcttgggcctacaagtcattgacgacagttgacccgaccggagggcccacctgtcagagagagacatgcgtctgtgccgtcgtctccttcctcgcgtcgcgtcgcccagttcagaaataacaaaatctcctctctacggctacttgcctctctcgtcttcctccccacgccgcgccgagaagcgagaggccaacggggcgcgcgctctcgctcctcctcttcctccccacgctactccacgcctcgccgccgcgcgccctcgcctcgcctcgctccgactaggtca

SEQ ID NO: 55818 - DNA, 316 bp, Oryza sativa
  unsure (1)..(316): unsure at all n locations
attcaaatcaagaagcctgcaaggtatttatcaccagttcaatgactacaaacatatgtcatgttaattcatactgttgccatcaataaactgtgacagtcgcacatacgtaacagtgatttttcaaccatatctggtaattttttgactnnnnnnnnnnnnnnnnnnnnnntccacagatacatgtcgaatgctaaacaagagcgctacaggttcagaattatatgcaaattatcacattccggacaagcatcacacacctactagtcaagagtttctagtagcacgagtggtaagtagagataacatatggcaa

SEQ ID NO: 55819 - DNA, 1218 bp, Oryza sativa
tctctttcgccactgcctttcattccttttccggtttctcatctccgattgaggggctgctcaatgcaggatttgctcatcagcttgaaggatttggccatggtatatatgcacggaaaatgccagcctcgctgtgcttgggcgtgctcttggtatttcttattctcgtttatcctctttatctatctcgcattgctagctgatccatgttgggtcgattgtctgatttaatttccagggattgttttgctggaaactttgaaagaacgacttaaggaaacctcaattgatccaagcggttttgatagactggctggctctcttaagtgattctgatgcgcattttcccagcattgcgagtgactctgagtctgaagagcatcaccctagcatgcgtttttgtgttacagaccccaacctgcgctcgatagctttgcccctaatcagtccaagttagatttagcatcctccctccgatgatacccatccatttttcagttgatacttggtcctttaatttatataaatctacagaccagtactattcttggtttcttgtcaatgtgatatgtatgtgagattacagttcattttcgttcataattgcaggtggctcagcgaggaaggtagaaagaaaagaacaccggcgagtcaaagatagcagtgagcaagcatagatagaccatgattattcctggtaggttagcacttaattagcactggagatttggtgttaaaacttgcaatgcgattggtgtttctgtctggctggtggctcgcaactggagtacatggaaattgaaatgtttcatggcagcaaattacgacatggtgcgataactaaaaatcaagatcccgagaattgccatacatatatttgagtatattcaagggacccatggaacgcaagaatcatatgtacaaactggaactgtttcatcttatatgagttctacatactacataaattcagcttcccgtagaaagtatagttttggcttatattaactttctcaaagaatcaaatctacacgatgtgtttattcagctgccaacaatgtccgtggcaaagtcaaaatctctgaaaactagttgtagctgaccttattcagttagaattagacccttttaggtgccaaaaatacgctggaatgtccaaggtgccgcagcaaacgatacattgaacaaatcgagataaaaaaaagtcgattatacatg

SEQ ID NO: 55820 - DNA, 458 bp, Oryza sativa
catatgggtccggagatcatcagaccacatgtcagcgtctttatcactaacatataggttcggagatcatcgggctcacatgttagtgataaaggcatggtgtagtgactgcagaggatttggccaatgcatggcaccatgccattaatcatactttaacatataacgtatacactgttggattttaaaccattcatcttattaaaataacaaaaaatagtataattatattgaagtataatttttacttagaatttttttaatgattaaattacagcagaataaaaaggacatttgacgaatgcctacggtcaacaagtgttaaaaagtgaacgacgtcatctatttaaaaatataggagttagtattgattaaggattttaatcttattattaccaataacaccagcgttttcttaatgcttattaactaattcttaattatttgcatattgcagt

SEQ ID NO: 55821 - DNA, 295 bp, Oryza sativa
tcgttgagtagtttgctattgaagaatccatctcttgaacccatctctcaaaatcctgaagcaccaaaatccccctacttggcgcgccactgtcgatgtttgatgtcacgactatggtatttgcatagtatagggatcgttggcaccagggtatatgtgagactgaggtaaaagagatggggacgaggatttttatacaggtttgggcccctgaattgtcaggtaataaccctactcctgttggccaaagccggtcgttgctcttattcatcataatcacaccagtacaatattt

SEQ ID NO: 55822 - DNA, 1501 bp, Oryza sativa
ccataataagggatgaaaacggttgaaaatgttcggaaactgtattgtttttctattattttatggaaacggttgaaaatggttgggaaattttaatttttatgaattaaactgaatttcaatgttaactgcaatgccgcacacataaattagaaaaacggtaacatttggtgaagtcaatattattatattagttttacgaatatcactatgatcgaaaaatttccctactccacatcaccaagagtctgtactgatgaaatagtcatctagcttaaccctttaatttttaatcgctaatcgcccctcgagctcccttctaagatgattatgtgatgaggtggaggaaaaaagttaggagaaagaggatgagatatcccttatatatgtaaatataaggggcaatctccacacaatcttcaagaaaagtttaaaaaaaatagtgtgagagtgaactaataaaaaacattattagggtttgtattagagatggtatgttgtacttgttacctcttaattaattagtagatgatatggctcaaattagaggtaacattcaccttcattataaaacttgctctaacgcttcttttgcatcgtattcctcgtagaattttcatctcagagcaagtttaatagtaggctataagcctattataagattacgcggtggagagaaaatttgaaaaaaaagaagaaggctggctcacatgcaactgttagctattcatatactccaaaataaaaacattaaatgcataggtgaaagatagagaaaggagaaaaaaatagagataagggcacgcacaaattaaggtctctattagtaggctctctcaattaccacgtaagcaaatttaatgacttggaagagagagataaagcaagatgaaaatatcgttgtttgctgtgacatcggcgtaacaacgccctggagtgagcaaaacgcggagacgagaaggaggaggaggagtcggcggtcgtcatggcgacgagcgacgggcggcgtagggaatcgagaagctaataccatgtttgacggatagactcaacgtgaattgtattatcacagagcaatacagatataggcatcataggccatatgctctcaaccgattcatggcaataaaatttgggagaacaaggaaggagagccaatcacatgatacatgccatatatagtctaacatgtgcctcgttgcacaacgcggtgtggggcatagagtttccagggtgttttatctagtacactctgattgtttttaaaagaatttaaacttatgtaatcgagatagaagtgtattgtgctgcatctgatagaagtacactctgaaagcacttttaataatttaactatgttatcaatatagaaatgtaatttgctgcatctgatagagtgcctaatggacaacatttacacaaccattgcttgttcacttaaattattctgcatattttcttgtactttgctctcttaccaatgggtctgttgtgtattagg

SEQ ID NO: 55823 - DNA, 206 bp, Oryza sativa
cattattgtaagaatgctatatttaagttttacctatgtacttatgttctggattagcttttgttccatattacttctgtgtgttttctgctcaaggattataagccatgttatgccatcacaatatacgctattctgaatcatattaagatgtcataaacattatgagagcaggtgtctattttctatgttactcagtgtataga

SEQ ID NO: 55824 - DNA, 1424 bp, Oryza sativa
agggaagaggcacggaaagtgtccatgactccatgtcaatgaggagggtgatgaaggggagtaggctaaagccaaagtcgatgatgatgccgatgtcagtgtccatgcgggttgtgaggccgagccgctcaagctcattgcggacaaggggtgctggtgtggtgttcccagaacgtgacctccagatgggcgtggatgtggtgccgcacgcgcaccatccagtcccgtgcgccacaacagcgcctcctcgtaacttgcggaggcagaggaaacaatgaggaggaggaagaagagaggagccactctttctccaattcggtcaccacggctacgattcagcctccgctgtacctcctttctcctccacgagctccacctggcctcctcttcatcagctgctccctcatcaatgtgtccactagcccctgaggagattgtttgcaccaacagcccaaagcccgtcatgtggaacaacggcaagatgagcaatgtcactatgaccggcaacgacagcttgccacttcgacttcaatggtttggcggctggaggaggagcagcgctgtcaagccgtcctgatttgaagggaaatagacaaggatgagagtggctgcctgggggaaaaagaagggagtagttgggccgggctgagggagaggaaatgggccgtctgggagagggaaatgggggctggcccaaggaaggagagaggggataagaggataggggttgtgttttttttcttgggaattcgaaggagatttgaattggaattggaatttgaatttgaatttttgtaaatggactgtaaaagggactgtgaactttgatattatgggagtttatttgtggacttggaataagaggtttgagatctttaatggcataggcaaaaatccgaataagaaccaaattttgaaaataattttgtatttaaaataggttttaaacgaaacggaaaaatcgggatgttacagaaactaaggtctcctatacgggtaggcatctccgcctctccggtgagcacctatggttgtggtgtgccacgggaagtttgtcaagactttcgatttcacctccgcaaggggaaaaaagatcaagagtgaaatcgatgagtgtattggtacaacctcatgagaaaaagggttgaaagagactcaatttttgtggccacttaacggaggcttggatcgttcaatggattttatgttggaagttttaatttgaattaaaagttctcaccattttaatatgttatgagatgtgataataagaacgccatttaatttaaccccccccctctcctcgcgtaggaggcatcacggttctttcattagggtggtcaaaaaggcttaaggggattcagctactgtcagcactcatcagaattcacaacatcatgcatgtttctacctagtttagcata

SEQ ID NO: 55825 - DNA, 224 bp, Oryza sativa
ctccctcttctctctatgtgcggccagagtagaggggtgccagtagccggcgggcggagcagccatctcttcgcctctacccgcctcgccccagtagacggcggggggaaggagcagcgcgcggaggtgggggagaagaggagcacgcgacgacggctggggagaagagcgggggagaagaggagcggcgttggatcgtgggcagagcagcggggcggagtgga

SEQ ID NO: 55826 - DNA, 206 bp, Oryza sativa
gtgctttaagcaatgttaacgataaagtatataatgttaatgttttcagtacaagcatataatgttaatgtctatatacagggagacaaggacgtttggaataaaagacaaattggctatgtctacatattgggcacatctttagccgtgttattctttctccggcctctgttgcccgctggttatggtatatggatgcttgcagc

SEQ ID NO: 55827 - DNA, 1278 bp, Oryza sativa
atggtgaatactatctaattattaagaagcactcgtagcatcacatgaaactgaacatattaatacagaagcaaacatatactgtggtaaacagtaaatatagcatacatattaataaaggcatacagcaacacagaataatttgcctatcagtgtgtcaccattttttttaaaaaaaataatagaattttagtttgtcaaagaagttatttccctattgtcttatagctactttacttatatgaacatgacaacacattatcactttactgcatgattcattcacaattgtatataataagaacatcttttgcaactcaggagtgtagcagaaggagtagcttatatcgatgtgataactaaaacacatgatcaatcaatagtagaatataaaaagaaaaacatctctccaagttcaaattcaaggtaaacacactgtgcgtgtactgaaaataagctgctacactgaatgttatcatttagtaagtagtataattccataatggcaagtcaattgcaatcccatatggaacgtttaatactattatcttgattgctgcaggtgatatggtaccacagtgtaacagatagatttgattgttcatcagaaatggagttttacatatagctgctatgttatccattatacacaatggaaacctgtagaaaaatcttacttaacccatttgttacccctcaacaacaatttcttagcaaaataacaaattataattatttaaggcaaaaccacagcaaagtgcagaatagcatgtgtaaacaggtgatagttcattttaagttagattagaacctgaaaaatttggtgcatggcttcaatttgcttcctacacccacttgagacgactccgatgctgttacaccaaatttattatttccgccggttaatagcgttgatttttactaaaacatggcatgtatataaacaacatgtacacattaatcatttcaaaatccactgagcattaccttctcagaaagaaaaaaaaaaggtaaatggtacaatacaataatgtccagtatccagagcttaatgagtttcactttcaaattaacgccttgagaaatcggacatctctttcaactcactcaagaaaattcgacgagcagctagatccgttcacatatttagcaggtccactaggtcaccaatcgcgtttctagatctctttgcgaaatattgccaaaaataaattttaaaaaaatagtggcgagccttccgtcatcatctccaaacgaacaaaacaagaaaaaaaaaca

SEQ ID NO: 55828 - DNA, 255 bp, Oryza sativa
cttagctgtatctaattagttctaatatttcttgtccttgcttccaaattcatggtatctatggttgtgggtttcttttttgtccttgtggccttgtgggtaccttgctgatacatcatacatacctaatgcttctatatgtacagtactattttccatttcttgggtgaaatgttggaatgtttcttgaaaacaagtaatcaatcatgatcaagtccagagttaagtagactagtaattacatttttttgcaga

SEQ ID NO: 55829 - DNA, 235 bp, Oryza sativa
attcctgcagcccttgggtttcagagtttttccagattctcagaagctggctaccaaacagctgcttctcagaatttaaagttccccaaacaggccctaagagagtatgggcggctccttcatgtcagcttcgtctcatagattgatagagtagctttcatgtacaattatgttactagtaatttcgctgttattataagacgagacgagacgacttggaaaagaggagccagca

SEQ ID NO: 55830 - DNA, 860 bp, Oryza sativa
tggcaaaaggagattggggactgttgtgacttgtgagtctagtttccaatatgttccttcttattaacgttatgcgtttacttggttgaggacccaatgattgaggatactagctgatgaccccgctctataacaagtatttttttttctgcaaagctttatatttggtaccacattattgtgtgtattgggttaactgcattttatctcacttctcacaaggaattaaatgcttttgccttttatttcacatcctctctcccattcttttctattggcatcatttttcccattatatacttatgttgcaaaatggtatcatcgaaatggaaggttatgatgattcatataggaaaaatcataaagtgactggtaaatggtttctcatcagtttgcgcttcgcattctatagtagtgtgaactcacttctgctttgccatgtttgaattatattgaacagatacagcttatttctatattccagagttgaaattttgcaatcatcacagcatacaaagttgcatgtagttccattcagtcgctatatttttattcatgtgctatataatgtaaaaaggatatccttatgcatttgatcttcctaataaattttatatttgctcaccctctttcaagattatctcaaagtactcattactatcatggattcatggtatctattgtaggattcattcctagatatcaggtgggctcaagtaaagttgacacaagtgaaagatactttgatgagtggcaaaagaagctgcccaatacagatgaaatccgcaagagcaagcctagatcaagatatttcacaatatctggggtggaactatccccagataatatggcagttgcaa

SEQ ID NO: 55831 - DNA, 176 bp, Oryza sativa
atgttttggtaaagatgagcctatgacaagtggaacacaaccgaaaagtgtggcatgacaaacatatcgcaacaaaacaaacactagactaggttggtcaaagttgcttgccaaagttatgataatgactgtaatagagagttgtcaggagttcaactgcttgaattctaagagag

SEQ ID NO: 55832 - DNA, 198 bp, Oryza sativa
ttcctgcagcccccataatcattaaagactgtattttcctatcctcattggatggatttgaaaatctgattgctctcagaaagttagtggtagcagattgtaaaaatttctgtttcttgccagctgatctgaatgcattaatatctctcaaaacattagccatttatgggtgccctaagatgaaatttctcccccaga

SEQ ID NO: 55833 - DNA, 1191 bp, Oryza sativa
tcactagattgggcccgtaattgtgggattgtagccaagctgtttattcccagtcaaaatgaacatggggatttaggagagggattaggaacatgcaagggattcaaacccccaaagggattgagtgatatgggagggattcactcaatccctccctggataggttccccttggggattggaacccaaggaaccgaataaggccttagggaggtgcctggttctcccatcaatcgaggagggcaagttggatgaacgagacagtaccgagtcctcttctgttaaagtgatattgttttcaaacatccatatttatagctatatataaaaaaataaattttctaatttttgttagtgttgaattgaagtcatcactaaatagttaaattctacaaattgaaagaaaaatccgaataaatgttatcgtgaccgttttcattctcatgatgtcatgcatagatatttggatcacacattttcttcccttgcaatgcacatgcactttgctagtatgttgtaaaagttaaaacatgtcatattggttttgataaatttaattagtttttatgtaaacttgagcatacttattcacattattttttttaattcttcttattgtaaacaatattttataagatcctaaggatcgtggagtcgggatactatcatatttcgtaggattctgtgaaaataaatagtaaaatcaacatactatgaaaatttggatactataaatcgaatcggtatcatttcggtttgtgagttcgtagtaccataagatactataagagcaagtttaatagtataatcaactactagctccaaatcatctatagtcaatttaatagccaattgtacctataaacatacactacacttttataattcctggtctcacatgtcatacacatgttacatcttggagtccgtgctgcagctagctacaaatctatagcccactgctcttctctcttcttttatcttcttaaaatatgtttatagctagcttatagtctactattctacctgctctaactcacggatcgggattcggtatcgtttcggttttgtctacatattaggacaacttcagatttcggcccgggtcatctggcccaaccacgcaccactgccactgcggcagcaacatctcccttcgtattctctcctctctcggcggcggaaggtttgg

SEQ ID NO: 55834 - DNA, 314 bp, Oryza sativa
caactagcaaagaaacgatgaaaaaaaagggaccgaccgggactgccgctaccctctctttagtcccgcttggtgttaactttactcccgattatttcacccggaactaaagattcaactctactcccggttatttcacccggaactataaattctactcttcttccgattatttcactcaggactaaaaatatttagtcccggttaaaaaaccggaactagaggggtttttaaccgagattacaaacggtttctccagcggtatgggacttggatctgtaaaaaccctttctctatagtaagcggcgccgcca

SEQ ID NO: 55835 - DNA, 604 bp, Oryza sativa
tcaagactgtgaggtatgtctaaaatgaagaattttaatcattcatatttccagaactatcatgcaatactaggaaaaactgaactgaaacacacaaatgaaaaccaattcattttttatgacattaaactagatcagtccttcaaaacaagagatgacttacatgtttttgtttgccccgaagcaattataactttagggattagcgagggtgccgaacaatccagaaacaaatgttcacctacgtatgtaatgacaatataaaagaagattatcaggaagaaataaaaacagcaattaactgtttccagagatgataaaagaaacttaaagggatgcatagagaattgaacaagcatggcgcaaacttatgaaagggacaaaactacaatttcttaacttagtttctaaaaaccccatgcataatgttctactactatccaatgaatagaacataaacagaaatgctagctacaacaaatttgtaggttaattaaactgacagcaaatgcaaaatggcaaatggatataaaatcaacagaggtgaagtacatatgatagatgaaacgtagtagcactggtacagtggcactgaagtcaaaga

SEQ ID NO: 55836 - DNA, 1501 bp, Oryza sativa
gagataagataggatccaagggtattttggtcatctcagcaagaataaacattacaaaaatcattaaactgagaagaaatggatcaaatggcattgcaacatgttgcccttgtttgaggttaccacttttgggagtggcatttcagcgaaaccccgttttgacaatggcaaaattccaattttctctgctagatatgagctgttgttatttgacatcctggcatactttcattcactcatatggttccacatgtcatcctcacaagtgtcaattaaagcaattggacaacgaaaaaaatgttaaattatcaaacttttcaccacccccatcaccatgacagcaacaccgacacagtgatcacacttttcgggtgggccggtcagctggtgtgcacggggagggtacagagctcatgctgcacggtgacgacgacgatgtgacggcatttgacctagagaaggtggagaggttccgcgagcgtggcacctgcactatatggtgcacagggtttaccttatcgtttgggtcggggttatcgtcaccccgcggtaacgcgataaccgtgataattgcctaaaatcgcacaaaaatcacatccaaaaattcgaaaaaaaaaactcggcggtttcgtggtttcaccatgataatcgcatggtttaccgcaataaccgcgatattcgcacggttatcgcggggttgtgtagctaaaataagtgtaaaataaatagggaaaaaatcaaaaatacagttgaatatgtgtaaaaaactagaaattaaaaataattggaagaatatgtaggatatttaaggcccaatattctcttccctttttcaatttgtaaactatgttttggtttgctctcaaatttgaatttagcttactctatttcaaaaacattcttcactattggtaattacaaattaagaactacatccatgatttttttttattttttttcgatttttttcagaattttgaatttgatcaaaattcatccaaactatatcgctggtttcccctaccgtaccccatgataagcgcgataaccgcgatagcatcgagccgagcccggcagtccggccggccgacgatgcaccgggtggtgctgtggtgcagctgcttgagagcagcactgccggtgcagaggcgttttgcctcacccatccgactgccacatggactcgtcgccattaattaatcctctgagatgaagtgtctgtgtctgtttaaaccctcctcaaagtacggcaagtcaacatgactactactattttaaagcagttgatttcagggtgagttattaatgcttaatttgagaagggtctaaacagattaacagatgtattttaacaagttgatgagtactagctttttttaggaacaggaaagtgtgcatattactcaaccctgaggggactaacctattgatttttcggcagttaaacttgttaaagaattcttcgacgtgttcctacagatatggagaagaaatgtcaccc

SEQ ID NO: 55837 - DNA, 1501 bp, Oryza sativa
cggccatctactactaatctttctttctttcttgtactcctcttcctcctcctcgcccaaccccccaacccccaacttctccaacccaaatgaaagaaaatgggaagcgtggggagacgaagccccttattctctaggtggtcccctgatccgatcgctcccccttggcccaccaggaacctttcaaacaaaaaatgataccccaacttcatcattttttcaatattttttgtaaaccaagtttattctgcccctactctattattaataagacttaataatatttaaaatatataacccctccatcctaacatataattatttataatgtttaggtttttgtttcataatctcccacttatccctcgtcttaaccaatcgtcttaaccaatcataaccaccaaaactttatgtgtaacatcgtgtacacctactaacaaatatcatctaaaactctagaaaaaaatgtatataaactttcaatagtattacatttatgtataaaatcttgaccttaattttaaaatattttagccgtaacaaaaaaagataaaatttctaatagttttaggagtataaatctgagattttttattttactcctaacccctatctctactattataaaaattgaagatgtttttgccagtattttggtatgtcatccatatttgagttggtttttaagtttattcgtctttggaaataattgatgattttgacaccaaatattttatatttttcacatgaatttgacatctgttttgacattcacatgtttaatgtaaaaaagaaaaggatcgagcacaaggttgacataaacttaaatactattaagtcttatttttttaaggaagccatttggcgcgctttattaatctacaaacataattacatcgttcactagaacgttcagcaagaaaattagggcttcgtcaacccaattacaggaattcttaaacttaaaagcatgattaagtcttgttaacagaacagaggcaaaatacaagttttacttgaaaatgtggaggtaaaataacaattaaagttaaggaaaaagtacgaattacccccacccctgaactatcgaggtcgaccaaattacacccctgaacttaaaaactagtcattctacaccatcaactattgaaaccggacaaataaccccctactcaatccggggtggttttgggtccacgtggcagtccaataagtattttttttaaaaaaatcagtgggccccacttgtcagttctccacccctctctatctctctctagtctatcccaatctctccctctctctctctcttctcaccagcatggcggcggccgcgcgagggcgggagtaggcggcgctgccggcggtggagggcgccgggcggctgagacggaggcggagcaagcggccagcagcgggaggcagagctcgcccgcgtaggttgccgtgcaggttgaggcggctgaggagcgtcgtcgtggtgtgctgctgccttgtcgtc

SEQ ID NO: 55838 - DNA, 614 bp, Oryza sativa
tttttttggcaacaaagtgaacagtcccaaacacattcttgccattgctaccataccaaatttagaaaatccggaatctaaactctattgatatccgtaagactttaaactaaacgtgtttaatagtactaaaaaattgttatatttttagactaaagtagtagttaattatgaaacgtttagaaaatatatttataagagtggattgtatgtacatggaggcatatagagacaggtatttggtactagtggtactagtggcataaagagaagttatgtttggatgaggtgatgaaggggttgggttgccggcgagcgacgaaagaaagaaagaagcagcagcagcgggtctcgtctggtctggtagtaactaggagtagtagacgggcaccggcggcagcagagtcaccttcctttcatttcctttctcttttctctttctttctctctctttcttggtgttggaaggcgaaggcaacccagggggggaagcaccggaggagccgcagatcccgccatgcgggtgctcccggcgtcgtggtcctccgccgcctcctcctccgcctccgcctccgcggaccgcctcaactcccccaccccggcgccgccgccgc

SEQ ID NO: 55839 - DNA, 332 bp, Oryza sativa
gaatgacaagattaggtgcactgcattcccagctttgtgtatggttgctttggatagatccctctctgttaatcaaatgtgctctattcctcttgaggattgctttttgctgcctctgaacacccaagcctatggagaattcatcattctagaggaggaattgtcctctctctctttgcagaatgacaagggtgatgattggtctttcatctggaactctgacaagtacacaaccaagaggttttataagctcactttctcaaatgtgcaagtgccaagaccttttgtttggatctggaaaacaagatgtgtaatgaagatacaagtttttg

SEQ ID NO: 55840 - DNA, 245 bp, Oryza sativa
ccgccgccttttacgccgccctccccaccgccgcctcgacctttttgccgccctttccaccaccgccgcctcactcactctctcgaccgccgccgtccatctccatcgacctctccgccgccatctccgccgccctctctaccgccatctccgccctctacgccgtcctccccaccgccacctcgacctctccaccgctgccgcctcactcactctctcgacggccgccgggacctcctctcagt

SEQ ID NO: 55841 - DNA, 330 bp, Oryza sativa
aaaatggttttttttaactgtcaacgtttttttatggctaggaaattgctttcactgaaaatgaactttttgacatctgggagcaatgcttcacgaaaactgctcttttcgtggaaggaatgatattccagaagtgaatatttatccctcaagggaacatccctgttccctccttttatgtatgtcacctaaaaattataaaaaaaattgtatgacagatatgatagaataatatgaaatatgtttttccacaaacataaaattcaaattcaatataacaagtgaaaaaaataacaaatattactgcgaatagtacacagtattcacagt

SEQ ID NO: 55842 - DNA, 1501 bp, Oryza sativa
agatcatttttatgaaaaatacgcagaatacccttaaagacatcgaagttagcattaatttataggtttaatttatagttgtctttatttcttgttgattacaggatcaaatcaactggtacgctagcatacccgaagacgatttttggacctgcactggaattaagcagatctctcaggcctcgtgtttttcatcaatatttaaataagatataaaattgtctatatagcatccttacacaatatgaaagtttgcatatagattttcaagttattggggcatttttatttttttaaaagaaataattttatgtgataactgatagagaaattgcttacgtaaaatataatagcataaaattatgttgggtaggatatgaaatatgatttatattaaaaacaaagacaaaatattttatatagcataaatggataaattataatattttataaaaaatgaaatacaaaaatctttaaacttatacacaaactttcacattgtgtatagaggctaaaaaaattcataattttttttaaaaacttttaataggataaatcaatagttaatcttacatgtaaggccaacctaatgatatactcccttcatattagtaaagaaagtcgttgagtacaatgtttaagttaaatcttgagaatataagtgatgaataactctcaagttgttgagtttgaaaatgtaaaattatatgaatagatttgtcttgaaaaatactttcataaaagaatatatatatatatatatatatatatatatatatatatatatatatatatatatatatatatatatatatatataacttttcaataaatatttttatggaaacaagaactcaaagttgtgttttggagaccgtgctgctgtctaaaatgacttcatttacgagtacggagggagtattaatgccaattataaatcattaaactatgataaactcaatattatagagtatattctctataccgtgtcatctcgatggtaaaaaacagttgctctctccggtcatccggtcacacactcgagtcactctcactcaccacagttcttttttcttccaaccaaaaatcactctcaagttctgagtagtgatttttgccgtctaggtttgaagctaaaacttccgttaccaaaatgccggcattttgaatagtattttggctatgtttggtttcctacagcaacaagtaaatattactatcaaaatatcgataatgtcaaaagacagggtaaaaaccaaccttcgttttggtgaggtgacaagataagcagaactctcaagtctcacaatcgctctgactgcaagctggggatcttggagcttgcagaaacacggatcagcgagaggtgctactgcttttgcaaaatcacaagttgccgagggtgcaatagcaaaagaaggcaacctttgctaattgcttcgctactcgtccttaaaagggaagccgccgcgtctgcagctgctgcaaatcccaataaagc

SEQ ID NO: 55843 - DNA, 1501 bp, Oryza sativa
caacattcttttataaccctgaaagaaacctttttactaaccttttttacaaattaaaacaaaatggacctgccaacaacaggacacacattggaagttcagttcgaagagtcacaatctatctgaagaaagagaaagggaagaacaagtttcagcagtgaatcttcactcctgtttcctacttctaacttgaacttcacttcccactatgccggatctgcacaatactacaccatctgcccaccattcatccttgcaaactacattcaccatctccatgatgaatccatccaaagaaaaatgcagaaaaagggcatatgttcttgatcctaccaactgacaaagattcagaagcttaatctgttaaaaaacacacacacagattgcacataccatcattcagcgggtgccccagggactccttgatgtaggtcgccgagcccatcctccactcctcatacccgccattgccaagccttatgcagccactcaagctcactccagaaagcagcagcagaagcaagaacagcagcactgagctcatcacacacacacacgccctggctctactctctgatgatcaatgcctctcttggagggaagaaaaatgtctgtgatggattggaggagagttcttggtgctgttctttttggtattcttgtgttcttggtctgaactcactgtgaactgtgaagtctgaaatgttgcagtgttttggcctgtggtgggagactggaatcgtgggtagtcaaagatgagaggagcacaggcacaacacagggggagagtggtggaaggggtccttcctttctgctctcgctttattgggatttgcagcagctgcagacgcggcggcttcccttttaaggacgagtagcgaagcaattagcaaaggttgccttcttttgctattgcaccctcggcaacttgtgattttgcaaaagcagtagcacctctcgctgatccgtgtttctgcaagctccaagatccccagcttgcagtcagagcgattgtgagacttgagagttctgcttatcttgtcacctcaccaaaacgaaggttggtttttaccctgtcttttgacattatcgatattttgatagtaatatttacttgttgctgtaggaaaccaaacatagccaaaatactattcaaaatgccggcattttggtaacggaagttttagcttcaaacctagacggcaaaaatcactactcagaacttgagagtgatttttggttggaagaaaaaagaactgtggtgagtgagagtgactcgagtgtgtgaccggatgaccggagagagcaactgttttttaccatcgagatgacacggtatagagaatatactctataatattgagtttatcatagtttaatgatttataattggcattaatactccctccgtactcgtaaatgaagtcattttagacagcagcacggtctccaaaacacaactttgagttcttgtttccataaaaatatttattgaaaagtt

SEQ ID NO: 55844 - DNA, 1501 bp, Oryza sativa
aagccaccacctaccacaaaaaaatatatccttcaggcaaaaattcacacagtatgtattctaccaaaaaggataattctaacaacaatataaaagaagcaagcatcattcataattgatgtgaataaatgttaacatattggcattactaccatttttaagttataaaaaaaggctggacaggtttgccacttcatcacatgttaaagtgaggtactaggaccctatccacatctatcaacactgttgatcagttaaaagtacaaaactagagctgttaatataaacttaggagtataggtgatagagtttccacagattttgcaatatgtgaagtttcaggggtacaagtggacttggtgcagtttcctcttaattttgcagtggaacctggtctacagaaaggatatggccaattggccatcctttatggcaacgcatctcatataatcataccttgattttcatgtggcggctcattcaaatcaagtgtttcatccgccatctccttctcttcaccccctatgaacagcaacaaccatcaaatgataactatattttctaaaagcaaaagatcatcatgcatgtaaactgaaactgaaaccaagcatgagtattaactaagcaggtcaattgtcattctggagtaacatatgaccattaaacaagccagtagatccagaaatgtggtatagtagactcacagtatcgtacatcattaattgttcaaactagaggaagcaaacttatcaaatcccaagttacatgactattcatctataagttattaaataatgccaaaagaaaaaaaaatcagctgggcaaacaggccaatccgaccaaaactcatcacaaaggtcaaacacgacaagaatttgctggtgaataatatatcccagaatgctaaatacatgccagataacatgcttaaaactatccagatgaatcgaactaagcaatgctacaaattataaaaacatcagattcagccctacataactacataagtcaggtacaagcaagcagcaacgaggctcaactctccagtatattaaaatgttaaatgcagctccaaggcttcaatgaaggccatgactcatcaaatgccctccttacagcctcgcataactcaacatattaatgtgattccactatagaagaaagaaagcaacaaaaagtacttgagatcacggtccaaagtggtgatttatgtcacttaacacctccaatcataaatatttggcatttaggacaagatttgattaaacttttaaaacattcaccattagaataagcttatgatgctatgatagaacttttcaaggcaaatctacacaaaactaagcatttgagaagttactcatggtcaaagtttcaaaagtttaaccaaatcttgtccgaaacattaagcatttattgcaggagtgaatactttggttacacaccgagctcggtaaaagacaccaccttcaacccccacaaaaatcccaaaagactccgt

SEQ ID NO: 55845 - DNA, 1417 bp, Oryza sativa
taggtcaccacatatggtgggttaggtgtccgcctccaggtgcccacttacccacatttatggcgtcctgagcggtcgcgccacgccgcatttaatgcggtgtgcagtgcactcaaccggtctgtgaccggtcgaatgactgatgggacccaagatgtcaggcgcaccatcgcgtgtgtcaggcgatgtgcagcccgacatatcccatcaaataatgatggtgagaggttctcatcctcttatcccagccggagtcggtcctcccgctctggtcaaagcaaggctcccgtttcccggtgtaataagagcccagaagtcttcacccattaaatggtgactgacaggggcaccccccgtgtcaggcgacaagatttgacaggccccatcatcaagacgacgtgtgcttggcttcccaagtcaagagacaagacatgcatttaatgcaaagattataatacttctccaccggagctaggttaggttgttgggcccatgtggtaacccctttaggtataaaaggaggttcaggcctagtggtggaggggggacttccgagcgaactggcgcttgggtctcgcaagcccaagcaccggtgttctacattcaatcaatcatgcacaggagtaaggtattacgcttcatagtggcccgaacctgtataaacctcttttgtctcatcgtcttggaggggcctaaccccctcaagatcacacagctccgctcactaagccctcgaatctcacccgctgcccccagccgaactcacaaaggggggcctcatggttccctggtggaggagttcattctccgacaactgtcatcatccctcaacctaaagcatactaccttcctcaccggcgtagctcgacctctcccttcctctccttttccgacctagacatcgagcttggttaagggagagctatgtgacaaaggaggtgtcatcggctcgagctcacccaaggccaagatctccactgaaagccatgactgcaactcccattcgccacaatgccatgcttgactacgggtggtggagtcctctatgtcccttcattccccattaattcctgtgatccctcctcctatacagcacaaccactgccgagttcaagcccctcgcgcgagtggctacggcaagctcccccttcctcaatgctcagggaggcgatgcattgaggttgtcttgatggagaggtattagtcagggatgagatcgatgcgtgccgtttctcaccatggagatggtatctcttccctctctcgccactgccatcaccgaatagcagctcaagcttttgaactcaccacttgccacttcctcgcttttgtatataccgagttgacgaggtctcaatgaggaatagatgaagaggttaggttaatggttggtgaaactccgacaaggatgcagtgg

SEQ ID NO: 55846 - DNA, 507 bp, Oryza sativa
ttaattatgtgccaaagataaccatgctagggctcttttaccatgtgactatttgtgaccgtttttagactcattgacaatttgacacatggcagagtaaatcaaccacctatttttatatttaatttaacaaattaggttcacatttattttagaacaactaggttcatattacctttatggaattaagatgcctgcactacatcagcacgataatatttggttttactattgcgtttcacagaattaaaatgacttccaagtttatacacacccccagctggtttatgagccactgtttagtattgtaacagagcaatatttctgcagtcgtaaattgaaatctttgattaaattagctaacaagtgtgcggacatcaacagctgaacagatttcagattgttcaaaggtgacctgcagtctattttacaaacaacactgacctgacaagtgacaatcaccctcatgtacaaaaaaaggaaaagaaaaagaaaacgacggcgcaa

SEQ ID NO: 55847 - DNA, 320 bp, Oryza sativa
aagatgacgactcgatgaggcataggtggggaggagcacgtggacataatgagaataatcctacaatgatacaggttttagtgtagatgctacttaacaattcttattcacgggaaccgaaagattcaattcgtactttgtagggctggtgttgctgctgtctgcgtaggctactagtcttttatgtaccagtatctcaccgacgaaaaatgagagataacatactttttttctaacttttttttttctaaaacaagactatagtttaaattcaattgatttttaattagcaagtgcatatattgttatgtccatgcagc

SEQ ID NO: 55848 - DNA, 209 bp, Oryza sativa
taacggaaatctagaaggttgtagtttggatcttaaggctaatgccctgtttagatgagattaactaattttagtctagtccctcccatccaatgatccaaacagcccctaaacttgaaccaaattcaaatctcacacagcctgccccacatcacacatcacagtggcgcaattcaaaacaaccaaccccgggtcccacatgtcacaga

SEQ ID NO: 55849 - DNA, 520 bp, Oryza sativa
ctgctagggtagttagaatgatagctctacatactactagtatgatcttattaggtcgtgatttagattattatactatgaattattaatatattataggtataaatgaaatattgtaagaaataaactttatagatagtttataacaagtaatttaagaaatgaggtagatttttttaaaatgtacatatcgaagtgtggagtaaataatccattttaacaattcgatgttacagttgaaaagaacacggccttaattctcgcactacaatttttaaccattatttttgggactataataatatgttgaacttctcataaataaatgcccaacaaatatagtagaagaagccacaaataatatctggtgatatagtagtgaagtcatggatacataactttaaatttatagtattttactaaggctaagatatgccgtttggtctatactccaccgtttaaaaaaaacgaatctaataccggatgtgacgcattataatactatgaatctggacagtga

SEQ ID NO: 55850 - DNA, 373 bp, Oryza sativa
ttggccatccattccacacgaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagcctatatagcctcgccacgtgggattgttctttttgtttctttttcttttttttttaccgttgcagt

SEQ ID NO: 55851 - DNA, 351 bp, Oryza sativa
aacggagggagtagctagttgggacttgggagaacttcaaaacatatgctaaccattatcgtttcaaaagaaaatcctttatttttgaaaattacatggagggaacgggtacacagatacaactaaattgtatatagtggtcactactcattagattaaattgcaccagtaaatcgagcactgaaagaaatataagtgtgaatgcatttatattaattctactgatagatctgctcatcttgttgaaaataaattagtgtttttgttcatgcagcgtgcaccaaactgaccattttcctttttacttttgaaaatgcaaaaacaataaacatgttgcaggttctgctgcca

SEQ ID NO: 55852 - DNA, 1501 bp, Oryza sativa
tgcgtgataacaaaatagttatgagtttctcttttttctaaaagaaaaatgacaaaagatcaatatatgcgaggcagaagcttggtgggccggcctcaagcgcagtggatgttctcatcgtctttatgttaactagcatggtggcccgcgcagattgcgcggctagcatcattatattttctctcatataatagtatatatgttttctcattatattattcaaatatattgaaatgacaacataattttaaattttgcaataactttacaaaaactactaatgtgtaatattcatattatattttatatatgtgttagttattaattatttttaatatcaaattttagttagttgtaaattatatatattcctatatagactctagactcgtcttttaatatttctttttttttaattccgaattttctgtaaattgtatttctatataaactctatactcttctttcaatattatttattttatttctgaatttttattatttctaattgtatttctatgtggaatctaaactcatctttcaatattctttaatttttaattttgaattttagttacttctaaattgtattcctatatttgtattcctatattgactttaaactcttcttcccatgtttttcttaatttcaaattttagttacttgtaaattatatttttatacggactctaaactctacttttaattttattatgtttattccaaattttagttagttttaaattcctatatgaactctatactctacttctaatatttcttatttttaattacaaatttatattatttcctaattgtatttctatatgaactctatactctacttctaatatttcttatttttaattacaaatttatattatttcctaattgcatttctatatggactctatactctacttctaatatttcttatttttaattctgaatttcaggtatttcctaattgtatttctatatgaactctagtctcatcttttaatattccttttttttaattcagaatttcagttatttcctaattgtatttctatatggactctagtctcctcttctaatattctttattttttaattccgaatttcaactatttcctaattgtatttctatattgactctagtctcctcttctaatattttttattttttaattccgaatttcagttatttcctaattgtatttctatatggattctgctttttctttttctccgattaatgtgagaatttctaggccatgcgaacgaacgtggaagctcatttttctatttctttaataatataatagattcttatccgaccgagatgctgctgtgtggagaggatacgtcggtggttggccatggccttcttcgtcaagatttcggcgccgtgctcgcttgccggccatggcaccaccagcagtagcagtggcagcagcaggtcaaagaggggattgttgcttccagttggggctggggctggggctggggcctacg

SEQ ID NO: 55853 - DNA, 313 bp, Oryza sativa
tttggacaaaattggcgtttcctgaagctggaaagggaaaactaagtttcttttaaataagaatacagaagtaatttttattgtttcaatgaaggcaaaagtaatctcactataagctgttataggatggagtagtataaatttgataggctgaatttctttcctcttggcacctatctataattcaatcaaactatttattttgcttattcatctatttttgtaccaatattcaaccaactgctatggtagttttatttctttagttgatgaacattggggatctgaatatcttaccctgttgccttcaagc

SEQ ID NO: 55854 - DNA, 485 bp, Oryza sativa
gcggccgaaaaccactagtggatcccccaaattttagtacatatatattgtccaaatcaatgtagcccatttctcccttttagcttgtcataaatattgtttacagttgtttttttaaaaattttgtggaacaaattgttgaatcgatcacaccgtgacatgaaactataagtataaagaatcatttctttttttagcttattcagatgctaaaacaaaatgtaagtcacattaactaatcatatcttctggacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcagttcggaatacatccaaaatgcagaaatagataaggcagcggaattcaggcgcagcggca

SEQ ID NO: 55855 - DNA, 381 bp, Oryza sativa
actttccttttcgtaatttcttgttgctacttgttctctactctatacttttcatattagaagtcgttcaagttttttcttagtcaaagttatctaggcatgatcaaatttataaaaaaaattagcaatatttataacatcaaattagtttcattagatttaacattgagtatattttgataatatgtttgttttgtattgaaaacgttactaaatatttctacaaacttgtcaaactaaaagaagtttgattaaaaaaagtcaaacgacttatgtagtatgaaacggagggattactattcacaagtcacacctctcgttgctaagaaacaaacgatagtatacaataattgataatgtagtgcttattttatttctagt

SEQ ID NO: 55856 - DNA, 348 bp, Oryza sativa
tgcagagcaaaccggcggccactagaaaactaatggcggaaacccattaatcaaaatcaaatggcgcatgagtctcctcctcctcctatgctaggagtacatttctactagcgtaggacaacaagatagacagagtatacttctaataggagtaggagtaggagtattaaaacaaaaatcgatcttccgtcctcctagtttagttgtctctcctcttggctctgctttaatttgtctctcctcttgcccctctttgatccgcttggcactctctcctcctgctgctgtagaatcgagatcgagagagagagagagattgaaaaggcagccagggatcttgtgaattaa

SEQ ID NO: 55857 - DNA, 538 bp, Oryza sativa
gcttctttctgatcataataatggaaagcttctttgtgacagtaatctacctgggagactgacttaaaaatgcaactgtagcagaatacaaaaccagaagcagaaagaacagaagggttattgcgcttctggcagcataaggggcacaatgtcctgtcagggggcaagggaagtccatctttagcaacctgatgaaagaagtagacgctcaaatcaaacagtagtcatataaagaactattaaaccacaaaatatatccaactgcacagtggcaaaacaaagagttctgttcaccatgttactgcaaattgagatttcagacaagggtaactgctttctgcatatattgactagcatataacatgtacctttggcagaggtggaggagggggtgggggatatacagtcggagctgacattctttcctcagcagattgataccaccattccatcatctagataagatcacgagatagagaacattaagcgaagcacgatgggggatcatgttttttcatcatattacatccattgtagg

SEQ ID NO: 55858 - DNA, 305 bp, Oryza sativa
tacagggcggcctgctaaacatgggccattacgaacacatagggtcgtcaattttcagggagaagttgccgttgttcttctagcctatttttatatgccatttagagcatttttctgattaagatacatattttatctcttttttaagcacggtttgttggttctgcaagcctgtgtgactggctggttttgctttgttggttctgcagattgttattttggatcactaaagtttaatcccaaacagaaaaagagtagttggcacagccttgctgggagatcatcttagttttgcattgccaaaa

SEQ ID NO: 55859 - DNA, 653 bp, Oryza sativa
atcaagaaaaatgtgtagaatccattaaaaatggttttgttcctcgtttcagtagtcttatagcctgtttgcaatgtttgccttgtatgtcgctagattccggttcatacgacgctccggtgtacttcaaaatagtcaccgaggttcctccagcagcagagcaaggcaagtcatgcttgtcacttgaacatgttgatcctatattgcaaatgctctattgtttttcttcaaatattgcattgttttataatgttactatgggatgtttacctattgtcatagccatgctattgttgtaccatgtccctttgtcagcttggggttataacatgactaaagattggactagggattgcttagccatgcttagttcaactagtgcacaatggggaaaattctattaatgtttagactgctggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagctagcgtgggcaacggctggacttgtagtgtagctttcctctagctgacgcatccaggcaagggtgggcgtgac

SEQ ID NO: 55860 - DNA, 1104 bp, Oryza sativa
atatttttggacaacgttttttaatgtgatattataaaagtctttgtcgagcgctataatagggaagctaattttctagcaaatatacttaaacatacgtctattttaaagtgttcttgattaggttgatgagcctcataattttttttgctaaacattctagctaacgatgtaactgtattttcatacaataaaacgcgccaagtggctttcctaaggaatatgaaaaagtactaccaaaaataggagtacaacagcaaagcttccaacaccgtccgattctcatagcgaagatcagaagcagcataaagccactatctcccaagcgagatttttctttaccagaagcggttaaaaaaatgcagaaacagtaaaaaaaaagaagggaaaaaaaacaataaaccggagcgggtgaaacaaacccgcttcagttcaaagcgttccccctgttcatttcgacctctctcttcctctcccgtcgtcgtctcccccgtctccggctagggtttcggccgctcgccgccctcgcctccgcctccgcctccgccgccgccgctcgccagggggagcccttctcacctcaccgctcccgtctctctctccccgtcgaccccgacgggctacggctctacaccctccccgcctcggctcgtgtctgttcgcccgcggggacgctgtttccggcgggcggaggcgcggccgcggcgtcgcggctcctcctcggaggcacggtgcgggcgacggccctcctcctctccttccccgaccctctctctctatctcactctctctgccctagccttctacgctgtgtggaggcgtcgtcgcgcgcgcgcgcccggacggcgagcatctggatttgagcctaattgaaggtattttgttcatcctcctatgcgatatgggcttggatttatttgtttctctctaattaacacttccaattcgttcgatttgcttaattttgttgcatgcgtggtgtggtgctaatggcagtttgtttgtttccaaaaataattttggggtacagctgaacccccatggcccagtttaggtctgcgcctgtggaaagcgaggcggagccaggcgccgatggccctgtgg

SEQ ID NO: 55861 - DNA, 1501 bp, Oryza sativa; identical to SEQ ID NO: 20174

SEQ ID NO: 55862 - DNA, 1501 bp, Oryza sativa; identical to SEQ ID NO: 16675

SEQ ID NO: 55863 - DNA, 1501 bp, Oryza sativa
gtcgtctcgcggcgccgcctccgtcgtcggcatcgcagcggcgtgttccacgtcgtcctcgtctccgtgcagccaccgccggctgccctcgtcgcctcctcgccggctccggtcgtcgtcgtcgtcgtcctctcgtcgttcccggttccgatcgtcgtggcgttcgtccctccgtcaagccgttctcgttcgtcgtcctcgcttcgtcaagtgcagcagccccatcatcgtcttcgtcctcgcctccgcgtcgtcaagcctcgtgccggccgcgtctcgccttcgtcctaggatcgccgccgaagtcgtcccctcgccgttcgtctccgtggttcccggccgcctccgccgcgcccgttcgtcgttgtcgttcccacgcctcgtcgcgtggtggtaaggatccctctcccgctgccccgtcctcgtcctttcggtgtcgcccgtgctcgttgtgcggttgtcggccccggtacccgtgtaccggtgttggtagtcgttcgcttgtgcgtgtggtgaccgtgttagcgtgcccgctcggtagccgcgtggtttccacgtgtgcaggccgtgtggtgtctagtggagtccgtttgtcggccactcgcctcggttgacacacggggtccgcttccgtcgacccgtggaccgtctctgtgtacctggtctaccgcggtcctttaggttgacatgtggggtccgcatgtcaacggcgcagccttcctgtcttttccaggctagcgcttacacacgttttatagttgcaaagcttaattataataatccgcaaatctccatataacagcattaaacctcggatgatcatatcttggtcatacgaaccctgaatcgacccgttcaagtctcctaatgttggttataacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattactaccttgttcaccctagattaaacaaaacctcaactagtggacactctactcgtggtatccctagtttaaatttaggtagatgattcgctgattaattaggcaacattaggtggttttataactttagactttgggaattctcatatcatttggacactatggaattgttgggttatggtggaattggacatacacctctcttcctctttcaaaacccctaaaacctgttttcggtggggtttgggtgcatgccagttgtgggaagtagcaccccggccactataaggattaa

SEQ ID NO: 55864 - DNA, 1501 bp, Oryza sativa
agatcaacggcaaaccggcgaagcagggtggcagagatgggagctccgcgatggcaacatctctctcatgttttctgcttcgctggacgtctttctacttttctctaacaaggccaccaaatcctaacaggaggacgagggactcactatgaacaacatctgcttacgtggaagggaatctcgaaagtggcgtatttagaccaaacgccacctcactgcaaggattgagatcctctaacttgtgtcactgacatatggaccctctaccagcggatccacatattagtgacctgtaagtagaggatctgtactatgaatggcctaattatcattgcattgtggatgacgcttaggacctgctcccttttagcattagcggtaaaccagtaccccttcatttcatattataagtttatggaaaaatatagcagtattttcaacacaaaacaaacatattatcaaaatatatttaatgtaagatttaattaaaccaatttaatattttatatgttgttaaatttttctacaaatttaatcaaatttaacaaagtttgacttaaaaaagtcaaataatttataatattagtactaacttttaggggcaattgcgcatttgaccctcttttgaaagctaactactaatttgatcctcttttttcaactttgcttatttgacccttctttttaaaattgaagatacggtatgaccctattctgttaaaggcttctaacggtgttaactgaagcacaaaaggtccattttacccttagtcatttgaccctattacatgtgggacccacccgtcagttctctcttctctcttcttcttctgacgtcgcctcctttattcctccgcgttccctccggcgccagctgccgtcgcgccgcccctccctcccttcttcgcgcgccaacctccgcctccctccctgcttcgcgcgccaacctccacctccctccccgctgcacacatcgccgccgccgcaactcactggcaggagagagacatggagagacatgtggatagggttaaagatgggtatggtttcctcaagggtattttgggcattatgaattttaattatatttctttttttttaaatcaaatcttagcgatgtagtgaaacaggtcagacggaaggttcgtttttgaaaattgacagttagacttttccctgacttttagcatcagttcctcgcgagtcgcgagttcagcgcattttttgggggaaaaaaatgtactccaacaacacaccccctccaattctcaatagtcaatttcatcacattaatccccccccccccccccctctcgctctcggcttcttcctctccacatgggttgctctcacgtcactatgcgagctctcctctcccgcatccacccgcccggccccggatcgatctccaccacttccttcctccagtgcccctcctccaccgccgcatccgcctccaaaaccctagccccgaccctcaccttccgccgcttcgccgcca

SEQ ID NO: 55865 - DNA, 1501 bp, Oryza sativa
ctggcacttcccaaccacgaaagtcatcagattatgatccgacgagtagggatgggcagaaaaagaccgaaccaaaagaccgaactgaaaagaccgagaccgagaccgaaaagatcgagaccgagaaattcggtcatcaattcggtcctaggcagtgaaagaccgaattttgttcggtcaattcggttagtatcctcggttaaccgaatatatcgaaaagacagaattatcaaaaaaacgtctaaatgcaacctacaatccactatgtttaataggattaaactctaattttcacatccctacttcttctaggcatgcaacctaacaagagtctttactcataagtgcttacgaaatttttttgtgatttttgtgttgaaactttccattatttctttgcatatatgaaaatgttgttgaatttcggtcaggactgagactgagaccgagaccgaatttgtcggtcctaacatttttgcgctgaaattcggtcttcacttttcaaagaccgaaaagaccgaaagaccgaagaccgagactaaaattttcggttagaccgaatgcccaccctgttgatgggtgatacccgtagaccgaatatagagggtattggggtacgttggtataagggttcacataatacgacatcaagcaaacaaaagacgaagattatactggttcaggccccttgataggtaatagccctaatccagttgatgtgggattatatgatggaaaacacaggttacaaagggaacaatggaactcgatggatccggcgagatcgtagtcgagttggttcgactagatcctcgacgatttggctcctgcaggcttcgacttcgtaggctgtgggggttgtgttggctctaagattcgatgccttatgtcctccccaggggggtcccttttatatcgcaggtcaggcggtttccaagtagaactcggagacatcagaccctacacgatacattgacgacccagtcttgtccgagtaggactcttttcgtccgtaaactccgtgaaggatttccttagtgtatgtagagagtatccgtatgcgcgtgggcatgccataccgatatgtgacgtatatcaaagggtaaagggtatacctaacccgtaaccctgacagtagcccccgacttctgcttaaatgaactcgtgtaaccattcgcgacttctcgtgtcgaggctattgttgttcccggtgcgagaaccgtggagacaggacgtaatcgagaacaccatgtgaagcccaacggtcacgagtgaatttaaactgaagtccaaaatactgccgcgcgtaacggacccagaaatttccggcggctatctctctcctttccttggaattcgcaccgtcggtagtgcgtctatttaaaggaattttgggggatccattttgaagcccgcctattgtgaagaaaacctcccgcctgcaagcgttcttcgtcttccccgctcccacaagaaaccctagttcgtcgacctcagccct

SEQ ID NO: 55866 - DNA, 1501 bp, Oryza sativa
tggaccgaaccagttttttttctctctccaaaaaaccggaccggtttcttttacttggtcaaccaccagtcaaagaaaaacagatcgaccctgttccccttcttcctttggcttcctcgctcctcctagaaaccgtgcccacgccactttttcccgatgcgccgccgcctcctgctcctcacgccgtcggccctgcaagaagcactgcgccgcccgcctcagaaaccgcctggggcgccgccgcctcccgccgccgtcacttgcgccgaccctgcgaggagccgccgcgtcgcctgccttgggaagccgccggcctaccacctaggagcgcccgccaccgaagtccggcgccggttcctcgccgggaaccgccgccgccgccgccgcaagctcctgcccgagctgcgacgaacgccgccgagtaccacgccgccgtgcgccgcctgcaatgatgcgtctccagccgcccgtgacctcgccgcccaaaccacctttgcctctgcgaaaatcgggtacgaatctcgccctctgctagatgatttgtttcgactgcgttgttacaatcccgtggtccctttgctgcttttattggggaaaaacgtgtccgatttccagtctaaatcgaatccgtatccaactccctcctgtgtcgaacgcggtatccatccagcttgtcttcggtcgtgtccatgccgtgaccgacacatagataactccatggccgagtcttcctctacatcacgaatccgacaaccaccgaaccttgcacgtcctggctcagcccgctccttctcggcatcaccctgatctccgccgccagctcggcttcgacgcaaaacgcgcacaccgccgcgaccctgacctcctgggcttcttcgtatctccagcggaacctagcaccactgccaaacaccacttgccgactacaccaatgactagtgccactgatctgttgtcatcgtgattttcttgatctgtgctagaaacagtagaaccagacctctctagggttggaactagcacatatgctagtctagacgccctacgcttagttctgccatccaccgctaatacgccgcttttgaagcaattccagtgtggaaatacctgtcaacacctccaaaacagcctataggatccacccgctccgacatccgattgaacgccatcaatctagtcgcgagccgaagccgacaagtcgcatgccgtcttcccagccgccgaacgacccgagcgctacgtctagccatctccctgtcgaacgcaactcttcgaaaggcccgggccaccccgcccagagtgttcgaatccaccgatcgagaacgccgatcgcctccagcttcaatcaacccgagcgtgcggccgcacgtctccctgtcgagagtagctcaccggaaagtccgagccacccgcccgaagtgtccgacccatcgattggatcgccaatcgcttctgccgccatcaacccgagcaccacgtctagtcatctccttgttgaagg

SEQ ID NO: 55867 - DNA, 1501 bp, Oryza sativa
tcgacgcaaactctaacaaactctaccttggcgaatatgccacaccaacttgaatctgttacttgctcgaacctccgtgtaccaggacttgagttggttctgccgcagctcacaccgagccgctcgactagcctacgccaggcttgccgccttcaggatcgtgcacaacaacaccagcatacccatcttccatgactccacctgcaacagcactcccttgtaacttgtacaaacatgaacttgtcctctcaccagtcataacagtcttgccgtccttcatgatattcatggtcttcctattagaatccacctgatacaaccaacccgtctcatgtaggctcccaagcgaaatcaaactcttccttagtcccggcacgtgtctcacatttgaaagtagcacctcgtttccatcatacatcttgaacttgacatcgcccactccaacaacacgataactcgtgtcatcgcctaagtaaacaacaccaaaatcaccagatttgtatgaagagaaccactcccgcttcgatgtcacatgataggaactagctaagtccaacatccacgcttctccagacttctcgttagacactgtgagaatctcatgactgctgctatctgaatcatcaccacgagctgctaaacttgcaatgccacctttcctcttcttcagtaacaggcaattcctccttatatgtccaaactcatgacacttatagcaccgtgccctcttctccttgctctttgacacccccgcttcatgatcatgctttgccctgaccagcaaactctcagcctgagaagcctccattgcctcgtttttctttgatcttctcaagtctcgtgcaagcaacgacgaaattatctcatcagttttgacagtatccttgccgtgcgtcagggtagtcaccacatgttcataagacggtggaagcgagcacagaagaattatggccttgtcttcatcatccagtttcacatctaacttacttagatccacaaccaactgattgaagacgtccacgtgcttcctaagatctgactcctcttgcatctgtaaaccatatagctgttgtttgagatacaacttactcatcagcgacttggacatatacaggcttgccaacttgtcccaaatttccttcagtgatttttcatccatgacctgatacatgacagaatccgagagactcaagcgtattgttgcagctgcctgcgccttcatctcctcccacttgccagcatccatcttttccggcatcgtctcctcaagagccttggatatcccctgttgagccaacagatccttcagcctcatctgccagagaacgaaattcccggtgccatcgaacttcaccacctcaaatttggaaaccaccgtcgccgccatcaacgataatcaactcaacagctgttgccctgttaaattgatctgccctgattaattgatcccaccgactaactcgaatagtaccagctggaccgaaccagttttttttctctc

SEQ ID NO: 55868 - DNA, 168 bp, Oryza sativa
cggcccactcgtcgtgtcgtgccgtgctagcacggcctcttcagggacgcagcccaagcacggcccaatggcccgatgggcctattcgtgccgggccggcacaagcacagcccaaaagaaagggagcaggccggctgcgctgagaagaaactccggcggcggcagtga

SEQ ID NO: 55869 - DNA, 1501 bp, Oryza sativa
ccaaagacctaaaccgaatttttggtctgaccgaatgcccacccctacgcccagggcgatcgatagcccaacaggaattttgctacacacgaccattcgatcacggcccgcagccgaagtggtagaaccagcgtcccgcggcgccgctggtgggttgagccgttgagcgccattcggccgcatgatgggcaaatggtccggttaagctttggagtccatcgtaaacagccaagattggatcgctaccaatgggcttacgcgtcgtaggaggctcatgggctgaacaaacccgcgccgagaaaatgagtcggatataaagcccaaacattccgtgagatggtaagtttcggcatgtttaggcatcccaggtactacaagtttgctgtgaaaatcatacatttaactcaacctcagcagctaatggctcaagaactgatgccaccttacccatgtccacgccttccagtgttgctggcttccactttggtttctacagatctatctatatctctattgctggctttgtctgccagaatcagaaaatttaatctttttcaactagcccaatttctagtagaaaaagaaatttggctatacattcaagagcattctactgattcttttttcaaattccagacacacatagccactccgtcacaatttcggcgtcgcaatgcttttcacaataacttgtgtcattttctgaagtttagcttaggtaggagccattatcttagccaacttatggataatgcttggagtaacagaagcttagctgcagtacttttgcacaaacgcctcatctactgtgaaacaactttgttggtctcgaaccgggaaggaggctccattgctgctctcaaggcaggcaaaatttgtactgtgcaaaccagctttgtctatcttcctcagaagcagctgaagcctgaagatgaacaaaaaattcttggttacgcagcacaaagggaaggagctggcatcgaacaggcgcttgcttgttggcttgctgtggcatcgggtgcccagacatggaccatctcgaacgaagcgaacagatgccgatgccggcatcccgtgcagtgccaggggggcttgtctttcatcagagtaaaggtgcagagcagaatggaatcaaaacgaaagcttaagcttgtgctttgccactactattctctgcgcattgtcgtctctttcgttcctgcacattcttggagattggtggcagccggggatcgtggacgatcgaagcagtgacattctgcgctctccggccgctcaatcgccggcgccgggggggagatcgagcgatggagtcggtggccgtgaacgcggcgcggcgggtggtcagcaaggcgctgagcccgctgtccggagggttcgtggaggcgtgggtggccagcaaggagctcggccccaacgtcggcgccgtcaagatggagctgctgtacgcgcaggggatgctcgacaacgcccgtggcaccggcggcagggaggcccgcag

SEQ ID NO: 55870 - DNA, 1501 bp, Oryza sativa
tctttcagttctatatcagttctcggtggccacataatagtggagaggcagactttcctttactaccatattggtgaggattatctctacccaatagtatcacgattaccgcgaaaaccggaggttacgaatcataaagtttaaaaaaccggaaagaaggttaccgcacaataaccgtggtgtaaccgtgcgatattgcaaaccctacggagaggaccccgtctgaaaacaaatacaatcacacgcaaaggcctgatctaccctccactaaaccatagtataatcaagctgatataaacaagtgctcccatgtgctaagcacctgcgttactgccaaccaaagagacggcaagcaaatcaggctgcgacacccacaatcagagaggtctagctcaagctcaactgctcgagcagagtgaaccgagactcgaggcgactaatcaaacaatttccctcgctattagtcactgacagccgactaaactaagataggatgatgggcaatcgacgaccgatccgtccccctcctctctcgatcctgatcttggaatcgggagcccatcccacccccaaattaatttgacctacagctcacgccttagctagctcccccagcttcccggatgcttccttcgatctcctctagctttctcgctcgcctctcctctcctgttctgctgttcttggtgtggagacacggctaggcgtccatggcgacgagctgggagtgattccccctgcttgatttgattgggtatgtgatctctgatcagcaacttgtaagcttcttctgttttggcttgatgctggattggaaccatcttgctggtgattttgttttggcttcttcttgtacagttgacagtttcgttctaggttattatggtttggaactttggatggatataagtttcccctgttttctgcgatcttgggaggatagagagggtgttcttggatctaaggcttttccttattgttcttgtagaaatttcttcagggtttacggttaactagttaagtttaggtgaattgttaggttattctgaactaagaaggagacttttggttcttaagatatcttgttcctgcagcctgcagtagttgcaaaattttttctttgttcttaggaaaaaaaaaggatgttggtttctcctgtcttgtgttagtaataaattagtgattctgaaaatgatcaaagctggtagtatcttttaattcgtagcatattcgttcagagaagaaccttgatcaagtaatttatgggaaaaaaaatcgatttaaacttcattttagcattgctgactgtgtcagtgaaaaggatggagcagattgcaaatcttgcatcacttgataatctagtagattactactactaattagttcccagtttcttgacttttcaaccaactcaaaaataacatcaaatagtttcttgggggaaaaaaaacaagaacaatctttgaactggctaacgatcttgattcctcttcctctgcag

SEQ ID NO: 55871 - DNA, 210 bp, Oryza sativa
cctgcggccccttcctgaggggcgtaccgagccaacttgttgaactgacttaggaactcattgacactgctgttgccttgcttaagtctgttaaattcttctttcttcatgtcaatagtgctttcaggcacatgagctgcacgaaaagccgtagcgaactcatcccaagcaatgttagtgggttcagggtgtgcattgcagtaattctcc

SEQ ID NO: 55872 - DNA, 1501 bp, Oryza sativa
caaaatacacacatgtactgtttactcgcacacctacgaatgtgtctcttctaacatacattaagatcaaattgcactttacattgggtatagtgtatctagtttcactttgcatggggtctagtgtatactttcactttatactagtgtatttggaaataagttttacttttgcactaggttatttcatataatcagagggaaatatcacaaaaacatgagcgagacataccagacttaacaaatatagatcatgtttcatgaagtttcattttgattttgtgaggtttaatgaaatttctatatgtttgatgatgtatatcatgatgctaactggaacaatgctaactggaactttgtacaatatatagcatggcgtaaagtaaatataagtgctaaacctagtaaaggccattgatacatcagtgaacctcactaaatttccaacaaaaataaggtaacaaaaacaccaacatcttagggctccttgagattgaaaggatttaagggcccctttaaaatggaggattagcaaaggaattttggaggattcattttcctaaggatttattcctatagagccctttgattcatagggagaggataagaaaacttccataggattgcattcctatgatcaattccataggaaaataagcaagagattagacctcttgtgaaactttcctttgttgagtttatcctgtggtataatcaaagggctcctctctccatttcttgtgttttcaatttctgtaggattggaaaaacatacaacttcaattcctacgtttttcctattcctgtgtttttcctatcctgcgtttcaaaggggccctaaaagaaaatctgaaggatttcatttcttgggaaatatttgtataaggtcatttaaaacaaagaaatggactgtgcaaaatcctatagattggctatcgtacatgaatgttaatatatttctataatcctgcatttcaaatgtgcccttaaaaataatctcatatttttctttcagttctatatcagttctcggtggccacataatagtggagaggcagactttcctttactaccatattggtgaggattatctctacccaatagtatcacgattaccgcgaaaaccggaggttacgaatcataaagtttaaaaaaccggaaagaaggttaccgcacaataaccgtggtgtaaccgtgcgatattgcaaaccctacggagaggaccccgtctgaaaacaaatacaatcacacgcaaaggcctgatctaccctccactaaaccatagtataatcaagctgatataaacaagtgctcccatgtgctaagcacctgcgttactgccaaccaaagagacggcaagcaaatcaggctgcgacacccacaatcagagaggtctagctcaagctcaactgctcgagcagagtgaaccgagactcgaggcgactaatcaaacaatttccctcgctattagtcactgacagccgactaaactaagatagga

SEQ ID NO: 55873 - DNA, 1501 bp, Oryza sativa
aaactgttttggacttttgacatgagcccgatgtcttttgctgctttgacaacttgcagcagcaactatgactactaatgttcaagcgtacacatattagaaccaatatgtacatatattagaacatagtgaactattaacctatttgattttaaaatttaaaatgattagatattatcccgagagcagtacatcaagtctcagaaaaatacaaccaccaaagccaacctacctgcagcaatctacatgcagttgctacctcaaattgcatattgtgcaaatgtaggacaactaggtcttgctaaaagtgctttttttatggttgtggattgtaatcaaagacgtgcttaaaaaaagagtgagacttgttatacccatggtttttatcacttaaaaagatatgagaatgacggcaatactaaaataacagaagaaaagtacggtgttattgaatgaaccataaacataaactctcagtgtaaaatatcccaaacaaaaatgttatgcatctagaaagtatattttaggtcaagagattcgttacatggctacaaggtcacaaattagttacagccttacaggtctcatgtatcatcgttttgtgtttttttttacaatgaacggacttacctattggatagggtgggtcggtcggtccagctataacctgtgtcatcttacacaccagaacctcttctagcactgagccatccatattaaccaccgtctactaacccataaacaacccatcaaattaatattttactccagactagaaatgaggcaaattgctcgtctcttcgtcccgagccatcgactattcattcgtcttcatcacctgttgcttgatacttgttccttcgcagtatcgatgattgtgctagtatacatgtgttgacgatgtattgtgcacaggcccatccgcccatggcccgaagccctagccagcaacatgttagtgggttatgtatggctaagcgactctataattgcattctatttttcttttttgtctttgatgttcttttgtaccttaatttattgattgcactcttgttctcacacggttgcaaaatatgaaacagtatgtgttatattccattatttttttcaagcatatctgttatatctttattttagatttagagctatgtccgccgaccatttatcatggcgtgcaccgtatcttccgttattttgtgaagcaacccacgcaatcccgctttcaaaccgcgaaggcgtaaatcctcaatttcccgtcttcgaagcgatatttccactccactccacgcaatcaccgtgcacctggcttggcgcgcgccacgcgcgggaaccggacgaacacccaccttccacacgccaccgcccaccggcgcgccggccatggctcccctcctcctcctcctccccccactccgccttctccccgccacccttcttcgcgccacaagccgcccggcgtcgccaaggcgcggcctctcctactcctaccccaggcgcg

SEQ ID NO: 55874 - DNA, 894 bp, Oryza sativa
ctgcgctgcatgcagcgtgacacgcttgaccagactacaataaatgcggttaggtgagcactgccgtgtcacctatcccatatatgtggcgcaaacttcctcaaggggtcggggtgcctcggccctcggggccggggcaggagtaacccgacccccccctcgggagaaatcaggaggagggcagacacctcaccctcgggcccgacgtccccgaaggtgccaggccgcgtgggcgattgtgtctgcctcaagcctctggtcacgatacccccggtcccatatcaccgacagtagcccccggcgttatgccagggcgatcgcccttctcaagggaagcggtcgggcgtaacgccactcctaaagcttggtgacaggtgggaccggtttccatggttgcgcagaaacccaacggtctcaaaccatgcacatcggtaatggtaacttggctgtccataatgggcggtctcttcaagactgccacatcacttgagcagcgcacgaatctgggtgagctgatttgcttcgcctggagatatggtaacgtcgcttcggtcggcgagcgtaattaacgcgcgcacgatacgatctatctcgactgccgcaaccgcacatccacttcatgcgccgcaagcgggcgaatgggattagtggaagcgtgggcacgagaaacgagggagcgagatagcgagaaacgagggagcgagatagtgggcgcgagaaacgaggagccgggcacggcgatggcaagggtataaagacaccgaggaaaagatttgctcccttcctttcgccattattccccttgccttcgccgcttgcgccctaactccttctctgctgcgccccaccttcgccacacgcgctcgttctcaatcatcccttcctccggcgcca

SEQ ID NO: 55875 - DNA, 1309 bp, Oryza sativa
ggactaaagatagagtatctttagtcccggttggtaacaccaaccaggactaaaaatggatttttactcccggttttttcacccaggactaaagatagcgatctttagtcccggattctccaccagtgaaagttagatggacgtggtcactgacgtgtaggcccataaaggtgggccccacctgtctgcgacccacgtctctctgtctttacgtcagaggagctgtgtcctactaactggtttatccaactggcacatgcacgtgaacacaatagtacagcacaagatatgtgttagaacaccacgaaatgtcatagaacgcaccatgaaattgatgtgatcttagactgttgattgattcgatctactactatttgttacatgtttcatgttgtgaacaacttcaggaataagtattaggaacaggaggcaagctgaagccgacaagctggcggcggggtgactcatgatgatgaaagaaacaaagcatcaaactgaactgaagttaatcatcaggggataaggttgtgccctgtaatctttttttttctgttttattttgtcctataatctgatgctagttaagcatggataattagtattgatgatagattggagggcccctgattagtactgatgcaagagtagtactactgaaagtctgcaacgagttcatcctggacggcagccgtaaaagggtcaatttgtcaaattcaccactccaagcttccaagtattgggtactatagtataagctaccaatctagctaggtaggtagcgttgtgtggtgtggctgaataatcagagtgtttccttttgttttgaagttagcatgaatcattttacggcctattcctggaaacaaacaaaattacaaatacaccctacaaggaaacaagcaataataagataatatggccttttactagtctcctttcctaataaactactataaaataaaaataataaaaataataataataataataataataataataataataatattattattattattattattttgtaatggtttgtctatttggtaatttattggctaagtggttgcctctatattgggcagggttttgcgtaaaggttagactggtactactaagaaaacgatttttttcgtgcggtcgaaaagggttgttgcgtgcggatctcacccctgtctgcacctaagtgtctgcaaaaatccaatttttttgtgccacgcgaaaatgattttcgcgtgcggttgggttatgtcgcccacatggaaaaaaaacccaaaaaaaaaatccaaaccctaaccctagc

SEQ ID NO: 55876 - DNA, 397 bp, Oryza sativa
gtctgaccaagtcagacggcttatgggctgattcagaaatatctgaacatataaacaatgtttagatcatttgtttattagcaatttttatacgtagaaaacatttatgccatgagtattatgcacaaatgccaaaatatgattatccatgatactcttatcgctgtatcgcatggatgggtgaagacagaaccatatttcctcatcaaactttttgattgaactttgaaccatccaatgtacagttatacatcaaaatgtgtttggctcaagcgcaatgtaatttgatttatcttttgaacttattggaacagtcgcaacaagctgtgttttctgaatatcatttttgtgtctcatttttgtgccgtaataatatatgctgatttgattaaatagc

SEQ ID NO: 55877 - DNA, 305 bp, Oryza sativa
acttggtttggatttaacctttttcacgatttgatgattcctattgtggagattatgggtaccccatatccacacggcatggttatccgactagtaataggggataacatatatgtatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggtgcata

SEQ ID NO: 55878 - DNA, 1501 bp, Oryza sativa
tgccattgtcgctgggttttaggtaggagataagcaccatggggaggggagaggagaacgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgagtaggcagacgtatgaagagaagatcggtccaatgtataatactctagacttattttagtcatcgtaggtaaatttagtaattagtagcgaggggaaaagtctaaagtacttctcgttaagaatagaaaattacgtagtaggagtatcagtgtattaccacgtgataggtaagtgatattgaaagtataagacttctcgattttgttgacgtagttaagagggtagaaattaattaacttatttttattaattttgaatgctaaaaattatgttactaatgtacaatttaagattattttaattttgtcactaacttcacgagtgtattcccgcctaactaccgcatatccatttgtggtgttcattgatcttatagccaaaaccaatcattagacgagacttgatagctccattgcatccaatctcacttttggaaaacggtagttggaacctgatagcttcatctgccaatcaaggcccccccgtacgttcgtttggtcaaaaagagatacatgttttccttactagaaaaaaatgtttgtacgttgcaacgggtaaaaatattttttatcctacgcactatgctccctttaatgcccatgcgttttggaccaaacgaacgcacattccttctgtccttttcagctctagtcctagtacagtccgctatctctctctgctcggtctacctctctttggctcagtccataaatggagttgtaggcccaagtcgaacagtattatgtccgtaccattacaaagccgatcctcccatcaaatccggtaatccgctcgagctcccatagtcttataccatgacggagccgatcctcccatcaaatacggtaatccgctcgagctcgcatagttccgtacccatacgatgactaacgaagccgatcctctccatcaaatccggtcgaatctttctccatatccaaaattattgagggatttttatccacttgatcttccttttccttttttttaccaaaattaaagcaatcagcaaa

SEQ ID NO: 55879 - DNA, 1501 bp, Oryza sativa
gagatttgggatgtcactatggacttcacattcaaccgtccattaagggttaagttccatataaactaatattgctcctgaattaaatcaatattagtgatgtgtgataataaattattccatgccagtaattttgatctagttagatctgttctctaaaacatctgcaatagttacctatttatacctaacaacactgtagaggaaagtgtactgttctcgtagggttacatctcccaatcatttgtctttccataatctaatttaatttagtaaccattcttaattatgtaggatccaagacaaaagagatctcatttcatcttcattaggctgtctccggccttctactgaacttgcgtgagcggctgtgaactcaaatacttattttgtattagctgtttccaaacatcatctacagtaagcaactgaaatagccacttactgagtaatactgaatttctaaaccaccttatctttaaggcggcatagtatgtctcacttggcttttttttttaccatcactctaacaacaaaaaccagagcaaaaatagtagattttttttaaaaaaattcctctcgctactgtgaagtacttcattcatgaaaaaaaaactcaatctaaatgggatgtgacatactccatccgtttcacaatgtaagtcattctagtatttcccacattcatatttatgttaatgaatatatatatatatatatatatatatatatatatatatatatatatatatatatatatatatatatatattcatatacatgaatacaaatatgggaaatactagaatgacttacattatgaaacaaaagaaagaatatagtataacaaatctggatacctttatatctaaatccattataccaagttggtcgtgtcacatcccccaattagattgggtcttgttttaagacgtgaataaacactaagttaattagtgtgagccctccttcaatagatagaaattttcctttccaactatggaagagatgcatatgcgtgtccaaacaccaaataatagtacattagcccgggagcaagccattggagcatactccctccgtccaaaaaaaaccaacctagaaagagtttgtttagattcgttgtactagaaagggatcctttaaggttgtcttaaaaatacccaacctaaaaaagatttgtccagattcgttgtgctaaaagagaaccctattagacttgtttttttttatggagggagtacgagactaactacaaaattttcagtctagacaatgaccaagcgggggggacatatgtcgctggactcaaactccacgacggaactggcaaacagacgacaagatctcgaccgaatctgatcgacactgggtaaggtcaggaagaacagtcttactcgtcttttttctaatccaacttaagctcagtgatgacgccaactaatctggaccgtgtttagttgtttaggtgtaaaaattttaaagtacacgggcacacatt

SEQ ID NO: 55880 - DNA, 1501 bp, Oryza sativa
tcgatctcttcgtgggcagacctgtggcagcagttcgtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctcaagcggaagtcctcgcagcagaatacgcgaaccctcccaagcgcccagacccacaaggtagcgacgcaaagaaagcatggtgccccatacacaaaacggacagacattctttggaagattgccttgttttcaaaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgaca

SEQ ID NO: 55881 - DNA, 1501 bp, Oryza sativa
ctctttcaatgatgccaccacctgatggtccgcgagcggcccgatgatgtcagtcagaggaagagcctacgctttataaagtcacaaagcgatctcagaagaaaaacgcagaatgactactgagtacacttacattgatggcggcatcgcgttcggccgcccccttctcgcaaaggggaacgggaacattactcgccgtcgccgggccactgatcatcacctggccgacacgacgtcccacggcttcgttgctcagacctgtgaatcgagaaccaaatttcgatgagccaggaggagcgcgcacacaagcatatcaggataaatgcgagaaagataccccgaggagaaacccgggtcgcatcctccggtccagaatagtcaaaggctaggtgggcttgagcctggagtggctggattcgtctactaatgaagtcaacagcgacttcataccccgacaaaccacgcactcggagatcgtcgaccacatcgatgaacgactgaagagaaggggtcaaagggggttttgcggtccaagacgaaatcttgtctggttgttcctcaggaacaacgaagacaggatccgaatcttctatctgaagatagaacacctcgtctgccatttgctgcgagaggagggacactggaaggggatataacgcgattttaggccatcccgaagtcggaatccaacgcatccagataccctgttggattccatccaacgcaactcgtagtagaagcggaagagatcgagaaagggctctaccccaatgtaggcttcacaaagatgtgaaaaatactaaggctatagaattggggttcagatggagcaaagaaagaccatagaagtttaaaaccaagagaagaaattcagaaggtggagggagaaaaccgcagagaatgtagtcctcgatcacaaccatgcgacctaagatgggctggggttcagtacctcctgcttccctttccatggttccacgacccggaagggcgccgtcctcctgaagcttcttcagcgacacgctagtggaggatgatttgccgagatccatcgccgatcggagatcgccggagaaagggctgaggtcgacgaactagggtttcttgtgggagcggggaagacgaagaacgcttgcaggcgggaggttttcttcacaataggcgggcttcaaaatggatcccccaaaattcctttaaatagacgcactaccgacggtgcgaattccaaggaaaggagagagatagccgccggaaatttctgggtccgttacgcgcggcagtattttggacttcagtttaaattcactcgtgaccgttgggcttcacatggtgttctcgattacgtcctgtctccacggttctcgcaccgggaacaacaatagcctcgacacgagaagtcgcgaatggttacacgagttcatttaagcagaagtcgggggctactgtcagggttacgggttaggtataccctttaccctttgatatacgtcacatatcggta

SEQ ID NO: 55882 - DNA, 1501 bp, Oryza sativa
cggactttccggtgagctactctcgacagggagacgtgcggccgcacgctcgggttgattgaagctggaggcgatcggcgttctcgatcggtggattcgaacactctgggcggggtggcccgggcctttcgaagagttgcgttcgacagggagatggctagacgtagcgctcgggtcgttcggcggctgggaagacggcatgcgacttgtcggcttcggctcgcgactagattgatggcgttcaatcggatgtcggagcgggtggatcctataggctgttttggaggtgttgacaggtatttccacactggaattgcttcaaaagcggcgtattagcggtggatggcagaactaagcgtagggcgtctagactagcatatgtgctagttccaaccctagagaggtctggttctactgtttctagcacagatcaagaaaatcacgatgacaacagatcagtggcactagtcattggtgtagtcggcaagtggtgtttggcagtggtgctaggttccgctggagatacgaagaagcccaggaggtcagggtcgcggcggtgtgcgcgttttgcgtcgaagccgagctggcggcggagatcagggtgatgccgagaaggagcgggctgagccaggacgtgcaaggttcggtggttgtcggattcgtgatgtagaggaagactcggccatggagttatctatgtgtcggtcacggcatggacacgaccgaagacaagctggatggataccgcgttcgacacaggagggagttggatacggattcgatttagactggaaatcggacacgtttttccccaataaaagcagcaaagggaccacgggattgtaacaacgcagtcgaaacaaatcatctagcagagggcgagattcgtacccgattttcgcagaggcaaaggtggtttgggcggcgaggtcacgggcggctggagacgcatcattgcaggcggcgcacggcggcgtggtactcggcggcgttcgtcgcagctcgggcaggagcttgcggcggcggcggcggcggttcccggcgaggaaccggcgccggacttcggtggcgggcgctcctaggtggtaggccggcggcttcccaaggcaggcgacgcggcggctcctcgcagggtcggcgcaagtgacggcggcgggaggcggcggcgccccaggcggtttctgaggcgggcggcgcagtgcttcttgcagggccgacggcgtgaggagcaggaggcggcggcgcatcgggaaaaagtggcgtgggcacggtttctaggaggagcgaggaagccaaaggaagaaggggaacagggtcgatctgtttttctttgactggtggttgaccaagtaaaagaaaccggtccggttttttggagagagaaaaaaaactggttcggtccagctggtactattcgagttagtcggtgggatcaattaatcagggcagatcaatttaacagggcaacagctgttgagttgattatcgttgatggcggcga

SEQ ID NO: 55883 - DNA, 152 bp, Oryza sativa
agcacctaccggagccatccaccccaggagaatgaccggaggcatctactgatttaggctccggagctaactagaggcgctggagccaacccgagccttcggagccacctaggtgctccggggtcatccaaggccttcggagccatctaagg

SEQ ID NO: 55884 - DNA, 170 bp, Oryza sativa
cccccaccaagagatgcttcatcaggaaggtttggaaattccgtgaatgaaccgcagaaagtttatagcctgcatcagcatatggtcactgggcacaaatcaggttggttcgctttatagtcaatcagtggcggacgtggaaataaaaacaagatagaagtctagaggga

SEQ ID NO: 55885 - DNA, 598 bp, Oryza sativa
ctcgttgctcgtggccgtgggtggggtgaggacgtcatcaccggtgaaggtagagaggcaaggagggaggtttggggtgggggaagaatatgacaagcgggcccgagggcatttttgaccttttacattgtttatctctcctattgaaccagaaattaatattttattggctgcggtgtcccttggcaaataaccatattttgatagtgtctttccccaaaagtgactttgtgcggtgtcctacagctaaaaccacgaagtcgggatgtcctgtagcaaaatttgccaatttattccgaatttactgcctgatcatttcttgtcagcaaagtttcttgtttgttgaattggacgcatatacaagccaagcaaataaatatcaacatattttttgtttgtttacaaatttgttaccttatatatctatgtaagtagaactacatatggcatcaaaagctacagagttgggattcgaaaatgttcaactacttgctagataaccacaaatccaaccaaacagctccagctggattttgccactggctgggctagatttccagctgcaaacattggtgtttcctggccgtgggaggggaca

SEQ ID NO: 55886 - DNA, 1501 bp, Oryza sativa
caggcccgcagtggcaagactggcaactttgcggcgaccgtggttaagtcaagtggctcggctaggcgttcgggccgggcctatggtgtgtggtttggagtcctaggacccgatgggtggaagaggattggcccgtgtaatttctatgcgaagctaggctgaattcagtccggccacccaggccattcaaggcctcttacaaatctcaaagcacgaatctgtcgtgcgacgccccgtaaatttttttttcatttaaggccctttaaatcgtagaattgagaaaacattggaatagaaaaaacatagaattttgatagaaatagaagtgtaaattagaggattgcaaaacataagaaaaaacacatgaatgaccatttgattgaaccgcagaaaaaacgtaggaattggatgagaaagatagactcaaaggaaagttaccaagaagttgaagctcttgctaaattttctctaaaatctctatatggttatccattccataggaattttaaaggattgaatatgattcaatcctttatttcaaagggcatcataggaaattttcctataggattgaaatcctcttaaatttctatgtttttcctccaattcaaaagggccctaaagaaacttaaaattgtgagaagcaaactgtttgatagttaacttgtaagaatttggtttctagttcattttctgaattctacaactataatttatcagaatctaaaccaaaagctgaaagagagtttctggttatgggataagctacaacagttagaagcttcccctctcttcctccccgaacaagccatttgattaccagacaaatagtatatcgtaatgaatcaggttcacagagttaaaatagactgcgggcctgtttagttcataccaaacttcttcccaactcccaactttccatcacatcacatccaaaactttcctacacacataaactcctaactttttttcaaactaccaaatttctccaaacttctccccaattttagaaactaaacacagcctacgtcatatatttggatatagactacgtgtccgtatgttaacagattaggtccatataaatagaaaggaactgtgattatttttcacatacgaacatactgcgcatgttgggatgagaggacggaagaagaactactccacttttaaactagtagatatatccatatctaaacgttaagattatagcaactatttaatctaaaaattgcctgttttgtatctttttatttttattttttatccttttttctataataaagatgaaagtgtaaaaactgaaagtatattgaatggggagagaacaataatgtctttacagtgaactgaaatttataatgaaatttcaacccctttaccttttgtttgttttaacatctcctaaattttactgtcctcgtggagtatctgaacttgaaaattcaaatgcctatgcatgtgaaaaaaaaataagaaaaatcaaccacttgctttttcc

SEQ ID NO: 55887 - DNA, 334 bp, Oryza sativa
atgaggaggagatcgcaaccgtacgttcgcacacatgaaggagctcccagcgagtcgtgcgtggggagaagagtcgtcggctggccatgcgcagggaaggagcttgccatccagcaccgcgcggggagagaagctcccggccggccgtgcatatggagaggagtcgttgaccggttgcgcgcggcggagttgctcgcccgccggccacacgggggtggggaggggggggagctcgccgaccggccgtgtgctgaggaggaggtcccggccggccacgcgcgggagaggagctcgctggccagccgtgcacggggagatagttgttggccaacca

SEQ ID NO: 55888 - DNA, 1501 bp, Oryza sativa
cgcgtacgccgcgcgctccgccgtgctccgagacctagcggctgcttctgctttgcttccgagtccctaactttcctccctgttgtttggcttcgcaggtcgaggggtggtgggcgaggaggagcgctcccgtcccgcctccgcactctccgactcaactgcagcgtggctgaagcgactgcctccggcgacgaggcgcctgctcctccggctaggaagtaagcccctggccgcctagtgttcggcgtaatgcgtctggtaggaagaggattgcggcaggtttctgtggtattttgttgttatgcgatggcgtagcctatgatgtataagtaagcgtttgctctggttcaaggctagtatgcgtgagaagtcacggatgaaattctgtaaggcttgtagcttgactgtggtaggaccagcttgtgatgtaatgcgcctgtagggtgttgtaatgagtgagtacagaattactgaggtgttgggaggggctaagaatggcaatgcaggaattgaattgctgttgaagcctgcagttcacttgctgctcttagtgtatatacttgtttgttagaatacttaactggtgttggatgaagcaagctacccataccatttgatctgaattcatttatttttctctactagacactagttgttaaattaaccgtcacttaatttttttcgtgcttgaaatgactcgatgataaattccacagaaaaattgtacatatcctagtatccaacaggctaaagtgaacttattttttgcgcaccaaggaagagagcatgccatcacagctcgcttctcttggtgtgcacaaaatgaaggtgtactcagttgactgattgtttttgtatttacaacttccacaattggtgcctcatatacaaattcagtgttcatttcatgtagtatcaagaaacaatgacattttttcagtccgatgaatatcttgatcctaagttagtttacactgtcaaattaattagtttcttcatgatcttatatatacacttgtttgcactgctcaaagtcatgaaaatattattgatggctagtgtgaagccagaatagcaaaaatagctattttggatatgtttctcatagggaatatttttagcaagtatgaacatataatgcataaggtaatcaagaacttttgattacattgcatttttttcatgatgcatcttttttcatgttggctgtttaattgtatttggatcaaatttattactcttattttatagttattattatagtcatccgtttgcagtgtgcttccaaagcaattgtttttatgtattataaggtttcatgagaaagaatgcagtttctttgcccaagttccatagtagcatctattcccacgggtctactagtcgtagttgtgattttcttcttcttttttttttcagataacaaagttctggcctagtcctgattaaatatttatacgcgtttcactaatttgaacatctatatttatctctactgact

SEQ ID NO: 55889 - DNA, 1501 bp, Oryza sativa
ctccctctctcctccccgcccgcgcgcgcgctctgggccgccttgttgggccgaccggcccatttagctcggccgagccgccccttttctctcgggccgcgccctagcctcccgagggaagtctaattttccccctccttcttttcttttcttttctttttcaaaaaaaggaattaagtaaatccttttcctttagaccaaaaatccaataatcttagaaattcaatatctttccaaccgtaagtccgtttgactccgttcaacttccaaaattcctcaaatcttgagatctatctaatggcacgcttagaggtcattaataggctttattttcgccgtttgttgagttgtcccgttttgcgtgtagtttcggagcccgaagacccgcagtgcgaggatttcgaggatcaagctccagatctcgagcaaggcaagccacctttgaatatcttgagcctatatttgaacttaattatattgcttgaaagattattatgcattgataggatcgcacttaatctgcttgtcccgtctgcaaggcagattgacggacctacctaatttgttgcatttgatccttcatttgttaattgttataccatgttcccttgtaaccacccagttgcgcctcggaaatcgtgcactctgcacgagtatcgacggccgccttcaaacttaaaatctgaaaaaaaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccaagagacatgtggattcgccggggtggtgtcagagaggactcctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtacccccctctgcagaggttaacaaactgttcgaacagccgtgcccacggtcatgcgcggatgtgaggtgattcctagcgtagttttgtttgactactgcttgtgaaattgctgttgtggaaaggggatcgatgcttggaaaatctgcagctgatgggatcagctaggcccgggtggccgtttgaaagttgttggcccgggtggccgtttgaaagttgttggccgggtgccaatcttgatcaattctaaagactgatacatttgcacatactccgaccggacgagacgcactgtctcatccgtgtcgtttgagaagcactcacttagttgttttc

SEQ ID NO: 55890 - DNA, 1150 bp, Oryza sativa
acggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccatcaaaggtgagggtttgggcccgtcacaggtgaccttgaccagtgtagtggcgtactgtgaatatatgtgtatgtattttcaaattaatgacaataatatgatgtggtgacgaacaacattttcgttaaaacattactcacttcgaggatacattactcatcgtatctttttggagaaaaactgaataggaaaaggatggttcacagtcgtgatctttttttcttcgaatgaaatgtatataatgcattcactaaacagcaagtaatattttcaccatatataatccacgcctctatgagctgatccactagcccaatgcgcccatccttgtcctgtaggcacaaattgttggcaaatggcttgtgtgagggctaacaccatctcttaacacagcacagaaggatcagtttgcttcccaaacaagtactaggatagggtctttcttccggatgcatcctagacctaacacgccctggtttttggtgcaagaggattctgcctgaacataaatcatcactgcagaaactgaattgaggtaaggaaggccttatgtgcgcacatacagaaaatggatgttgttcactgcatttcttgcgctttggagttctggtccctaggccctagcgtcaattaattttctatatatggtagcttttatttttatttctagactattaaatgtggtatagtaaatgtttttatttctatatatgctagctagctagcacaatcagggcactattttgcaattcatcattgactagtgctgggcaaggattatttgcaagcttcacatatgtattgtctgtgaactgatatatctgatacctgtttaaaaggtcaatacaaccaatacaatatactctaacatgcacaagttcttcaaaataatgacctactcttttttccccagc

SEQ ID NO: 55891 - DNA, 1501 bp, Oryza sativa
caccgtgcgccgcccctttgactcgctgacgtgtggggcccgcgtgtcggcgccggccgccccttgctgacgtcagcgagatccatttcctttgtaaaaataaataataattgcgcaataattcgtaaataattatagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagattgtttgaagaagcaaggcaagtcacacattccccttgagcattttgatcctaatttacaaatgttttactgtttgcaaataaatatgcatgttttgctaattacacgggatcagggtttacctatctgctcgcttgtgccatgtttacttgatatctgttctttgtcaaccttgggtaataaatcgaccagcttgtgttacttatgtgacctagctagaactatatgcttagccatgcttaattaccactagctcagttgatgggataattacaatattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccctaataaatcgacccaatgcaccgtagtccaggtgggttggttgggcctgttcaacgtggtgtagcgttgatcagtggagattcaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgcgattattcccccttttcagaagtgtagtgcttctgagctgaa

SEQ ID NO: 55892 - DNA, 478 bp, Oryza sativa
agaagagagaaaagagaagagaaggagaagaaaagaggagataacggctgatatgtgggccccacgtacttttcttaatttttttactgactaggatgccacgtccgcaaaaccacccatatatactgccataggaccctgagtgcacggtttgtgtgagattaggggtacacatttatggttttgtggttaagggatttcaaaaaatctcgctgttaagttgaggacctccggtgaacttattccaatcggtaaccgcccccatggccaagtgggcttcatttgaggctcatttgtctccggcccggcccacttcccttcccatctcaccagtgacgtgcttcttcatcatccctatatttccccgacacttcccatcgagccgagcaaaagccctagctttcttatccggggaaagaaaaagaaaaaagaaaaaaccctagcgatcgatcttggcggcgaggcgagcgacagggga

SEQ ID NO: 55893 - DNA, 378 bp, Oryza sativa
taaatgatagtgcacatagtagcgaagatttcatgcaatataaaaaatgagttttgtgtgtttgggatgcgaagtcgaatttagaagtagtataaatttaggacgattggagtttgatcaggtggattacttgtatgggtaggtttcctactaaattatgactttttctacaaagtggatttgtggtttttgtacaaccacatcagggtataaataaaagagtggttgatgcctctaggtatagattttgtgagattattagttgagagaaaagtttaggtttagcctagatttcgagtttcgtcaaaagttgagagacaagtgtaattgttgtgttttgtaaacataattagaagtaataaagatgatttattttta

SEQ ID NO: 55894 - DNA, 1422 bp, Oryza sativa
ccctcgatcttgtagtttaggttacaatagctaaatcatattatgaattttatggtacttgacttccacatggttctacgagaaactttaggtgccctccacacagcgcatagaagttaaccttctagtttaattataggtcaagttatttcttgtatatggtactgttagggtgaaatcggacgatagggtagtatgtggcgggatgattttgaggaaatttcatgtagagttactgccaagattgtctgttcatggttcaatcaagagtcaggcaataaactaccgcatgttggcattttttatcagcttcaggcactgagagatagatgccaaagattttgatcagtgcagcaatggtctgttatatgagttgaccatttgacaatcttccctaatgccacagccaatagtgatgtacattctgtggactaatgcattgcaaggatttatcaggacaagatgacatgaagagtgtacaagtgaaatatggttctgttgactgattgttgcttttggttgctagtatctgggtctggggcagccaagtttgtatcctgttgaggtcaggagcatacaaaccaaattgctgttatgattctttggattaccataatcaaacacatggaaggcacaaaaacttgtgtttccttaatcaggcagaattgttatgtcttttttcaagggcattcaacgcttgccaagtcgttaaggctgatggataacatgtgttagtttgcgaactaagacacaaaccaatagcatcggctcttgcagtattacagcatgtcacttttttatattctggctagagagtagagactgtaggttgaaccaattgctgcatttgatgttgggtatttcgggtacacagtacatgctgcatattttgttatcttctattttgctctttccatcctggtgagtaatttatgcttgaaaattcacttttgcatttgcattagtcaattcctactgtttacaatatgagcattagtatagcgctgataagcttcatatggattgggatttcatttcatatctgtagcctttggtaggtatcagaaattgccattatttatgccttgacatcttcctagtcctaattaaattggaatctctatattgaatattactttttattgaagtaccaattactacagaagtttttgccagttaagtgacttaatgtttattttttttaacttttagctttgtttcaactttgttttattactcttctggttgctaagcatacaacaaaccttaaacacttggtttatttttcttgttcaaatcagatatcgttgatctttgctttcttggagtttgttatgtgtcatccttttttggtttattttaagctttagacttctattaaaatttattgcatgaagcaacagtttgtttttgctgggtgca

SEQ ID NO: 55895 - DNA, 605 bp, Oryza sativa
cgtcaaacatttagggaaggagggacaccttgtcaacaagatatacaggcacaacggccttagccgcacatggaaactcctccttatcattttggcattaggccattcttggctgagttcgtttggaggagatggtaaccaatctcctacgcacggaaaacagagcaatccattagcatgtaattaattaattattagctaatttctttttcaaaaatggatcaatatggttcttttaacaaactttcttatagaaacattttataaagcgtgcgcatgaaagacgagcgagaggagttgggaacatgtggtgctgaacacagccttaggctatccaattaaaggttttaggctatccaattaaaggtttgtagaaaaagggttagtagttggtaatataaaaataaccttgctagtatagggtagcaagaaacccacctttggtcgcatatacaattaaatgtcactcttatgttgctcggagtttatttaagatttcattttcttttagcttgtttggaatgcatggagcgtgcaatgaaaaccaatatatgtatggatcgaacaagtactaacctgatcaagtttggatttggtcgccggca

SEQ ID NO: 55896 - DNA, 1501 bp, Oryza sativa
tactagctatttttctttgttctgcaaggttagattaaagaccgtatatatcttactgtgctaagatttctgagattctcagtattatctaaaaaatatttctgaatttacttctgtggaaatggttccagtttattgctttgatgaatattattgccagtgccctcttctgcttgtcttcttgtttcttgtctggttgaggagttgaggtaacttatctctggattgtactgtatctggtagttttttgttgggacttggtactacatcacatgaaactttggagtttcttcatgtgacaggactaatgattaagcacgataacttgtatagtttctgtaacatttagtagcagtagcagtagtttttaactacaacaagctgaatctagctagcagctggtccaggaagacatcaagatttcctgtccgttttttgaaaagaacaagataacaaggaaggcaggacacatctctgaaacagatgaaacaagacaaatccgtgacacaagcaaacggtaatgcagagcaaggtccttactagatacttattttgatattattttcttgattcaaaagggaaggaaccacacacaatgcaaagtatatatatgtacatgcatcatatccatgataagatgaggaccacatattgatgaggatatgtaaccacaatcgattgcaagataagaattcctatttcttcagaaagaattaataaacaaaggacaagataagaacacaaagtctacttacatccattatttaaatacaatccatgatagatgtacagtactcagctactatggaacatttctttgtaacaagatgtcggttttttcgtcatgcatgcgttcatttttcagaaaagaaaaggttagccagtaccactgaagtagtcaagcttcagattaattagtgcatacggcacatggtaacatatattgccctccattttggaattgtaatactaaaaatcaagtggccctctcattattattttttttctaagaaccctgcttttttattgaaaagttaaggaaaatctcagtacaaaaggagtagacagagatcgagcttgcatggatcttgaatcctatactagtatactgtaatgaacttccactgtctactctcattaattccaggttataattaattactatatgaaaattctgcttcccggtacacatgcatccaccaccaatctaccacaagttggacccaaagaaatccactgaaaaattcacaagcgaataatatatatcattcacaaattggttgcctgctagctacttgccttggagctgataaagtctatgtatatctgttacctatggtcagatatactcagatagatcatacatgacgctcttgtcaattgaatatcatctattgtgtgtcctgtgtgaagaatactaggagcactcgtaatttttatctcctttgcttgagatgcatatgtttggtgtgccttcacacgagcttaattagcagcataa

SEQ ID NO: 55897 - DNA, 189 bp, Oryza sativa
taggctgacgaggggcgggcccaacttgtacggcccgaacgtacgtgatactcccgttccgttccggcccaactataatgggccgcaggtgttgttccggctcaattagagggggcctaaacaaacgagagctcactttggtatcagctgcgtctgtgtgtgtcaagctaccactactcgtgtatcagg

SEQ ID NO: 55898 - DNA, 1501 bp, Oryza sativa
tgtatataaaagttttattataaattattttccgtttgtaaatatgttgtttgacttatttcttgaataagccaaatgatgggactattagttttctatgggatggagggtgtactggtccatgcagctgcaacaggaaaccggccggtcgatcgagcaaataatacatgggtcgcagcgctactgtgcacgagagcgattgagcctgcacgcatgcagtaaactgtggtccaacacgtctaaaaagaggccgtttttgcacggcgcgacgactgtggcattgcctacctatagtacagccctacatatgctagctaaagaaaatttcgttccaaattaagatatattatatgatacatcatcgacacccaagtgatgaaaaacacacaccattcatacatatatattttttagaaataaggtgttgtctaatatttaagtacatcgacaaaacgatatatatacatgtatatatgtcggattaagtacgggtatagaaaacaattcagtctaatctcgcatgataaaccgtttaattacacagccacctataatctatggcaagtgaaaaatcaattgtttatatagtcgtaaaatcgatcgtctattatagtcttattaggccaagtcctagattgacctactattttaaaccacatttaaaacatgataaaaaaatgaatacaatattatcgactcataggctaacaactctgaaaaattgagttgtccatatattcaacacaactaccctaccacgtggatcggtggatgctacagtgcatccgatagcttataccacttcaattaatgcatatgcttccgtttccatttgaccaaattaaacgaagtgttcgtggtacaaacgtacgttccttcaattaaattcggaaatgattgcactaacgggcgtactttctccgtcctaatttaagtgcaaccataagttttcgcgtccaattttaatcatccgtcttatttaattttttttataattagtatttttattattatgagatgataaaacattaatagtattttatacgtaacttatatttttaaattttttaaaaatagttttaaataagacaaacggtcaaagctgtgcacgaaaaattatgactgcacttaaaattagacggagaaagtaattaagtttacgttaggtgctaaagtagctgtcagaacaacacgacaagtcggtacaatattcctatgaagtttgtcacgtcagagagagagttatggatcaatacgtgtcgtcggttgcattgcatttgcaattaacacgtccatcaatatgtaacagaggtacatcaaacgtacttaaaaacacattacctacaagcctaaaactagctagccatcgacactgttagtgcaacatgcatccaacagcaatgcaaacaaatacaactagacatgtttaatactttatcttgcatgagtaactagaaggtcgtataattaaccatataaaagtacattgaaacataaacca

SEQ ID NO: 55899 - DNA, 1118 bp, Oryza sativa
acatctgaagttagaaaacgacaactgctggttgtgttttcagactttctggatgctgtcaaacaaggttgtattgaacattggttcagcagtagtagtactcaatcccaactggccatgaatggtatttctgggcaccaaccctgcgtaataggcatgtaataatatgtgagataaattgtgttatgcgaatttcatgcgtccaatttggactgagtttatttccagaaaattcaaaggattgagttgttcagtggggactggggacagacgaatttggaacgaactaagttctaggagttacctatgagtatgagtccactgtctacatcttcatttctgtttttcaaagcactgtaatgacatgaggtacaacatttgtttcaggtctttatctgatgttaacgtgcaaatgcttatgaacttggagtttaagtgagcaattcatgattcaacatgaaggcattttttctttttttttctcgaatagacaggagagctgcatatccttccatataagaagaagaacaaaaataacatgaaggctttattttccaaaatatcaaactttgatttcttttccctaaaaaacttgtactacactaaagctctgcgatatgtaaataaaaaatcaccaggagtggtaacattgaactgaaaactaggtattggcaggatcatgttaccggaatttatacttggactcttggagaacaaaaacttcctgtacaatatgcttagctttccagaaagcagcgtactgccattacagcatccggttctgattcccacttatcacccaattgccactgtgtggtatttttcctatatatcctaatatttctgttcttccatctggttgtttcctgcaaacaaaaaaaaatccctatccatttttatctgttagcgcacttgttctctgaataagtttagctgctcaccttactacttggtgtagttcttaacatatctgaaccaaacatggtatgcaagtcatgcacttcattttcagtcttgcagaacagaaaaatcatctgaatttttctatccaaaagttcagtgagcaactcatacacttcaattatacaggatatcccttttttttttgcaggagcagc

SEQ ID NO: 55900 - DNA, 1501 bp, Oryza sativa
cctaggacaataaatctgtacatgagattttgagtggatgtgatacatcttaggacaatgaatcattgtactacttcctccgtccccaaaataagtacagccatggttttccgcacccaactttaaccgttcgtcttatttaaattttttttgaaaaaaaattaaaaacataagtcatgagtaaagtactattcatgttttatcatctcataacaacaaaaatgctaattataaaaaatttcgaataagacggacaatcaaagttggacgcggaaactcatggctgcatttattttgggacggaggtagtataagatgtgtcacatccgcacaatatctcttatattataaaacagagggagtaggatctagacagagttaggatagaatacaatagaccaggggtgtgtttgagtagaaggagatcggggagattggaaagatacgcaaaacgaggtgagccattagcgcatgattaattgagtattaactattttaaatttcaaaaatagattaatatgattttttaaaacaacttttctatagaaattttttgcaaaaaatacactgtttagtagtttgggaagtgtgcgcgcgaaaaacgaggcgctttctcaccctatatcacacaaacgaaagcagcctaggagaccttatgcgataatacaagaaaaccagtctagcaatcaacgtgcaattttgtacaaatactctcctccaacccttgggctcaattagtggtaactgggctgggcctccgtgggccgcctatttcgcaacagtccagttagtctggtgtttcagcccattcagtaatacatgggccaaggcagattagagcagggtccaataaggtccataaagacccgagcaaacctagggtttatgagcacggagcgtataaaagcgagcctccacgccgccgtccctccctgcagccaccaccaccacccccacaccggagcacagcgaggcggcgccgcagccccatcttctccggtgagtcttcgtccctcaccctcgccttctcttacggaaccctaaaaccgtatgatctctactagtacgatggatggatggatagctcttagttttggtcagttcgatggcatttgctcgttctgctcgttgtctaatatcttctacgatcctatccggctgttggtccagtagtattactgcaagaactgtaagcttagttcgagatttttcttgtagacgatttgttacctacttagattttgtttactagcgggttatttgtttcgctcggttagatctggtaatataaaacgagccatgtagcgattttgatgtgtgggggcacgaactgttcttgtcacgagaaaggttgtaccccagatttcatttgcaatcgatgccaattctgggcaaatgttgcgttataataatcatatatatgggtcactttttcctgctgatcattagttacaggatcttacagtaggttgttggttttggttatgtaggcgaagcgaaa

SEQ ID NO: 55901 - DNA, 1501 bp, Oryza sativa
ttttttcttgatgctttatggatccgtggtgcaaaaagtatccggtgttgtcccctgtaactaatgtttgaaatttcaattgcaaaccaaatatggtgggttgatacagaggatgtatttttatctttttttttaacaaaaaagatttagactttaaatctatcctctgatttcagccggattcaccaccgtgtatatatatatgcatatactgcgccaattggccacagagagattataattactgcatctccatttttcgtagttgagcgacgcaacaacgtgcagctactagccagctagtctttttgctcagctggtgtctacttacctagactctgctacgacacttataattaaataaaaaacgactatacaatatatacgattatacagtcgttataccgtatacatacttgcctatagctttgcttctgtatgcgtacaaatatacacgtacaagtacaactctctcgtatatatctcttcttctcggtgtcgagctctcgatcgtttcaggctccgagtccgccgccgaccatgtactgcacggcgtcgcggatcacccggagaaaagcggcgcaggggatcggcggcgcgagcgcgacggcgacgttggtttcacccggcgggtttccggccggcgtcggcggagcgggtcctggccggccgcaacaccgcgacacgccgtagttggagagcggctgcaccggcggcgtgttcgggtcaggcggcgggggagccttaggccacggcctcccaagcaatccgccgacgccgccgtcgtcgccgccggcgagctgcgtctgcgtcggcacaccggggtgccaaggagacggcggagtggggccgcccggcctcctcagcaatccgccgtcatcgtcggcggcgagctgcgtcggagtcggcacaacggggtgcgaaggaggcggcggagtggggccgaccggcctccccaccagccatccgccggcgagcgtgatcggcccgccaggcgcaaaaggtgacggtgggatgtgatcctccggccgcccgacacctccgacgacctcgccgccgtcgctcggcaacattagcggcgccaccaccacctgatgaccgagtggccgtgcttggagcagcggcgcgaacgcgagcaggacgacgtgaagaagaagaagaagaagaagcttgcaaggagacgacgaggcctccatggcgggaaggaaagggatcacaagctaattaagctagaaattagccgatcgatagatgagatgaaactctgatgcaagctactaggctgcagctagccacacccacatgagctctgttatataggcaggatttggtacggcgctcgtgtggtcgtcgtggactcgcgtggtgtgcatgtgtgatgactgagtcaacggttttttgcctaattaatccatcaaaagaaagaaaatgctcggattgatttgttaatggtttgacacggaaggaaaaacaagttaatggtttgacacggaaggaacag

SEQ ID NO: 55902 - DNA, 766 bp, Oryza sativa
tatagtatatagtgttagtgagagtaattacataaatgcagcgcctacaaaggagatattttaaataatgaagtatgatcagttgatgatattgatttgggaaggaaagaatcaaatcattaatacgagtgctggatcgaatatcacagcgatcgagcatctgatgtagtaagaatttaatgatcagtcacagcactagattgttaatttactgtgatgaaatatcagtgcattgtttactggagtactagttattattagtactgaaagcagcatcttcttcagatgtcaaatgtataagggaggcgccgaccaagaaggcaaacagaatggctcagaatttgtctacttaacgtaggatccctgggtatagagtcccctgcacagacgtgcattgttcagactgacaatgaagacgatctgcaacgctgactttttcttcttattcatgtataaattgatctgcttcttacgaatttctatgttccaaaacaataggatctagatcggtctaagtagttatatataagccatttttttttgtcggtatacgcttattgaacgtgagaaacctttggttgggccgaaaaaaaaatcgaagcttgaataaaaaaaacccaataacattatatttgaaaatttgtaatacccaaggatccaacggcccatgtagccatgcatgcatgtttctttgcaaaagcagcccatagtagccgaagcccaataactgaccggctgaacgccacagttgatgtgtgtcctcaga

SEQ ID NO: 55903 - DNA, 1501 bp, Oryza sativa
ggcgaaaataaagcctattaatgacctctaagcgtgccattagatagatctcaagatttgaggaattttggaagttgaacggagtcaaacggacttacggttggaaagatattgaatttctaagattattggatttttggtctaaaggaaaaggatttacttaattcctttttttgaaaaagaaaagaaaagaaaagaaggagggggaaaattagacttccctcgggaggctagggcgcggcccgagagaaaaggggcggctcggccgagctaaatgggccggtcggcccaacaaggcggcccagagcgcgcgcgcgggcggggaggagagagggagccggtggaccgggctcacctcgcgtggtcccgagtgggacccgcttgtcggtgacacggttcaccgagcggaacgcgcacgcggcgcccgctagggtttgggggagggacgcggtgcacgcgcgcggttcgcggaggacgcggatgcggcgggcccacgcgcagcctcacggctcgcggtggaccgcgcccgcgagcggggccgtggggagcggctaaccggggtcggctcgacccggtcttggccgagctggcgccgacgtggcgcctacgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatcgcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctggactacggtgcattgggtcgatttattagggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactaga

SEQ ID NO: 55904 - DNA, 939 bp, Oryza sativa
ttgtggataattgattttagttactggcactggttttttcagccgaactcatccacagatcatctcccgacatcccaaatcatccacaatcccaaatcattcacaacaacaaaatcatcatccacaatcccaaatcatccacaacaacatatatagccaacaaaaaatcatccacaaattaagagggaaaaaaaggaaaagaaaaagaaaaacatccggccggccgaccctccgcgtgcgcccggccgcctaccgcccagcagccgccgcgacccctctgtcacgcccctccacgtgcgccctaccacctgccacccggcggccgcgcctccctcagccgccgcaagcccgccctgctcgctcgcccactgccgcgtgcgagaatagagagaggaaagggaaaggataagaaaagagaggaggagaataagggaagagatggttgctagaggataagtacgaggaattatatactatgcaccgatttttaattccggttggtgtttctaatcgggaataaaaaaagtagggggcaaacacttttttaaccgggactatgtttagtcccggttagtgtgttaccaaccgggactaaagatcataaaatggttatgggcttttcaaccgaggctaaagatgatttttagttatgattctttttggaaccggaattattgtggttttcgtccaacccagtaaagatcggttcttcaatagtggtggttgcttgatctctgctctgtctatctctctctccgtgaacttgtgaccttgaccaagagaggagagagagtggagatagttgtggacagatttgagcccattggtggtagttgaggcgaatggagaacagaggatacacttctactatttactagtgcactaccttcgtgtttgtttttttactggtcagagacccaggtttgcgtcgcccacagt

SEQ ID NO: 55905 - DNA, 1501 bp, Oryza sativa
aaaccctactagccgcctccaccacttctcctcactcctcctcttcacctcgtcgctgcctgaacgaggtactagtagtccgcgctccagctgggaatgctgggatgttggggatactaggaatggtaatatgtatctgtgtttttgttattttgcagcaggcatggctagcaaaggcttgacgctagccaaaaaaataaatttattttttttggtaaattactcatcggtgacgggttaaaaaaaagcaacgtcacgggtgcgcataaaaaacgttggttctaaaacagaaaccatcccaataagtcatcggtgacggtctcaaaaccatatcgacaaaggtgacaaacatctttatcagtttgtagtaggggatcatcacggatgaatcatccgtgacaggctctagtttcactcctttgttgggtcaaacctattggtaatggtcttttgtgtcggcccgacatagatcactatcattggtgatggtatgtagcctgagtgcctgacacagataacttttcacatcactgtccaataatccgtgacgcagcctccctccgatacagatgaaggttcccgacacagatgtcttgttccgtactagtacggtgatgtaagagtattactattggttgtctggtttttttttccaaaccaatatgaactgacaatgttactcaatatcatttccagttcaaggattgaactgagagtgaaactaggccattgctgcaaagaaagcaagtatagtcgtcactttaagtaagaacaagacgaggtggaggccgagactagaaaattttaagccaacatgacaccgctctctcctctattctttcttctctgtcctctctatgtcctatacctagcgtcctgagtgccctcacctctctatgatccgaatctgactgacgtgccactactcccctctcctccggcgccaccacctccctttcctctggccagccctgcacaagcttagaggcggtcaaatttgaccaccacaagcttggagttagatcccgatcaccacgggcttagtggtcttggatccagttgacctgaactcaagggtggatttggtggtgacaacaatgatagccttggagggtgtccaccaccgcttccctctagctggcaacattacctatggccaacacaccatggagaaggtgaggactgacggattgaaaatgggagggaggccaaagatcgtcgttccaccagcatgcatgtgggcaccgacagatctacaaggaggctagatgcgatccaccacaccattggagggagagtgttcataatttcttagagggtaagttggctaacaagaaacaccaatttcttcatgttacagatacaattccaaataaccacacaaatgaaaagttaatcgcataattgtgttacatgtatccattttgagtggtaggtcattcaatttccaatcttcccacgatgctataggattccttcaagatggccacaaggccctagg

SEQ ID NO: 55906 - DNA, 1501 bp, Oryza sativa; identical to SEQ ID NO: 44563

SEQ ID NO: 55907 - DNA, 1501 bp, Oryza sativa
ccaccaggcttccagagctgcggctgtggcatctgctccggcaaggcggcagcacgaccagccgccatggcccaaatgggcaggcgcgcagcgcaggaagagcagagacagaggcagggtgggatgaatggcacaacagcagtgcaggcgtgcagcacccagcgacgacagcaagcaagcgacaagccaacaagccaagcatccatcactccatcaacaggtgcctacatatgtgaacattaatcaatctttggtactatatctatctatactcagtactgtacttcctatttgtgatgtattgttgaaagcatgaatcttaggaagttgaggtattttttgagtacctactcttctatctagtttacaaatagatgatgaatcatcaacttataattagttcttgtttaccgtgcttaatgtagacttgttgtgataatattgcatcgtataataacatgcattgagatttttcgttatgtgctaacttctgtggtaattcgtaggccacacctaaaattttttccgtcctccgccactggtgtggctgtgatgcatcaagcgccggtggttgatatggccgagacttctgtgccgaatcttggcatgaagcccaagatctctgaacggacaagcaacaccaaggccacaatgggcacaaggtgagcttgtttatttcttgtattaaagaaagctgaacggttctgctcgttcatagcttgatgtcacattccttttaatcttagagcaagagatgcttttgtatgattaaggatgaatctggattcgattttgtatggaataactcttcatttttgtgtgcaatatgtggactaaggctaaggctaaataatacttttgattaaggatgaatccttacggatgctgccgtcatgcacgttgtccacctgtgcgttgtcatgcggcagataaacgggctggagcagcaatacgtatgaacataaggtatttgctataatcgtaggctttagtccagacatgataattttgttgttgtcctgaaatttattatctttattttatagttgctgctcatacaatacatgtgaggattctaccattaaatgcacaatgacccaatttgaggatcagtttagcactataaaacctgatgggattcaagtcagatgccgtaaggtacttgttcttttttgcactggacttcggacaactctgtctgtttctatcaatgaaactgcggccaatgttttctaacgtaaatgcaatgccccgcgggggtttacttgagtctactaaattttgcttactcatgtattataggattcatagatacattatgccactggggtacatgtaattcaagtacaataagaaactactcaattgtttggcagcaattttgcatcatcagatgctgaatagtaagcactcctactcaattaggttcagatgatattttggtgacactgaacttgcgaccattgtgcttgtgggatgttatttaggtgctgctgtgctt

SEQ ID NO: 55908 - DNA, 1501 bp, Oryza sativa
ttgtggtgggttttttgtgtgtattgtgatgtgtatttctttgagacatgagtcattaaagtgttgatcgacgatttattatggcaaattggttatcttcattttgtcagcactaacaggcatacccccactggcactgcctatccttccttcgataattatttccttataaagctgcttcgtttagcctttagcttataaatataaacgaaaatttaaatttaaaacttaaatttatttttttgaattttcaaaatatattttaatcttctttatttgtttttaaaatcactaacaaacacgtatataaatgttttactcataaaatattatttaatcgttaaataataaactgttttgctcgtaactataatcgtgacaccccgtttatagtctctgggcaactcgacccatgatccatcgtgcagttaattagatccattgttttgattgggaagcacacacacatatcgagtgttcattgcctttttcgttttttttccccataagcttagattcgcacatgctaaaaacccacttgattaattagcccaaaagtaatgcatattgaacgtacatatcccattccatgattcttcgagatcattgtttatatttttaagccacttcattgtttttttaattgttaaattagatgcaaagtgctattctggcagaaatctacctaataactacgggtgaagacagtgggggtcacttgttattaccgagaggactaagtacaggccttctgcaagaaacacgtttcagctcaagtcacaaacgcgtgctctgctcttttctttctcttatttttttttagaattacacaatacaacgcagacactcgcaatgcacgcgtacttaccccctatgaacgcacgcaaaccctacctctacgagcatcttcgaagactgggccggcaagtcattgagattgacgaagtcaccacaggcgtctcgttgtcgacaggtacattgcctaccactgaatctttccatcacattattgggatgtgctccctccgttttttcaatatacgatgtcattaaccttttaaaacactttaaccattcatcttatttaaaaaatttatatgattaatatttattttcttgatttgaattattattaaaagttctttaaacataactaatattttttatgtttgtacaaaagacaacaatgttatattgtaaagaatggaggtatatatgttgtgacaaagtaataaattaacagattgtcaaactgtggactcagagtacgtggttttcatactttccctgaccatgtagctaccaacaatttcaacccaacatacatagcccacaaagtgatagtcaagccatgcctgaaacaaaaaagtttgcttaactaactggcctgagagtcatatcttgcctactcgttcttctttttgttccctgaagaacactgattcagataaaccagagaccgaatgtgtcactctgtgctagagctctgcatggtctccaa

SEQ ID NO: 55909 - DNA, 1501 bp, Oryza sativa
catttctctagtgtgtggattggttataagttttacgctttctttaaccactcttatttattgtagtctattagggattatggaatatcaaagttctggatacatgtgtagctcacgattcaatgacaaacatagttgtcggcaagaattcttagagtgtgttttcaggtcaaaaattaaaagtttggttgaaattggaacgaagtgacggaaaagttggaggtttatatgtgtagaaaagttttgatgtgatgaaaaaaattgaaaatttgaagaaaaaatttggaactaaacaaggccttaatttgcaaggaaaatttacaatgtgagctacctccaccagatgaatcaaataggtccccgttatctacatgtgcattttgcctatatttttcccgcatttccccaactgctcttattcaagccagtttattagctaatttggtggaatatcaattatagtatggtacgtcgaactttgtaagatgtgaagaacttgtcaaagttctgggtaggtgtgtactcgctgaagatgccattgtctccgggtatcactacttgcaaggacaaatgacaattaattgatgagctaccgccacatgattttaacgcatgttttcaaacctctcttcgtcgttgtttattacggaattctaggaatctcaaagttctggatagatgtgaacgtacgtagctctcaagattccattgcttaaaaaacagggttatatatgcaagaatcctttgcacgttacccagatgcgcaatgcctatatatatttattacgcatttcttcaactgctcatattcaaggtagtttattagccaatttgagataatatcagtgatagtatggcagctcgaactttgtaaaatgggaacaacttgtcagagttttgggtagatgtctaggtcgaacaagattcaatttgtttcacaaatacgaatcggattctttattagtttttacgaaattgataatacacaattctgaaattacggactttccatttttaatttgaaataactaatttaatttgaaattttgaaaccacaaatgtgaagttgtaactaacgtgtgcgcttcttttagctagagtcagtataataaaaaaaatataaaacctacatatttaagctatgattaaaatttaaaatatatctctatactctataatacccgtgcatcgtacgggttagcggctagtgtaactaatgcatgggctttggaccatgtgtagagctatattttgcatgaaaacttgcacttctctctttttttttatatatatctcctttctacctaagctatagttggcttatactctcactggaaagttgacgtgcaacttttataacttttactacctccgtctcaaaatgtggataggtcttatctcattctaagttactagacgggggagaagtacattgtttttttctattataatatataaaataaataaatatttttttacttttagtacggtactttttttc

SEQ ID NO: 55910 - DNA, 1501 bp, Oryza sativa
ttcagctttgcatggtctccaactctagaaactctagaagcataagtatcaagccaaactctagacacgtaatctgtccagattcgttttaggatgagggagatattgagtagtaaatttgagccttaaaaattttaacaaaacacgttttctttaatactttagataaagtttataataacctaaaaaaaatgtagtaacaaaaaatgatttattataccagttgattaatactaggtgatacccatgctttattgcggaatgaatggatgaatatgttaaatactacagaaatgatgatgttgaaatattgtgaaatgatgtgaggaagatgatttgacatatttatatgttgaactctataatggtatattttagataatatatcacgcttgcatgtgatttaaaatgatctaacaaaacagtttttctatagtactttaaataaagtttataataacctccaaaagaaatgtaggtaataaaaaaatattgattataccaattcattaatactatatgatatcccgtgctttgctgtggaatgaatggatggatatatgttaaatattatagaaatgataatgttgaaatattatgaaaataatgtgaggaagatgatttcacatatttatatgttgaactctacgatattatattttagatgatgtgtcatgcttgcatgtgatttaagatgctctacaatagtaattgctagtagatgatgatgtggtatatttgcatcttgagttttagtttctaataattactagcgggcactaattatatacaaggtattgattccactatcacataatattgctatcactatactattaaatgtatattctagaaaataatggtcgggccttgagcactacattgttcaccttgttgaattataatatgccctacgaaaatcaaagggtggataagcacaacacggaaaagactaattaatcagatgtcatacatgcaagaaattatatttagtgcatacagctatgcatcttgcatgcatacactacacagccacacattaccacacatgaaaggtatgtacgtgtagcatatataacttaattattaacatgtgacagcgactcattttatgatatattgtagtactagctattgtatctataggcttagtccagctagctgtgatctatatatcatcctgcccataattaaatttaatttgcccattggaagtgctcaattacttggactcagtaagtggtattattatttatgtttctctagctatctaaatatataatattatacgtatcaattcacacgttatctttattcaggccaactaataagaaagtatgtataaccaggcataaaagtcatagtccatctaattcggctgcactctttttcccctgtgaagtagactttgtaattatgtagtactacgtaattgactagagatcatgctagtggcatcttgcttgacagcttaatttacatcaatcacaatggctaagct

SEQ ID NO: 55911 - DNA, 252 bp, Oryza sativa
atatatagtttcaaacagatatttttaaaagtaatgcctccggacgctgcaacactagacttgcctgatcaagcatatatgttggagttttttctgaaacacaagtttagatagctttaatgcgcacgttggataacaggggttatattaacaaggcacggcacattatatacggccagaagaagcacgtatgtagggatgaaaacgaaacagaaacggacggaaactagctttatcatattagattttaga

SEQ ID NO: 55912 - DNA, 526 bp, Oryza sativa
cgataaccccttgtcgcatgctaaggtaaacccaattgtctaccctagatactctctcgatatcatagagttgcatacttatatcatatcatagagttgcatacttatatccaaccgctagtcaattcattctaaagcaacttcctccgttctcaaataactcataccatcactatttaaatttaaactttggtccatgtttttttaagaaaaaaactataaaatatgctacgtatattattaaagtgtgtactatcacagatagacccatataccttccatccatcgtaatctaaacatttaaaagtaatttgtagaaaggaaagggtataaaatttttcactatactgaaagaagtcagcaaagacagtgcagcgttacaaaccagcttggacagtgtctgaaagagatctcaattatgggataagcaatcagctggttgctgtcatcgacggtgtagacgcaaaatactcatcctaaaaccatactaacaaaatgaaaaataaaaaaagtaattttctgtagc

SEQ ID NO: 55913 - DNA, 710 bp, Oryza sativa
gaatgcattggggtgggtataatgttcattcgtatgattgctctaagtcataacaataattgtagagtagtatttggtagtataagcgaggtgcttagactattgaatatcattatatggggttatatgctgcgggtcagtcgaggtgggccgctgatagtgatagctcagtataagtattcctccatattagtatataatcctaagttacttttctagggaggttacttctccgtatttagcaccggttggatggccataatgggttgtcgtaagaaactcggcaaccaggagtggtctctcgaaacaccaggagggcattgtaatgggggtattggctatataattatatagcagataatattaactaaagttgtatgtatattagaggtgtaagaatagattattttcttattcttttccattttgcctagacttattatttatgagagaatgagtttttatgcttcgtgtcactctacccttgaattaaattaacacctgcttagactgattattacaagtaacatataaatattagcatagttttctccattataatctttccacgggactaaacaaatatgatacccttgtaatacttccgggtgaaatgctactatagtatatccgtgtgcttgcgtatatgatttgtaaccataatataacataaatatttctgttccattgctgggcattatatttctagt

SEQ ID NO: 55914 - DNA, 222 bp, Oryza sativa
ttggcatgccttgggccgggcctcaggccatattgctatctatattcagaacccatccactaatttgctatctgactttttttttccgtctatatattaaccgtggcatggtgcccgggggtgggggggatacatctcgatgctttgctaggtcgctctagctagctagccagccaaccgctccattccaatggctatgcatccacgcctcttgccgccagt

SEQ ID NO: 55915 - DNA, 1501 bp, Oryza sativa
gagaatcaacatcacaacagacaatcaatcaatcggacgatgaggagaatcagacttatcaatgagtgggccaagaatgcagaaatgacatgaccaattgggtcaaaattcacaagtctgaagtgaacagcagaagaggaggccgccagccgaaaatgggctgggttgggccgtcccctcattcggacaaacccaccgcctggttcggccgaacccgccgtgcagccgatggatccagggttggcgatagacggtgtggattgcttccctatggcgattggagggtattaccgacctttccaaccgtcataaccatcattacctgcttatttaaggccttcatctcctcactttcttcacacacttcgagcaaagttctctcatactctctcaagcttagtttagcattctcaagctagtggagtaggaatagaatagaaatcagagtctggaagtcttcggaagagtttgggcatggctctagcagttctcctttcttcttttgtaagacttgtactttatttagaatattcttctttattcaattctggtattgtaatactttccaagtatatgaatgccaactttactttatattcaagttatattgattatactgctagcttatataggagatgcaatggtacgggtatagtgtttgcttatgtaattactctatgtcatgatgatgatattagagtagtatctggtaattaggcgtggtgtctaaattactgggtatgattatttgggttatatgctacggaagagaggtgagtcgctgatggtgacaggtcagtacgggtattcctccgcgtgtgtatatagtcctaagttaatttcctggggagggtactcctccgtatttagctccggttgtatggtcatgacgacctgtcgtaaggaactcggtagtcaggggtggcttctcgaagtaccaggagggcatcgaaaagagggtattagctagttaatcttatagttaggatgtatgtataagatgtatactagaaatataggaatagattcttttctcttttctttccacttagcttagatgatttaatatgaaaataagtagtattatgcttgtgtgtcattctaccctatgaattacattaactcctgcttaaactatggttattacaagtaatatataaattattagtacgattccctctactataatcttcccacgccaaaatttggaataatttttaatcacgataaaacaataattaagacttcaaacagagtgtaatattttttaattaggaattttaaaactaaattatgaagatgctatatatatttgagactactccacatggaatacaacttgatatttaataactacgaatataggtgtcgaaacatgatttcggcaataataaaagggggtagcacacgagacctaaaagtggatggatgcagagacaaaggatttagacaggttcaggccctctcaatgagaggtaataccctactcctgtttggggat

SEQ ID NO: 55916 - DNA, 1501 bp, Oryza sativa
  unsure (1)..(1501): unsure at all n locations
cttcaatttcaatgatcatacctactattgccaaacttaatggtatccttttcaaagagttcatagtaacggctgggctcaatacgattctcctgaaaaaaaaatcaaaacataaatattgactgggtagaaaatattattagaaacgcgactagtgtatctgattagtagtaaaagtatcattggaggacttacattaatgaaagttccattggtactaccaagatccatcagataaggcctatcaaacaaagcagcaaaaaacatcataatctagagtagcatacagaactaagataatcatgaattattagtacttgttattaaaaaaaattatatgcattactagcaaggagtacctcacttgctttgacatcatgccatctggctgctccttctctacaagtctgaaaaggcaaagagatgggtgaatcacaatattatttctcaatatatacttcttgtaaaagggagtagtggtgatggtgagtggtgnatntnccaccaccccaccaccagctccctagtttttttaatagaaaaggggggcctacatgtcaaccacccctaccaccaacttcctactttttgtgagaagaaaaggacagtgcacatgtcagtaacaaatatatacataaattaaggggcgatatacacagaaaatgataataataatgagttaatgataattttctttatttaaaatcttgttgccacgcacaggcaatatgctaataaaggcaaataacaataagattgctatgcttacctatattgaagaactgcatgttgtttactgcaggagggatgatctatggggatgtctgcaactttccgttcccttccaaaaaggtagctgctcatccggtgaacatataatggttctgatcgatcaagatagcatcataagacacagtcaaacaagaagagcaaaactgaagtatttaatcactaacgtaagcatgtgaatttttttaccaccctacacatttaatttataccactataatgcccaacctttaacttgctgttcatcacaataaacttcatcacttcagttatttcacttccgttcaaaactaaaactaatgagctatccatacgataccaatgctcaaacagtatcattggatatattcacaagccagtgtatactgtatcgtaaggaactgaacaatagcaaagcactaggcaggcttcattattacaaaccaatggaacaaaaagatgaggcttctgaaggatgaaaaccgtatgaactaggaaggggcactgtgtgcacacttcaaaatctccacagctccgaacatatgttatgcagtaggctggaccaaactggcaaacaattgcatggatacataatgcatagtttgcttatcagaatcaaatgctctgaataaggatgattctatgaaaaagtcataccgttaatctcacttgaggttaaggtgatgaaaaggttctataatgatgtaattttttactctctggagttttcagt

SEQ ID NO: 55917 - DNA, 1501 bp, Oryza sativa
aaaaatactttacagatctatcatgctttaagattggtgaggatacatgtacgtgtacgcgtacgtggcacccatttagccagctaggtaggatggtgctccacttggtgcggtttagggcggaggcttcacaccccggactactttcgccgttctaaaaaaacataacctataaacgaaatatgatataatataatacaataaatttaaaaaacatttagatagaaattcatcccattttaggtgtttttttatacagttcctgttccttccgtgtcaaaccattaacttgtttttccttccgtgtcaaaccattaacaaatcaatccgagcattttctttcttttgatggattaattaggcaaaaaaccgttgactcagtcatcacacatgcacaccacgcgagtccacgacgaccacacgagcgccgtaccaaatcctgcctatataacagagctcatgtgggtgtggctagctgcagcctagtagcttgcatcagagtttcatctcatctatcgatcggctaatttctagcttaattagcttgtgatccctttccttcccgccatggaggcctcgtcgtctccttgcaagcttcttcttcttcttcttcttcacgtcgtcctgctcgcgttcgcgccgctgctccaagcacggccactcggtcatcaggtggtggtggcgccgctaatgttgccgagcgacggcggcgaggtcgtcggaggtgtcgggcggccggaggatcacatcccaccgtcaccttttgcgcctggcgggccgatcacgctcgccggcggatggctggtggggaggccggtcggccccactccgccgcctccttcgcaccccgttgtgccgactccgacgcagctcgccgccgacgatgacggcggattgctgaggaggccgggcggccccactccgccgtctccttggcaccccggtgtgccgacgcagacgcagctcgccggcggcgacgacggcggcgtcggcggattgcttgggaggccgtggcctaaggctcccccgccgcctgacccgaacacgccgccggtgcagccgctctccaactacggcgtgtcgcggtgttgcggccggccaggacccgctccgccgacgccggccggaaacccgccgggtgaaaccaacgtcgccgtcgcgctcgcgccgccgatcccctgcgccgcttttctccgggtgatccgcgacgccgtgcagtacatggtcggcggcggactcggagcctgaaacgatcgagagctcgacaccgagaagaagagatatatacgagagagttgtacttgtacgtgtatatttgtacgcatacagaagcaaagctataggcaagtatgtatacggtataacgactgtataatcgtatatattgtatagtcgttttttatttaattataagtgtcgtagcagagtctaggtaagtagacaccagctgagcaaaaagactagctggctagtagctgcacgttgttgcgtcgctcaacta

SEQ ID NO: 55918 - DNA, 1501 bp, Oryza sativa
cgccgcgtacaggatccgacgcccgtatgagatgcttctggtcggctgcaattccgccgccaagacttcctggacgaggatgaggaatcgaggatgagcgtgcgtggttcaggatggaggatgggcctacgtgatctgtgggggcgatggagttttctcgctcgccgacgagaaatactcagattacgctagtggaagacgccgtccgtcggtcgacgaagcaccggagggtggaacgaaggaggatgcgcacgggatcggataagtgaccgtgggacccacaaaatatgtttttaatcgtgagtgcgcgtgaaaacgcgtgctatcgccgggcgccagattagctcccgctccgttctctctcatcgattctcttccctccatctaataaaaaaaaacaatataatagcttttggagcctgctgactaggattattgcatctgctcttgtacgtgtgtatggcgatcgagtggcagtcaacggtttatttcttcctaaatcatggagtattaaaaataggacggctaatgacttggctgtgttgggtggtgggggttgggaacccatcattcacgcacggaaaacacaatggtctattaacgcgtgattaattaattattagctatttttttaaaaaaagataatataatttttttaagcaactttcatatataaaccttttaaaaacacaccgtttattagtttcaaaagcgtacacgcgaaaaacagggggagttaggaactcctgatatcgaacgcagcctaattaatgtttaaactggaaaggaacacgacgcaaacagcgaaaaccaggtaattaaacagcgaaagctacccgacgcaatttttcgctagcacctgttcaacagctactccaggaagcaacagcgaaaaccaggtaattaaaccagcgcgtgcatcaggctgcgtgcatggccggagtgtcaaacttcggccgtgtttagttcacctcagctaccctaaacttccaacttttcatcacattatatcatatccaaaactttcctacacacataaacttttaacttttttttcaaacttttaactttccccaaacttccaacttttttcagcaactaaacacagccttctgcgctcactcgatcgatctggccgtgaatagctgatattttggctaacagttaggcgtgaaatgagagtacgaatccatcaaaccatacgagcattcgacgattctcctgcacgcaccgcaaacgggttgctatggatggcttcggagcccacggacagcttcggaggccttgatcggccccagagcacttagatgacctcgaaggccttggatgaccccggagcccctaggtggctccgaaggcctaggttggctccggagcctctggttagctccggagcctaaatcagtagatgcctccggtcattctcctggggtgaatggctccggtaggtgttgcatcacatgacggaggctggctccgctacccggagccattcccccaa

SEQ ID NO: 55919 - DNA, 1501 bp, Oryza sativa
cttcctcctcttcgctcagctgttgcaagcacggatgctaggtaggcaacatagacgctttcactcgcatggatcacgtgaaaatagagagaaacagagaagagtgcatttcatttggtagctaatttgtcattcactgacgaaacgcatcacgcattgaccatgtgaaaatattataacaatggtttgatagctaatttgtctgtcctacactgacgaaatttctcctgctgttttctcgcttcaggagaagcctactactcctatccacatcggatccggattaaatgcagtagtagtatggactgcaacttaagcagttgtagctgctacgttggatctaaatccaacggtaaggattaggccggttactgtagcaaaagtaccacggcgtaaaatattgttcagggtactgtagcacgagtactgtagcagttgatctggactgttgatcacaaaaatgaatggctgaaaatgcatgcagtccctaagactgcacccgatctcaatccatccacatcttcgtgcgtcggcgtggcggagcagcgtcagcacggatgacggtggtgcgctggtgaggccgtcctcgtacaccccgccgtcgccgaagcacccggggccgcctcaccagcacggcggaggtggtgcgccgcccgccgatgtggtggccggttgctgttgctccgccgttggcaggacacaatggccggccaaccaagcccggcagtgtacacggcttagttattcgtaaccttgatgttacaaggtagccaactctgccattcgtgtgattggaagcccgtttgtttggggaatttgagagccatccggtgagaatatggaaaaactaaatcctacgtttcttaaaatctaagtaaaaggttagactatttgaagacccgaagattctaggaaaaaactgtagttacaataagctcccttaaacatgatttgattatgttgtcaattatcaggctggtttggtttgtgtcataaattgattttaccaattttcgtccatgtctaattttagcaagttttagcatggctgatcttagtaaggtaaagttgtgtttgaattaaagctaaaatagcctaaattaactattgaagtgacctatttttcttaggtttgctaaaatttggcttcaaaccaaatagacactaagtactactccctccgttccagaatataagtatttttagagttggacacggttattaagaaagtagatagaatttaatagaggaaggttgtgattggacaagaagtggatgtaggtgaaaaatttaaatggtggaggattgtgattgattgagaagagaatgttggtgtagaaattgttatattttgggataaattctagaggctaaaagttgttatattttgggacgaatgcagtattaaaattatcaaatattggtaatatcaatatagaccacagaccaaaccagcccatcaaaacttcagctcctcaccatcaggcttccaagacctgct

SEQ ID NO: 55920 - DNA, 523 bp, Oryza sativa
cgacgaaatagagcaggtactgtttcctcacttccttcaacaggagatttttcactattttcctaataatttggtgttttttgttcacagagtgcagttgaaacaatgaagcaattggcttatgcgaatataagtggtattcagtatgaccataagatggtcaacaactatcctgtaccgcttcataggttccattgtgggggaacttctatgttgactgactttattcctaaacagcagatcccaacttgtggtaatatcttgttctgagaatttcaatcactagcgataattacttttttggggatttttggtcatctattccaattgtttacaggtcaatacaattcagccctggctggtcaaccatttgaatcaacggagaacttttcttcattccaagaagcctctaatgtaaggaagatattttgaaatatacaaaatacagtacataataaaatacatatgcatgttagtctaagatagtttcatcaattttctagcaggcttcagtggatatgtc

SEQ ID NO: 55921 - DNA, 1501 bp, Oryza sativa
acgccaaagtagagtggggtgtagttgtcatctaggcttccgtcgaagtcgtcgagatccgggtcgtggtagcgagagcaaaactcgtcgtactccacgacgtcggtgggacgcgagtcgacggtgggagagctgtagtggctatccagctgatccgtcgaaaccgtgccgagtggttggaggatgacaccgacttccctgaagctaggtgaaatcggtgttgaagccgacttccgcctaggcctacgggatggagacgctgtcgtgatggagatggccgccaaatcgtcggggagcttcatcaggatcggtgggtaagccccatcatcttgatctggtgacgttggagaagatgcaatctcagccgagtggtttgaagccgactcgattgagatggtcttggagtaactttcagccgcgtttgggagtccaaacgggactgagatccagttctctcccgactggtccgactccgagtcaaggagagagatcttgccgaagttgttggtgacgaagtcgaggctgccgaaccgaaacatctgcccgggcgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtcgagaccgggaaaattgccttttcccgaacgctagtgtattaatccccgtcccaggaaaagccggggtacaccatacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagggagtacaaggggataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttaga

SEQ ID NO: 55922 - DNA, 159 bp, Oryza sativa
taattattagcgtatgattaagaaaattagtcattcaccaatgattaattattattaattatttaaaattaaaaaataaattaatatagttttctaaaggaacttctctaaagaaaattttttttaaaagaaacatatcgtttagcagttcgagaaaca

SEQ ID NO: 55923 - DNA, 1501 bp, Oryza sativa
ttagccaacttaccctctaagaaattatgaacactctccctccaatggtgtggtggatcgcatctagcctccttgtagatctgtcggtgcccacatgcatgctggtggaacgacgatctttggcctccctcccattttcaatccgtcagtcctcaccttctccatggtgtgttggccataggtaatgttgccagctagagggaagcggtggtggacaccctccaaggctatcattgttgtcaccaccaaatccacccttgagttcaggtcaactggatccaagaccactaagcccgtggtgatcgggatctaactccaagcttgtggtggtcaaatttgaccgcctctaagcttgtgcagggctggccagaggaaagggaggtggtggcgccggaggagaggggagtagtggcacgtcagtcagattcggatcatagagaggtgagggcactcaggacgctaggtataggacatagagaggacagagaagaaagaatagaggagagagcggtgtcatgttggcttaaaattttctagtctcggcctccacctcgtcttgttcttacttaaagtgacgactatacttgctttctttgcagcaatggcctagtttcactctcagttcaatccttgaactggaaatgatattgagtaacattgtcagttcatattggtttggaaaaaaaaaccagacaaccaatagtaatactcttacatcaccgtactagtacggaacaagacatctgtgtcgggaaccttcatctgtatcggagggaggctgcgtcacggattattggacagtgatgtgaaaagttatctgtgtcaggcactcaggctacataccatcaccaatgatagtgatctatgtcgggccgacacaaaagaccattaccaataggtttgacccaacaaaggagtgaaactagagcctgtcacggatgattcatccgtgatgatcccctactacaaactgataaagatgtttgtcacctttgtcgatatggttttgagaccgtcaccgatgacttattgggatggtttctgttttagaaccaacgttttttatgcgcacccgtgacgttgcttttttttaacccgtcaccgatgagtaatttaccaaaaaaaataaatttatttttttggctagcgtcaagcctttgctagccatgcctgctgcaaaataacaaaaacacagatacatattaccattcctagtatccccaacatcccagcattcccagctggagcgcggactactagtacctcgttcaggcagcgacgaggtgaagaggaggagtgaggagaagtggtggaggcggctagtagggttttgctgcccgagctatccctcctggagtgatgcaaggttcttcgccaaaattccctcttgtccataataattgaataggttaccgatcatttaaggagaaagtgtacatatattgtatttagtagtcttaaagactactacttttattacaactatccagctatgacaact

SEQ ID NO: 55924 - DNA, 613 bp, Oryza sativa
tttgtaatatttatttacgctttttaattcgtagtttattttgaaatatttagttttgaattattaagagtcccatcgattgacctaataagctaaaataaaagccaaaatttatatttctggatttgattctaaagttgattttaaaagtaatttatttttagcattggcttttaagccactatgaacaaatatataaaagttttacctataaattaaattttattcttttattcctaaataaaccgttttgacttattaggtaatatgagcaaccgatgaggctctaaattatttttttaagttacttataagcaatgtgaatatgataggtaaaccttttatatatatttttaagttacttataaaccaaatgatatggctgatcagccagccgctgtcagcattccaaacgtgtctgtgttcttatcacagttttcccaactcctctctctcgttatccacgcgcacgcttttcaaactactaaatggtgtattttttagaaaaattttctatacaaaagttgttttaaaaaaatcatattgatttatttttttttaaaaaaatagctaatacttaattaatcacgactgcttcgtttttcgtaccaga

SEQ ID NO: 55925 - DNA, 733 bp, Oryza sativa
caacgagaaaccatgtgataattcagttgagttggacaaattatggactcccatatctaatttatgttgcatttgcttagattttagcttgttaatgtgcacgtgcgattgtttgaattggtaacttataccagttgaggtaggaaattcattgatggcttatatcttcaaatctatttggtaattgaatttataggctattttccattaggtatgatctgtgttgaccattgaatatcaatggcatcttgtggataaacttatgggcatcttgtgaattttatgggctctacttcgattttactattagaaacgcctaggaacatatgctatgctttttataagcattccctactttcctaaagataccagtgcactttctcaggcaaacttgctttggcctctatattgcgttatgtggataatacagtgtatgctaggtttattatggtttatttaaattgcacatagttcatagagaatgttcagcatgcattaatgaccggatgtggtaggttcataggctgcacaactttgattgcaaattaccttaggttcaaatataacgctttatagtgatggaatatgtagtgagttatgcaagaagaatatctacgaggttctgaaattgctttgtttaaagaatgatttggatctttttaatctaaaatatgtcaatcatatacagatttgttaccataaattccctcatcctttttttttttgaatcata

SEQ ID NO: 55926 - DNA, 1501 bp, Oryza sativa
tgcgagaccgtagacggtgagccacgattcggggttagtggtgccgtcatacttctctattccagtcggtttgaagccggctggccaatccactcgacgcaggtcgtctgtgaaggctgctactccgtcaaggtcgtcgtcgtggcggtccggcgagtgatggtagcctcgagccgctcggcgctgtatgattgtgtcgcgaagatcgatggggcggcgacgaggtggtgagcgaggccgttccactcggtgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacactttcggagttaactgggaccgaggccgcaatcatggtcttcgtctggttcaagatgttgacgacgtggtcggatcgattgagctcgttttggttgaggagggtgtcgagaagggtgatcgcggcaaccgcattctgttgaggggtacggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgttgaagtcgttgtagcgagaactaaattcgtcgtactccacgatgtcagtaggacgtgagtcggcggtgggagagctgttgtagtcatccagctgatccgtcgaaaccgtgccgagtggttggaggatgacgccaacttccctgaagctaggcgaaatcggtgttgaagccgacttctgcctaggcctacgggatgaagacgctgtcgtggtggagacggccgctaagtcgtcggggagcttcatcaggactggtgggtaagtcccatcatcttggtctggtgtcgttggagaagatgcgatctcggccgagtggtttgaagccgactcggttgagatggtcttgaagtagctttcagccgcgttcgggaatccaaacccgaccgaaatccggttctctcccgactggtctgattccgagtcgaggagagaaatcttgccaaagttgttggtgatgaagtcgaggctgccgaaccgaaacgtctgcccgggagggaagacgaggtcgtcgatgccggagacggaacccattgcgctgatcggcgaaaagcttgacgctacccctacctggcgcgccaactgtcgaaactagatttcggcaataataaaagggggtggctatcaagctagaaaagtgtatgggtttggagacaaaaga

SEQ ID NO: 55927 - DNA, 881 bp, Oryza sativa
  unsure (1)..(881): unsure at all n locations
aggtccggaatacatccaaaagcagaaatagataaggcagcagaattcaggcagcggcatgccattgccacaggcaacgaccatactaagacctactggacgccttcgtcttcatctccctcntgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccatcccacacaagttaagaatttagagtctagccaagtgtaatacatgtcccggtgctcaataaccgtgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaggccctcatgcactctaggcgtacacagtttctagcagtgagaggagttttggcgctcccaagggggaaaactcacgcaagcctaacatcgcattctgtagttgaacccaatccacgctgtccccttttgggtatctccttgtagt

SEQ ID NO: 55928 - DNA, 1476 bp, Oryza sativa
ccactacctttacttcaagtggtcgagtggggctacaactggtttttgaccagaggtgtagcgattctcccactacctctactccagcaaaattggtataaggtacacaatattgccaagtgttttacccagagatcccttaccacgacgacacctagcgttgaaacctatcctactgtccctttacgtcgtcttgacaaggcctccgaggaacctaaggaaacttcggctggggacgcccggagccgataaggccttgtcggatcctgtagagacaaaataccatgtaagatctggtcatgtaagagttctcgccgtgcgtattaaccaagccgtgtaatcggaaattgagtttttcaacttcacggctgggggctagggtcagtgcttttttcaaccgaggcaggtcaagggtccaagagccttatcctctgagaacgattctccgacgacaaggcttgggggctagggagagtgtatgactcaacaaactgactgatcgaagtcggtaaaagagaagacactcatatacaaaacattggtttgtaaatttaatttattttcagtttttcatacatattataacatgtcaccctttgatcgctcgctcgggggctatttctatctaatattgttttctaagtattgatttcaggaaaattctatttgacattgtcgaagacttcacgtctctatggttctacaccaagatcgactaaggcgagtacgacaaatgttgacaaggcttcgtcgcagattctacgccttctcgatcgctcgagaacggttggtggatctcgacaaggaatacaaaatgaagagatggtgtacccgcctagataaaatttcttgacttcaatccaaattctcgattacagcaagacgggagacctagttgtatgctatgtactttcttggttgacatcggagattgactcagacaaaccctataggtgcccgcacgaggctgataaaggaagtctaacgttatctctgaactcaccgagaacggtcacttgagctcgataacagttactccatggtcagcggtcaagaatatgaattcgttcatttacattgaagtcgggggctactgtcaggattatgaataccacatacctaatagtagtcgactacatctcggcaggacccaccacataccatgtcttatacggaaattgacattggatatggacggagttctagataaggaaagacaaccagagttctacatggaaacgacaaggactactcacattgtatccatattggtttccctagttctacttggacaagggggcacttatgggtataaatacaagaccccccgggaagggcctggggcatcgaatctcaccgccgatacacccaccacaatatacggaacaacagaagccacaacatacaagctaacatacgccaagacaagacgccggatatcgacttcagggataagaacggctagttccctacagt

SEQ ID NO: 55929 - DNA, 1501 bp, Oryza sativa
tcattccttttctccactctcataacaaaatttcttttaataaatgtttagagtcaactctgagctgttatatgcatagcaatcatacttttcttttctctcctctctcttccacatttttcttctctcctctctctttcacatcatcaaatttacttgtatggcaataaagagagactgctattatacacggttgtacatgctctaaggcacaaccactcctgacacaaagagcaagaaagaatttaatcacctccttaattgaatcacatccgtacatgcaagtaatgtgattgggagacttaatggtacatgaattaaaataaaccaaatttaaagaaccaagagatgataattaatgtatgcatgcacgccttatattatgagacataataaaaaagtggttgtgtcttatattttaggatggagggagtagctaatacatacaatagttacctataaacatatactacactattgatacatggtcccacttgccctacacatattgcatcttgcagtccgtgctacggctggctataaatctgtagcccgctgcttgtttctctccccgatatgtgtttatagctgacttatagtctggtatcactggtggagaagtagtttttactcccggttcgtaaccccctttagtctcggttttccaaccgggactacgaatccgggactaaagatcgctatctttagtcccgggtgaaataaccgggagtaaaaatctatctttagtcctggttggtgttaccaatcgggactaaagatggagcatgccaaccgggactaaagatagagccaggctgatccctggctgctcctttattatattcttttcttcattgtttttaatatattgatttcactccatccccatccccaaaatcccaaatcaattatcacctccaaatccttaaatcgatcatctccaaatacatcacaaaatctttaaaaaaaaattacatcacaacttctacaaaattcatcacaaatacatcacatattcatatcacacacaaatcaaatacatctcaaatccggatcataaattctcaaaaaaaaaaaacaaaacaagccgccatcttccacctgccgcccagccgccaccttccgccttctgccagccagtgccgcgcgccggccgctgcttgttaatggctgcaataatggctgcaatctaggaaactaaataatggctgcaatgcagcatgcaagacactcatctatagatagccaaaaggcctgaggcccgacgcttggcccacggcacagcattttggcccggcccaagcacggcacgacccaaacggggtcgggcccgtgccggtccggcccaatcaccgggcgtgcctggcccctccaccggcacgttgggccggggcggcacggcacgatgggccgcaggccaggcccgacacataaacaacagggagtaaaaatagacattatatgccacggtcgaagaatagggacgtcaaatagacttatt

SEQ ID NO: 55930 - DNA, 1501 bp, Oryza sativa
gaatcgtgccattgccgtcaagtttctatccatctccatcttttttttttccgtttcttctttttttttccctcccatcttctttgctttgcttggcggctgtgtatgatgtccggccgcgcgatcgcgggggttcagggcaccaacgccgccgtggccagcgcgttgatttctcctcctgccatgcgtggttggtggccagcgcacggcggcgtggcggcgggcgcagcaggcggggcaaggccgcactgcggccggcagcccggcacaaggcggcgctgcgggcgacggcgggcgcagggtggtgcggtggccggcgcaagcacggcgggcggctccctggcgaaagcgcggcggcctcgacgcggcttcggcgcaggctcggtgggcggcggccggggcacggcgcgagcaacggcgacgcacgcagtagctcgaccacactgtgctgatcgtcctgccaatctgccatccgttgtggtgttccttcaatccttctccttgccttgctcggatggtatctatggtggagcaacaagatgagccagaatggcaagaaaaagaagagcaagagctccaccatgaaagtgtacttgggccgtcagaagtcgccgtccagggacaggcggacgctgacaacgacggcggagatgacgacgacatcatcataccagcaggcatgccgacgaggtttagcttccaggagattacaacgatgacctccaatttcgcgacaaaggtgagaacaggcgggttcggcacagtgtacaaaggggagcttccaatggcgcggcgaggggctcatcgccgtgaaaaagctcgaggctatcgagctgaagggaagaagacgggagaaaacggaaaaacagagggatggatagaaacttatgatagtggcatgatcctaattttgtaaaatattaatggcatggttacgaatagataaataataatgacatttatctaaatatacacatttgcaaaggcatggatccaattattaataattgattgattgatcactcaattggtgggtttgtctctctctctctctcaacttgggcatgttaattggtggcctccgatcctgctattctttttaaaacatgggaaaattttaaaatccaccccataagtcacgtgacatactagggtgcatttgcaacaaaattacttatggttgctgttcgcaataacggaattaatggaaggcaaaattttaagttaaatatttgatatttgaatgcatgttcgttgaatttaaaaaatcttcatatatatatatagatgttcacaactccacgagattctttgtcacggcgttacgctgaagctgttagaaggatgacatggaaaaaaaaaatgggggtgaatgggatttgcaaggttgccccagttgtcaaaacacaagagggtggtaagaatttctcttgcttgtttaatctgacattaacatcaatgtgctatggtcttttggactaacaagaagtacatgctttta

SEQ ID NO: 55931 - DNA, 1501 bp, Oryza sativa
aaccctgcttcagcacatgcatgtcaaaatgaatattcagcggcataacatttatcgattactccaatgataatttacaatgagggaagggaggaaacatggagtccaagtgcttaccattgtatttatcgacaatcttgcacattgtgacctcatttggtttttcttccccccttaattcagcaaaaaagggtgttgaacagccagcaacagtggctctaaagtacacgtgccagaaacattgtttgtcagcaagcctcaagataaacatgtggctatccttggctactcccttggttgctttattggctggctgaaaatgagaggaagggaacaatacaaggaaaaaaagaacagaaaatataatgaattaaaaaggtaactgactcaatcttaacaaactgattacaaatatatgaagtaagcagaatacttcagaatactaatcagatgatctccaaaagctaccttatatctaatacacacattaccatctgaggtaaaatataataacaaagataaatcacataaggtaaggtccaagataacatcagtacacacattttccaagttgtagtagtgcattgctagacgggtgcaaacacgtgtctggtgacattgacttgtatttttatgttcttgccaattcaatggtcccggcagcttgctgcggtcccttgaaattgcatccggctgtagcatgcggtgatgaaaaaattcttcagcagcactttcatattgccaaagaacaaaatgaagattagaaatgtgatgcacatctagcaaagcaaagtaactttatgtatgtgttccagatgttatttacgtaagtgcagatgctttggattgcttgccatgatttgctataaaatataccatttctaatgtacagatagctgtatgtagcagtcactgttgctaccagttgaaaaataatcttacatgtataaatatttaatttatatgcacatcatgtatggcctaaaagaaattagtatacataatcaagccttgtgcattaatggaagttacttcctacccatttcacccaaattattattatgttttggagaaacatataaaacacatgagaaaaagaaacatactcagggggacctttcttttcgggcttttgggacgccattcttgatagctcaaaaggagatgcccttaaagttttcctgcatatgtgaaagttaacattgaacttgatgcaggtgcttaacaaacacagattaccgaatagctaaagtaatacaaggataagcatctattgaatgagagctgcaatattcaacataaatataatggtatgttacaataacaaattatttaattcatctagcaaaaactatcatagacatcctattactatctttaatacactaaaaatacaatagaatctaattgggtgcacaactaattgggtccactcatactgaggtagtttaaccatgatgcatttcacctggtccaccactagggtgtgcactacattttc

SEQ ID NO: 55932 - DNA, 156 bp, Oryza sativa
attatgaactgctaattatagctttggtatgcatgattaagtgattaacagttagcagtctcctgtctttaagctatggttagaatccacttattgttgcaaatctacaatgagctgtctgatttgaatgtggggcccacagccagtctcctcctc

SEQ ID NO: 55933 - DNA, 1501 bp, Oryza sativa
agagagagaaaatggctacctgacagcgcggtggtgggcgtggccggcggttgtgtggtggcggtggtggtgagccgccgcggcggcggccgcacggcgctggctagccgcggccttctcggcggccacggtggcggcggcgtcgacgtcgcggcggtgcaccttgacgcagcgcagccgcttccggttgccccactgcaggagcaggtcgcgctccgccgccgttccgccgccgccgccgccgccgcgggtggagccccgcgtgtggtagtgattcctcgcctccttctccattgccggaccagagctcgccctgcacgtgtcacagcaacaaaaaaaaaaagaaaagaaaaaaaaaacacagaaattcagcagcagaagggaaggaagaaagattcatggtgggaagggaaattgctagaatttcaatcagattggaatagtgaagaattgcagaggaaattgctttgaggacagatcagctattcagctcagaccaattggtctaaaaataatctcaagattttattacaaatcttccgctttaattctccgtacgaactaggagaagggcaagttcaacaaactttagctcaatttcaccctccacccaaaagtaaaaaaaaaaaaaatcttctcagctgcccgatcaaatgaccggaacaagatgagacaccactaaaatgcaactcaattttaaggggccgaggaaatcagccagataaagttgcaaacttttgggagttttgcgaccactttgctttcaaaaattcagactgaaaccttaaaaaaaattcagactgaacgaactcaaaatcgggcaagaatcagacaaattaacagatcgaatttaagatgaaggtagatattcagttcaatttaactcatctattctggaaagaaaaagcaacctagataaaggggagaaaaaacagaacgatacaattttcggtaatcctacagtagagaaccaatattgaaaattcaacacagaaatggacagtgaaaaagttagaaagaggggacaacaaatcggacaaaatttgagacgagaacaagaaaacggcgagcagacgaacaagccaatttgggagcagaaaaaacaagagtaaaatgtgctaacttggtgaggtatacaaaatcatcaacacgagagaagcaaaacacaggggatgacccaaatcattaccagcatcctacctaaggaaaatcagctccctctttccaatcgacctactacaaggaaaaccaaattaaaactgacaagatttgtgacgaaatcaagtcgatcccaatcagaacccccaaccgcgcaaatcccaagttaggcagctcagatatgaagcacacttgatgcaactaatgcgtcttggcgaaattggattcaaattacccagtctgaatcatccctcactccattcccaatcgcagacagaggcgcagacaacggcagaagaattccagcacaggaaaaagcagccgcaaaaaggaatttaatccc

SEQ ID NO: 55934 - DNA, 1501 bp, Oryza sativa
tgcaaatatattggtcatcatatctatatataatttgataaactatatattgagcagaataaactgaactagctagtgtctgtaaactactacaaatacgacctaaaaaacagcggatcgagaataagcatatgtgttcgtcaaattaattgaatgcgaagtgtcgagttggctcatgatcgaacttctagtacgtgtagccgcgtagtgtaggagaccatacaaagctaggtgtagagcgaagtgacattttgggtcacttgtttaatttagttaatttatccaaacaatcagtgttctcattgagaaaatatcaggtcggcaaggcacgactgttaggccagttaggacaactttttttcccttttatgattaggctttgcctaatacgcctcccatgcatggtcagggaaagtatacatatagtagtatatatgaaaaccacgcgtactctaagtgaggaaatgctagctggtgccaaactgcatatgcatgccaaccttggatgacatggatcaagtggcgccgcaggcatgcactccctccgtccaaaaattaatactacctctgtttcatattataagtcgttttaatttttcttcctagtaaaacattttcaagtttgaaccaatttataaaatacctagcaacatctataacacaaaataattttcattaagtctaacattgaatatattttgatgatacatttattttgtattgaaaatactactaacttttttataaacttggtcatacttaaaaatatttgacttaaaaaaaagtcaaagtgacttataatatataaaaaggagggagtattaacttctagctacaaattaaaaaaataaattgttttctgttttaatatcagcaaggacaatgtaaataaatatcaatgcattaatttttggtaataaattgtccgggtgcttcggacacttcaaacagtttgtgtctcgcccacagcctaactaccagcctgtagaatagaaaacatgtggtagtagatcaaaatacgccttattatttcaaatagccggatttactcgtgcttctataacaagctatacagacaattaaaatctctctttcccacccgtatctctctcttccttcccaccatccctctctcccttcctttcctacctttgctcctaccttttgactctctagtgaggcatcactgtaacaagcttaggtgtcatctttacctcggattgggatcctctaacttaagctcactttgagacactgacatgtggcccctctttactatagacccagatgtcaatgaccccaaaagtcacctgacttaagtcagaggatctcattcccttcacctaggaggtgcagatttacaccagccaaaacaaggaattaatactaatcaatgaaccaaacactagcaaaatagttaatttctaaaaggcatgttttggcttcaaaccgaaatggtcctcagtgtggttcgatcgtgaattatcatgcatttggaata

SEQ ID NO: 55935 - DNA, 1501 bp, Oryza sativa
attgttattattatcaccttgttcaccctagatcaaacaaaaccccaactagtggactctctactcatagtaccactagtataattttaggtagatgcttcgcaagttaactaggcaacattaggtggttttataactctagacttgggaaattctcatatcacctggacactttggaattgttggtttttggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaaggcaattttcccggtctcgacacttttccagcttgatagccacccccttttattattgccgaaatctagtttcgacagttggcgcgccaggtaggggtagcgtcaagcttttcgccgatcagtgcaa

SEQ ID NO: 55936 - DNA, 522 bp, Oryza sativa
gggagcccctcacctcaatgactagcttttggggtgggaaaggccctttacgatcctacaatccaatgttgtgcatgcaaaacctcttgtttctgcttgtattgctaaaacttctagttctaacaaagtgtctaaacaacgtgagaaatatacttgttcttttttggcaaagatggacatattgttgatttttgtttcagattagctcataaacagaaaaaggagatagagattgcttttgcaaaatcaaagtggcaaaaatctggttttccctcgaggaaaccggtcagaccgcagtgggtcccgcggtcagaccggcgaccggtcagactggctgaacagcctcggtcagaccggcggtacagaggcggtcagaccggcccccggtcagaccggccactgtacctcggtcagatcggcctcggaggaatttttctgaaaattctaaaattgattttgctcgtggatatatgcctattggatcttctggtcgtgtgtctcagtactggattcctaaatttt

SEQ ID NO: 55937 - DNA, 337 bp, Oryza sativa
gcatcgccgtcctcctctctcgcttttttcccatttcgccgatctctcccgagctccccatcgcctccgcgccgtgcaaccacccgccgccgccgcttttgctactccgaccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcgccatggccgccgccttcggccggcgctctcgccctcccacgctctttcctctctctctaatccctctccttttgttcgttagg

SEQ ID NO: 55938 - DNA, 1501 bp, Oryza sativa
acataaagatcttaatcttaagtagcatcttgagcttccaaatacacttatttctctcaacatagctattattaattaaagctaggtacattgatcttaccgagaatctaccgttctgatggtagttccatctgaaacaatcaaaagaacgattcaactggatatacacaatagaagcgcacaactcatgccaataatggtcacctagcaaagcaaacagagaatgggctggcttatgtgcacccaaaatgttgtgtgaagaagtgtgccctcgaaaatatttctcggaatactaaagtggatcgattttgttttgtctcctgcagccttaattaattacgagtatcaattaaatcatcacattatcaaatcgatctaagcttcatcagcaagccgaagtagtagttgggcttaggacaggcctaattttgtcttgctttgggcctctatgcctggtccaatccattttgcatctcacgtcctttagacgtggcttggaatgaatggataatttatggcttattttgctttttaatttctaccgagttttgccgtggcaattggtaaaccatcaacatttcaggcccagcataagaaaatgaatccatcgatctatattgggcttgctattcatcactcaactgatttttctaaaaaaatatatattagtcactttttgatacccctaaccacttctaatttttttaaaaagatattaattaactaactggtctcatctcactcactgtcgatcgagtactgatcaccacatatgtgcagcactatagcatcttcccctccctgacctcctcctatctagggtgctctaccattcgtcttgtcgtcaccaacacgagcgctagtagtgaagcttgtcaaccttcgcgttcccacgtcgtccctcactccctctttctgcttggttgtagtcggtacatctcatcatctttttgttgctcctgctaccagatctactgtcgctgcacccgcctcctaactaatcaaaagaatcgcacctgcctctaacactagcacacattcttccatccccgtggctttaacatcgccttgtcacctactcgtccctgctgctcatcatcggtcttctaccaccttggctatcgctctaaagttatcctcattatcccctacctcccacctggccaccacctctaagcctgaaacactaatccaaaggaagtttgtttgagttaatcgtcaccggtgggaccatcaaccctctccctctcctttcttcctatctcccccgtctaggtgttataacgatgcccttgttattaaattgtgatccaatgactagggcgaggtgtaacaaccctagtttgttggtagcccttgtagggatttgttcggttaatccatttcaagggggattgaaaggccctcattgagaagtgattaaccaaataaactatagtaatagtgtggtttaggtccttatggcccaaaagtggttggcgggtgaggatgagtttataaa

SEQ ID NO: 55939 - DNA, 156 bp, Oryza sativa
attcctgcagccctgtatgttaataaatctaggtacgcatatatgtctaaattcattaccatatatatgaatatgggcaatggtagaaagtcttataatatgaaacgtacgaattatcaaattaaagtagcatcacagagaatctaaaggcaagaa

SEQ ID NO: 55940 - DNA, 413 bp, Oryza sativa
ctcaaggaggcgcatgtatgtaatttttgtgacgcattgcatcggaagttcccggacattttgctcactcgcacaaataactctgcagtttgttcaatttgcacgaaaattcatctaaattctctcccacctggagtaggaagctatacaaaagcttatgtacagtaggattagcgttagtgccctgcaaagtcgacacgtggatcccctttccccctccaaaaatcagtggacccacccgtcagtgacacaaaacgccatgccgcgggccccacacggcagcgatgtggtccccactgcggcccgcgcgtggtttattgccgccctttgctttgcttcctcgatttctcctctcgctagggtttgtgggtgagagcggcggcggcagtggccgcggcggagttgaggagaaa

SEQ ID NO: 55941 - DNA, 1114 bp, Oryza sativa
acacgtttaatcatttatcttatttaaaaaaaaatttaaatgtataagatataaatcatacttaaaatatttgtaagtgataaaacaactcacaataaaataaataataattgcgtgatttttttaaataagaccagaataatcaaatatgtgttaaaaatcaacgtgtcatatattaaaaaacgaagatactattaagcacatatatgttgttgaaattggaacaagaacctggtcactgacccacatgtcattgactcatgtggatcctacatgtcattgagatacgggtgatatatctcaaattttacaaatatagggtggcatggtttcaacaaaccctaaagacaatgctcatagtccaaaccttgcaaaatggtagtataaggttatataagattagatataattgttaaattaaattagtagaacttgacccgttcttttttattaataatatccattcttaaaataattgattcttaaaacatgtgcaataattaaaatttaaaatcattaattaataggtgccaaaattagcatgatttagaatgtaagaatcatatcgctagatttatcaagaaaatctcgttcatatagtatctttttaataaatacatatatatagttttaaaaaataatgatgaaacatatgtgtcatagactgtatcgacgttcaaaacattatacttataggaacagagcaagtttaataaaaatttgttactctctccatcccaatttagtcatcatatttgaaaatagcattaagaccaaaacaaaaaaaacatcatttattctgagattaaacctcatcgatcaagatgattagatatgcgacgatgtcatttactcctacatagataagagagcagatatgcaacaaacattttactcctgcacatataaacgaactgatatactatgatgccatttatttttgcactaataaacgagtaaacaccagttagatgatgaattttggaagaccaaaaaatctactatatatcaaattggaagtgtgactataatatttttggtccctacatcgggagcaaatcagcctgatcttactaataaattctaaggtagagtacataacaagttccatgca

SEQ ID NO: 55942 - DNA, 576 bp, Oryza sativa
ttcctgcagcccgtatgttgtacctatgatcactcacatattctgttcttcatctatttgttttagaacttttattaagcatcggaagtaaacaaccagagataatatgtcatcattgacatatttaactccgaagtgccattatgatatgtaagtgtgcttggaataaaggcccgtaggcctagttgaatgtcctatacccaagtgacatgccatgacaacacgatggaggcggctgccacaaggccaggtgaaacagtgggaagctaatgacttgtttgtttctattaaaagagacgcaaccccatccttataaagatgggatgactcgacccctaagaaatcttatctaaaattaaggaaataggctaaaactcaacctaagttatctctaaaacaaaaaaaaaacaaaaaaaaaaacacccaaccgactacttcagtacttgtgggtactgttcatgtgcatttgcatgtgacgtggtaataccacctaaggtttaggttgtaatgcgttgtacgttgtgcatctaagatgcacatgtttgcatttgtatgatgttttcttctttgagcagg

SEQ ID NO: 55943 - DNA, 512 bp, Oryza sativa
tttggaagtaaactcggccgtccatctccgatctataatactccttccgtccctaaatatttaacgtcgttgacttttttaaacatatttgaccgttcgtcttattaaaaacttttgtaaaatatgtaaaactttatatatacataaaagtatatttaacaatgaatcaaatgataggaaaaaaattaataattacttaatttttttgaataaaatgaatagtcaaatatgtttaaaaatatgtttaaaaagataaacggcgtaggtacggagggagtgccttcctttccaaggagccgaagccgacatcccgcctgccgccagtggctgcccgcttacacgtacgtttgtaggtgccctgtataggctgcaacctgcaatactgttaatggctttggatcacgttaatttagattgccagcagcccatggagtgatttggactgtacatgtatgaagttggttcagatgctgacgaacaagtaataatcacactttttctttgacgaccta

SEQ ID NO: 55944 - DNA, 1098 bp, Oryza sativa
ccaacctttgagcaccgcatcaatcgcttttgttattccagcgagtttttgggttctttgtgtgatttggatggaaggtgatcggaacctctatctctctctctctctcatcttgtttgttttgtgggcgactgttcttgccttcttggttggggatgatcagacattcagaccatcagatgaatcgatttctttgtagagcagttcttgatttatttatttattttgcgctaggtagtagatcggaggggttcatatgattcttggatcttttggttgatttgatttgatctttgttcttcacatggatgaagcgagttttgtgtgtgtttgagcctttgccctttgcttctctgtctgcggaagaaaatactcgtcttttccccttcacttgttcaattttttctcagttttggtggttagaaagaaaatctttgtttgcaaacttgattttctttttggaatgctcatctgcaacgagttgcggatttttttgttttcttgctgctctctgaagagcaagtgcggatcttgcattctcggtcggatctctgcgtttctttgcaaccatcgattccactgctttgcttcttgtaggtttctttggttcgatggaactcgctttatgcatgttctttcacttctgttcttgtgaatccttcgatgtgactcctgcggtttttttcaactatattattttgttttatgtgctgttgatttcccttccagtttactaattcctactgcattgtttaatctttacaggtgggcttcaggactggtggtgataactggctgttggtaaggtgagggttttactttttaatgtcatctgcaacaatttcatgttgctcaccaattttgttggactgtgtgtgggctgtttcttggtgcttatggttgtgggattgagtctcctgggtttgcttccacttagacactagcagtataatgcacataaagttgggcaaataagtttaatcatgcacataagttgaatttgatgcacatttttcattactttgatgcacataagttgggcaaaattcaagtgactgtcaagtcatattctgttgcctattgaacctgcaggaaaca

SEQ ID NO: 55945 - DNA, 400 bp, Oryza sativa
attcctgcagccctcatcaaggaacttcaaatatcaaggaactacgcaaagatgttttcaaaaaggattacataaaatttgagaagaaacatggagaggctttggatgattaccttgcatgctttgacaaagttttgagtaatcttagatttgttgatacatcttatgatacttctactcacaatctaagattgtcactttttgaatggtcttggtatgtctgtttgtgagatgaaaattacgtgtgttcaggaatctgttgacatgcccactttgactttagattcactttacactagactcaaaacttatgagataaatattctttctcgtaaagttgattctaaatctagtgcattggtttctccttcgacttctttggatattggtgcttcttagt

SEQ ID NO: 55946 - DNA, 343 bp, Oryza sativa
tgaattgctccttcatctccggccccgactgtgtcgacagtggccatacacgaattgccaatatccaagccctggtatgccacctaaagctagacccagagataaaaaacagacgcaccttgtccacaaatcgccccctcacagcaaaaacagcctacgacttaagcttcttagggttataggatgaccttttcgctaagcccatttgggacaaccacgctcaagtcaaatgcaagatcttcctttgtactacacacaagaggcgcatcttcaccaatgagagacaagctcgatgtggattagtagcatccgcacgttgtcctttttgctcctctgttaaaga

SEQ ID NO: 55947 - DNA, 361 bp, Oryza sativa
ccagattaggtttattcaaatgtagcattgtatgtattttgataatatgttgtcatgtgttgaaaacattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtaggga

SEQ ID NO: 55948 - DNA, 158 bp, Oryza sativa
aggttgatcaagaatatatcaataataaggattatcctgagcaaggcaagtcatcactattccttgaacatgttgatcctaatggcgaaattgttttgtttacaaataaaattgcatgcaatgatgaacatcctacttgtgattatgccatgccttga

SEQ ID NO: 55949 - DNA, 413 bp, Oryza sativa
aaggcagggtttttcaaactttcccttgatttaagtagtttgcctaagagcccgtgcattgcaatgaaaaacaaattaagtttctagcttattgaatcaatcaataaacacttatttagtctaagtaatactatgatttttcttattgaacaagtagataattttgaaatttggggggagccaatagtgaaatgggggaggatttgttgaaaggtggtgcaatagtatagattgtggggcccaattttagtggtaggggtggtgtgggaatagacaccaccactaccaacattttaactagtatagatatagaaaactttaatcagaaccagttaatatgagtatatgattgaaacaaaaagtttattaaactgttagttgctctttagctaataacattgtttgtttgcagc

SEQ ID NO: 55950 - DNA, 1501 bp, Oryza sativa
ccatgcttttcttcttcgatggtcgctttcagcggcagatatgataacgtatcaactccaaatgttccaatcacatctttgcttccaacgcaaccaaccatcatccaggcaggctccaccagatgacctttttaatttaccttcaccgtttaggtagtatgcaactttggaacgatctcttcagattagccatcttgagcttgtacgttatagaaaaaaccgtttttctgatggtgatttggtgacgcagatattctcgtggagtgacgagaggatgggactcactgatggagcagcgcagatcaggggttcagagtgacacacttgcacacacatttacatttttcctagagatggcaattgtgctacagaagttttcgtgtacagcgtttttatggattcagagtgacacgctggtggagcacacgacttggtgatttgagtccgattacagtcggcctggaacggcactgtgatgttaccttcagcccattctagttgggccagaaaggaagtacttaaatgtggccccattatacttgggcctgggagggaatacgagtagggatggcaatgggggggctacacctacaaggctacacccgtcggattttgctatcctgtcccgtccccgtagtagaaaaaaaatcccgtccccattcccatccccgcacgcgggggagtgttttcccctcccccgttcccgcccccgtgcgggtatggggcaccgtcgggtgcccacacccgacaatatctcaatagatttggtagcagcaaagcaagacaagaaatagccaaacaccagtgaataagcaccaaatcttaccgtaatccaagtatccaggctatcaacaacaacaattagcatgattgcataaggaccaaaggcatcatattaggtattcacgttcacatgcgtgtacatcaccacaacacaactacacatgcagtgaatatgcacgctattacagatcgatcggagtaggctgtggcggcagcggcgccgaagcgaggctgcttgctagttgctcccttggaggcggcggcgcgaagcgtctcgcacggcaaggacgacgagagctcaacgccgccttctcgcctggaggtgtggatgcggcgacgcatcagggaggccgagctcgtggcggcgcgcagggagggagtttgagctcgaaaacgaaaacaattttaacatataattaagtctttaattattactttctccgtcccataatataacgtacgagacactcctgcggtccagattcattatgccatgaagtgtctcatccaatactaggttgctatattattggacggagggagtacaaacttaacaaattaacatatttaatatgttaaaacaatttctatatagaaagttttcgtacgtaacaccgtttagtagttaaaaaaaactatgcaaataaaaaacgatgtaaaatccgaatcttaattagaaaataacaggattgaccagagtcgccaccacactcttagc

SEQ ID NO: 55951 - DNA, 1501 bp, Oryza sativa
aagtatacacaccaatgaaactataggtgtgcacaaaagaaaaataactatacacataattaattaactaatccttttccttatttttaaaacttgataacttggtgcgcattgcatgtatttgttgtctaaacaccatacaacgagggagtgtaaattacaaaaagaaaaaaaagaaattggactcctattcttgttagggtgttagtgttcttaccctacgatagtgttaggacgatagtttattagatgaatctgtgcagatagtggtaactagaagatgtacagatgttgatagagataactagaagtagagatgagtgacatatatacctctggagatcagagagaggcagagatgatagcagcatcagagatgatactaaatattgtcttttgctgcaatcaatcatttcaggtcaggtcgttggtaccgataataaacatttcatatagtacttcgtaattaacataagtctgaactaggggcaaaaggtagcttcgatttgaaaaaaaacagggacaaaatcacaaagtaagaaaaaggaggacataatcatgattgagcaccaaattatgttgggtaaaaacatcatcgccccattcttattctatataacctagttcattagatgaacctgtgcaaatagagataggtacaacatcgccccattcttactctatatattgttagagtaaaattgttgattagatgaatctgcgtagatagtggtaactagaagatgtacatatgtcgatagagataactagaagtagaaatgagtgacatatatacctctggagattagagagaggtagtactcctgagcttcctgggacagctgggatatcttctgttggtggtggcggcacagacctgcgcaatcaatcatatcatttcaggcttggtcactggtaccaacaataatcatttcagtgttgatggaagaattttctacctgttgggattacgccagtcccacacccaatccaagccgaagccggcaccactaccgccactcctcccacccatcggaatgccgccctcctggtcagcgccggcaccaccactgcccctcctcccacccatcggaacgccgtgctccttgttagtgccggcatcgccactgcccctactcccacccatcggaacgccgccctcctggtcagcgccagcgccaccactgcccctcctcatacccatcggaacgtcgcccagtggcaccagagatggtagtaaagattgtctttcgctgaaataaccattgcatatactttgtaattatcataagtctgaactaggggcaaaaggtagcttcagttcgcaaaaaaaaaaaaacagggacaaaatcacaaagtaagaaaaaggaggacataatcatgattgagcaccaaattaagttgggtaaaaacatcatcgccccattcttattctatatatcctagttaatgagatgaaccagtgcagatagagataggtacaccatttccccattcttac

SEQ ID NO: 55952 - DNA, 201 bp, Oryza sativa
acccagatgaaaaagtacggccgcaagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaatttttttg

SEQ ID NO: 55953 - DNA, 777 bp, Oryza sativa
acccagatgaaaaagtacggccgcaagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaatttttttggtcgatagattatttctgtaaatattaaaaaaaaatctaaaaacgaaaaaaattcttcctgttctcccttgtggcctggacttatggaccgtggagtaaagttgctgtaactagataggccaactttttttttagataatggaatataatatcccggcctttgctcaaaaagaactacagccaattattacaaagatccactccagaagagagtgtagttcaagacaagttgaacacaccaaacaagagaagagaggacccaaactgagaaaagcaaaataaaatgtggagctagaaggcctcgtcaaggcctaggactgaagttcgaagccaatgcatagaccaatgacaatatccttgcacgaagaggtttctccaaagcggtgcccccaaggaggatgcgacgtggatcgccgccaccactcgttcggaaccgaagcaaggttttcacccagagaatatggtagggaaaggaaaggggtatgctaaaacaacgcctccaaggaggggaacgacgccaaacggcgtcgccgttgtcagccagccaaatggctcggcaaggctttcgcccgcgat

SEQ ID NO: 55954 - DNA, 1501 bp, Oryza sativa
aattttagctatttttaaattgtatttctacttagactcttttttttggtaatttcggattttattttatttttattttgaattttgattaatgtcgtattgggtttctatatggaaatttctttcaatatttcttacttttaatttcgaatttcagttattttaaattgtatttctacttggactcttcttttttttctttttctccgattaatgtgggaatttccagcctccacagcgaacgtggtgccttctttcaaggctgttttaataatataactagaactctaactcttctttttttcttatattaatgtgagaatttccgttcgaaaattttggttatttataagttgtattcctatctaaactctcaattttattttataatttcagaatttattttatttttactccaaatttcaattaattgatctcatgtttcgtttaagatggtctcttcttgcaacatttcttatttttaattatgaattttagctatttctaaattgtattcctacataaactactactatttttctaatgttgaaatttattttattattttcgaattttaattaatcttgtcttgttttccagatagactgttcttttaatattctttttatcgaattacaattatttttttcttttacccaaaagtgcacacatatatcaaattgcacttctgactgatgaagctgctatgaaggtgaaggtcttatgacataaaattttttttcctgcgacaactcattttttatgaaattattaattaagtatatattgaattacgcacatgcctttaaccactggcgttttgcatttatactgcctaattaatcgtaagccagtgcagccacatgtatatggcctttactgctaggcttgtgcatacagcatatggtatgctatatgtatgtactgtttagttgttcctattctcctagcaatgcatggccgtatatatatggtgaatttaaatgactctaattacagacttcaggctctagcgccatatgcattcaaatatgtattgccaagtcctaatccgattacaggcttcaacaggaccaacacctatacgtcagaatcctactcctaatcaatttatgtttctagtatatgtagacagatcagtccaatgtagccttttagtttcctattgcatttaagttagttcccaaaacttatttgtagccttattaaatatcaaccgttataatttaggactatcacgatctagcggtgtagattttatctttttcttcgattaatgtgggaatttctagcctccacagcaaaataagtttgatgtgatgacatgttgatgtgatgaaaaagaactaaggtttaaacacagccaaggtatgtcaatgtatggaatcacaatatcacatcaatgcaaataataattaaaaaaacaatatcacacacatcaatgggcaaaaatgtttgaccctctgttgcaacatggatcatgaatagaccaaataagttg

SEQ ID NO: 55955 - DNA, 895 bp, Oryza sativa
taatgattttaaattttaattattgcacatgttttaagaatcaattattttaagaatggatattattaataaaaaagaacgggtcaagttctactaatttaatttaacaattatatctaatcttatataaccttatactaccattttgcaaggtttggactatgagcattgtctttagggtttgttgaaaccatgccaccctatatttgtaaaatttgagatatatcacccgtatctcaatgacatgtaggatccacatgagtcaatgacatgtgggtcagtgaccaggttcttgttccaatttcaacaacatatatgtgcttaatagtatcttcgttttttaatatatgacacgttgatttttaacacatatttgattattctggtcttatttaaaaaaatcacgcaattattatttattttattgtgagttgttttatcacttacaaatattttaagtatgatttatatcttatacatttaaatttttttttaaataagataaatgattaaacgtgtgttcaaaagtaaatgatgttatatattaaaatatagagagggtaaccactcctatgttgcactgtactctatatttttttccttggcacagttttcaactaacaataatacttcaactgtaccgtacaagccttccacagcaaatactagtcaagtactgatcactccaaacactatatgtctctgttgagagagaagtgaggaaatttagcgcagttaatgatactccctcaattctaaaatatactccatctgttctatattaattgacgttttgaacatagttgagattaaacttttataactttgactatcaataactttaaaaatatttagtttaaagaaactagaaaaacatatatagatttgtctttca

SEQ ID NO: 55956 - DNA, 508 bp, Oryza sativa
gaaaattaagttgtataatatgtaaaaataagatgcaatatgattattagaactaaaacaaattgatatttatgaattttgagacctaaataattgaaattacatggtgttatgagagaagaaagaggagacacaatttgaaccataaatctatcgtccaaaggctaaaaataattggagtgatgtggcttaatgagagaaaagagaaatagcattaactacacttaattagtggggatgaactatataaatataaaggattacatttattttgatattgtaattttatccagtctccacatcacgcatgtatcagaccagctgcttgtttacataactaaaacatgtgttataattaagccacttgcatttgctttgagtacacaccttaactcagggtcagggacctcccctgtagcatagctagggcactgccaatcaatcaactgttcaattatttgatcaatcaattaaacggatggtcctgatttcatctcaccacctcatg

SEQ ID NO: 55957 - DNA, 1501 bp, Oryza sativa
atttgatatctatatatggttttaagcggctatgaagacccatcgggattaatttcctgtgtaagagcgggatggaacaaagttttttccgttgtatttcgcggggacgaaaacagggaaagttttgactcactggggggtagggaggactgaggaggatgtattatagatggccagatgggccgccaggcccgacacagtccaggcacgactggacttgggccgaggtcagtcgggtcagcacagcccgacctacttgctgggttgggccgtgcctacccacgggctatacccatggcctaggcacgactcgagtcagactcggaccgtgttgggccggaccaaacacacaatagccaccgtgcttctccatagaataagcctatttttccttccttatctctttgggctatgtcttatatggctggaatagtctattttgtattcctcttctctttgggccgtgtcttatatggctgagttaagtctatatagggtccctcaactttttttctttaatcctgccgggccgggtcggcccaccatgccaaggcatcggctaggcacggcccaactgtctggccgggccggcacgagcctgacaccaatcgtatcgtgccatgcttgagctgagccaaatggccgtgccgtgggctgggttattaggcctcaggccttatggtcatatataggatgtattccccgttgtcatctctagcaccgttagctgaactcgccaacccggatgcatcttggcccataacggtgacaacataaataaggaaataagttatgggccaagataggctttcttttcctgttctgactttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctatagaaggcctgctgcccagcccccagccctcattcttctctcctcaattccagtgaaaaaaaaagaagagagggaaggagaagagaagaaggggcgaaaccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcattggcttacacaagaagatattacgttatagatgtttattgcatgaaagagtaatatgatctagttatttcgttgacagata

SEQ ID NO: 55958 - DNA, 516 bp, Oryza sativa
tcaagataatagtcacacccaaaactgttttatttaaagggatccactttttgtcagatgatgaatgctagctatatggtagtgaataatggaagaacttctatcaaggaaaaataatgaacagtctccttactgtttttattgcaaccagtccccttcatgctcacttcctttttagctacaattcatttttaaacaaattactctgttagcgggtatctataagtgataccatgtgtatttagtgggcaaataataaagtattctgattttaattctttttctacaattaaatcatggaatacatactatttgtatgtggcagtgatggaagaaattaaaaatccagtacttctgacacatattacagtgtgattcatgcttttttttttgggtatggttctatcacttctctagaggtatatttatctacactgtttttgttccaaaatatcactatttcaatttgagaatctcaaatttcataaaacctgtaccagttcagctaaaacaaga

SEQ ID NO: 55959 - DNA, 1447 bp, Oryza sativa
ccccccccccccccccccccaaccccgcatgccccattgaccgacgaaaacaccgaacaaaccgagcacaaaccgcagacgcggacgccgagcgaaatgctcgttcttttcgttggtggaatctgcaaaagcacactggaggctggtccggtacgggacaagacaaccacgcgagaggggataaaaaaaaggcgataaaggtaaagctagctaccgcgcgcatccaatgatcggatgcgatccggaggagaaggtcgccgaattccgtcttatccagagatggggaggtaaaaaggagggggatccacctaaccaaccaagttgcgtcgcgcctaaaaaaaatggccgcacgcgctccgccccggcagcaccggtcaattcctgctgcttcctcgagtcaactgctccagcgcagcgccccacccacgccttttacccgcgcgccagcggcggcggcggcggcggcggggtgaggaggtgaagtgggagaggcggcgtggacctgcgacgacctgcttgctgcccagcctgcgagggcaagccactggtaggtagtacgtgcttctctcttcagtcttcactgtctgtgtgtgtgtgaattggaatttggaagtgctggaggtaagcagtaagagaaggatcagatttggagaggctgaatctctgattctctctggtgtttaaagagtttgttcaattcgaattgtgggtttaattttggtgccgtctctcactgggagggatcactggatcacagttgtgctgcttctgggaacgttttggttaattctatcaggtctgtagttcttcatgatttttttttgaatggatgtagttcttcatgatagcttctagaatatctgagtcttgctaatattccttttttttttaatagcaagagaatttagtggtgctgacatactaaaaattagaaggtttatgtgctgtatgggcatgttcagatattttgatttgttaggcaaatttagatatttttaaccatggcgaccttttggtttgggggcataattgggagcttggttttgcttccttttttttgaacggaagttttgcttgtttcatgcgttctctttggaaataataattctagtacgttttgctgtgatgaattcaagcctctattttagtataccgatgaaacaattgtgcatttcaaggcaacttttgcttttcagcataactaacagcataacagtgaacagatagtataataataacagtaactacaaattctgctttgcctatcactcaatcttgtatgaacctcttttcttatccaataatattttgtctatcttataggtgccatactggactggcttgcttgttaactgggttagccagggactccggtattatactactatgatcagttcgtgtactttttttcgccgggcaagtttccccaaggaactcttttgatgct

SEQ ID NO: 55960 - DNA, 1501 bp, Oryza sativa
acactcctgcttcactctcttgcggtagatacccctgcctgacttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttctgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgttgttagtatctggccccgatactttcctatcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggtgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacactaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgt

SEQ ID NO: 55961 - DNA, 424 bp, Oryza sativa
tactctgatgacatgcttgattttcgatcctataataaaggtacaagtctgtaattatctatctacatttattttcatgtttcagtgtgaagtttctcaactataggctacctatgacctaattgggatttatataatctttttttagtgtttatattttctggtaattctaccttcaaacaacattgtgcttatccattacatgctagcttgtgttttagctgttgactgagggtgttcaattgtcttgacaccgttgctagttgaacatatattaaatgtttgcaaaaagtcgatgtagacacttgaaaagttaaaataaaagtatttaatgtgtgcagactctttatagcccatacttctatcaaattagtgtgtttatatttgataattctcttgatttacctggatgtctatgtgcagg

SEQ ID NO: 55962 - DNA, 412 bp, Oryza sativa
ttgcgcttgagaagaagtacggaggctggttgaatgcaaaaatggcgtaagtcaaattagtaatttatcctagctttttgtctgttaatctattagaactctcgtcatttgttggttattgactattttagacttggttttaaacatagaagcacacatgataagtatgaatgcttgggacaaaattatcagtttcttaacacaaaaattcctgactaaaattggctccaattctagacaaatgacaattattatgaacgtgaaagttctattgttctgtcaaaagaaagctgcactgcattatgattattggtacctgttgtctagctaaatgcagcatcctgtatctctggcatcactagctgtataagtaacactctgaagtctggattatcttcatactacttgttct

SEQ ID NO: 55963 - DNA, 249 bp, Oryza sativa
attcctgcagccctttttggatagctacagctacgctaaaaatgattttgttttctacttttctcaaatactccttcaattgcattgcagcctgctaaagcaatatatgagtctcttatagctgagaatgcgggatgacttcacttgcacatattcaggtgagttgctaacttgttattacttttggcatacttagattattgctgtaatgtatgtgagagctttagcattctggttttctgttgtagt

SEQ ID NO: 55964 - DNA, 362 bp, Oryza sativa
aaaaaaaaaagaagaaaaatctctacttctgactttacatggaaacacagaagcaaatgtaattttaagcttacaccaagtcattgttctgatcgttgatctgaagtatggtttgcataccatgttttattttgcaaatgcatgcaagaaattttgattgttcatgctatatctagtttcgattagagttcatcggcacgacaatgttgtagcctttgcacgctaacctgtgtaaacttgaatatctggttcattcaaatgttggagcaaaacaaatcatcgcaaagtaacttatcaattatcagataatggggaccacgcattactaacttctggacaccttgtttttttttttaccaagt

SEQ ID NO: 55965 - DNA, 151 bp, Oryza sativa
aatgtcttaacaaaggtaaataggcatggctaaataaaacagtgataacgcgggaatgtaaataaagcggtaatgcattaatttaaattaaaataattttataaactgggattcaatatgctcaaggatgatgtgacttgccttgctcaga

SEQ ID NO: 55966 - DNA, 1501 bp, Oryza sativa
attttggtgtattttacactccaatttctggtagtggtaatgtcagcatggataaatatattcttttgggcctataaaaaaggaatagacttttttagatacgactacccagtgcacggtcgctggtttggttaaaccatcgaccactttatcccatgtgatgtataaatacttctttgccactaatatagatcggtcactagtgtatcttttaaaccttatattatatttaagatatttttttaccattgtactctgcttaaaatatgtgataaaacaagttcaatgttgaatatattcaaacattttattgatctaaaagtagttcattaaaattgcaaaagtaacttagctatgcaataggagtaactatttagagcattagaagtaattacatcatgatgagttgaaataagaaactatgtggagtaaatccacaagcacaatgtagagaagatattttcaagtaaatatatatattctttatttaaactaatcactatattatttaaaaaataaaatcttgcgtcatatagaaggtaactcttcatgatattaaaactaactacactattagagggaagcaacttttaaagtaatagaagtaactcttcataatattagaagtaaacacacttctagagagaagtaactataaaaaataaaattaaaataactctttaagatattagaagtaactgtactgctagagagaattagttcttcacgtcgttagaaataactacactgctataaggatgtaacttttcatattattagaagtaactacacttatagaggaattaagaaaaaaaaattaaatatattcaatattggactcatttatcacatgtttcaagtatagtatgatggttcaaacagatcataaaaataacatacggtcttaaaaaaatatagaccatcaaaggttctataaaaaaagaaaatatattagtgttgttagccttggtagcatacacgtgaatcgacacgacaactaacaattagcatgttgtcctctttttctgacaagtggtctcgtttccatgtttctttgtcagtacaacatccatgtgttcgtatctcagtcattattaactgattggttaggataactatttccgatgctataggtagttacttctattgcaaagctaaattatttctacaatttaaataaattacttttaaattaagtaaactctttaagtgtttgcatatattcaatattggactcgtctatagtatattttgagtagaacatgatgatataaatgaaagtgaaatataatatgtggtcggtggtgtgttgccattgcagtgaaagcaagtctgtctctccgatagcacgaagacgtacggctaccagacgcgtcgtgcaataacacaaaaccgagatagctctctcgatttagatttcccgccgaacttttttccccctcccgtataaatatccctccactgtgagcagcgggagtggaaaaaaataatccgagaggtt

SEQ ID NO: 55967 - DNA, 411 bp, Oryza sativa
tgtgttggggatgttatgtgtggtgggttctacttttcggaactcgggagatgtcaatatcttgctgctagaatccatacttcatgtgtgtcagttctgtgcttctgcttgatggatatatactgatgcactttttatgacctgcgatcgttttctgtctgattaacaacattgctagggatatgcattgcagtcatactggcagcatttgttttgcccttcttttctctattaatgtaatcgttgcttttttttttcattagatttaacctgtcctgcagtatgctctgaattgctcgaattttgctttgtttgatgttaaccaaactgttgagagcattcaataatgtgttgtgtacattttctttcttctgatgaactgatgttataaatggggggctattgtttagg

SEQ ID NO: 55968 - DNA, 1501 bp, Oryza sativa
gtctagctaatggctaaggaaggattatggttacacatgcatctatctaaatagaacggttatacactagaggttctgttgccggatggattttggatcggtcaaataattactgtgaatcatttgtattattattttattaatggaggctttattttaattatgtacatatttcacttgtcaaaataaattataaaaggttaacaattacccatgctttgtatgttggaattgtttaggttaatcatattatggttacggattatcccatcacctaattttacaatgaataatccaagtttacagttgatctgtaattatacgaggacaggatgtataactagtatttatctaatattcatgtttgtcatatactccctctaaattaatatatgcaacaagcaaattaatacgataccatatatctataacgggatgtacaatatatgcgtgcataatatcttaatatattgaatcatttatttgaatagtttctatttactgcttggttaactaagggttgctcaccttgcctactatatgctattttatgggatatgtcgttgattaatttcatataggtgatttaatcacactagctctgttattatttgccataaacaagcttatgaccgatctatgtgtatctatattttacttacctaacaattataaggctaactctatttaaataactaataagtcgtgggttttaattatatttggacatagattagtaaatggcactaatattttcctgtacacccattaatttgaaggattgattataactaatttatttagttgctacagtgacaagacatgttaaagataattatgccactgtacaatatccattttcgatttatacatcctaaactattttgcgggtataaatattttgttagcataagtttttaatttaatctacccgagcattatatccatataatagggtagaaattttctatcgcgagctaagtatcggacgaaatcctggaaatattgtacgaattaatttagtctatgactaaatgattaaatataatacaagggaaaaatccgaatttctaccgtgaattgattatttatagggattacccaaaaataatctataataatctataataattcatcttatttgtttagtaattaactacatctaaattattaccgcgaattgatttcttatagaaattgccaagaataatccataatttatattaaattttgcaattctacgactataattaatccataattaaattctaattattttaaatcttctaaacttccctaatcttcctctaatttctatttatttttttttccttctttttctctcctcttttctttcttttcttttctttttctctctttttctctcttttctctcctttctttttcctttctttctctcctctctctctttttccctttcttctctttctttcctccctcccggcttcttcctcccttcctctctctctctcggctcagg

SEQ ID NO: 55969 - DNA, 1501 bp, Oryza sativa
ccaaatctctctcgcaaatcaacagtattcaagttgcgtgccgcaggtaaaaaactgtggtgcttatgacgacagaaaagttttatgctgcacgcgcaatagcgtgatggaagaagacacgtcaaaattgtgcgttgcaatttggctgcgttctatgccccaggttggagagattttcagcgcacctaatacgaaataacttattaacatatgaataattaaatattactccctccatcctaaaatcaaaatataagtatttttattgttcagattcataactaaaaatacttatattttagctaaaaatatttatattttagcttgtaatagctaaaagttattacattttagaacggatgtagtaatatttataaattaaaaaatgtacttatttgattttttaaagaaaaattatatagaaaattttgtaaaagacatataatttaacagttcgaaaaagtgctaacaaacaaacgaggaagaactgaaagtaactctacgaaaaacatgagtaaattaaacagtacaaatgtggcacattgacagctggaataaacaacggagcacattgattcatcgccacacgtatctaaaaaaacttgtaaaacctccagtgcctcacctactctgcagtctgcactaatgatacccagccgcctgatagtgcgtcatcaggttttggcactggacggccatgaacgtctttagctatgacctcattcattcctcaatcaaacattttccgtccactctctttcacctaaaactgtacaagtcatgggtcctctttaaatgaatttttacaagttgcagcatttcttaaaatttctaactccatcgaacactatagcttctcacccaatttctaataatatacttacatcccaccgaaatcctttatatggatatttttatctatgtaattatatggatgaaatcctatatattctcagacggaggtattaatctagaaaatatgatattgatttttgataagttttattggtttttatataaacataagcatatttattcatattatttttaatccatatgattttaaataatatagatcgggactgacatgcttaaaccatcaactcccatcttaacaaaaaaaaaagaaagaggcatcactaaggcctggtttagttcccaacttttttcttaaaactttcaacttttccattacatcaaaactttcctacacacacaaacttcgaacttttccgtcacatcgtttcaatttcaaacaaacttctagttttagcgtgaactaggccctgtttagttcaaaagttttttttccaaacttccaactttccatcacatcaaacctttcatacacacataacttttctatcacatcgtaccaatttcaaccaaactttcaaacttcagtgtgaacaaaacacaaacacacccttgagaatgggctggcatctgggatgatagtactgtgcaggaggccaacacccagcagttgaggagtaggcca

SEQ ID NO: 55970 - DNA, 1501 bp, Oryza sativa
tttggttgcatactttgttgaactgattaggagtttaggactgtcaatttaccctacaagcaagtttggccaggtttgattggtgatatatatatagaatcagatcgccctattgtcctatatgaatcaggttgtacaaaacaatgcaagcaatatacctttgaaataactaggattggcaatttgacctcaatttacagttgcttttgcctgattgtgaccgcattttggagcaggagaagtactgggaagatcatccgggcgaggccgtgccgctcatgccgcccaaattctactgggggccatggagggtgatgaacggagaagttccacgctttatgcagacaccagaagaggcgaaaccggcataaaatcttcaatgatcactgaatcttttaaatgttgcgtgtctgtaaggacacgatatgtagtgtttgttgcgtgaataaacagtttgcccccatcgatctcaaggcaagtagagttagatacgatctatattatacggtataaacggtttatttccccttatccccttataatgagaaattggaagtgttcatgagtcataaatcttcactccttgtttgtctactttgcattttcgccttcctgataacagtcgagttgtgatgtgtttgaatcagttcgtgcttatgaacatgtgcagcgtacgcacattcaaggagatcaggggagaataattcgttcaggtggtcggacaaatggtggttttgcgcaggcaaaattattgccaaaatgcatagtaaaatattgcagctttcacagtatcaatttcacatatgtagtaatctacaaaatgaggtgctgctccacattagttcagtttacatcagacggattcccaattcccaagtttaaaataaattatatctgtaacgtctttctcccgggccgtgaaattctgtagaaatattaagtactactactgcctttcaccacgaaaagacaaaatcacgtcatatagctttcaaaaaatcacccctttcatttgaggggcactgccttacatcaggagaagacatatcataaatcatgttacttgctctcaaaaatccatcccgctcatctgcggcatccgactagccattctggcctttgctgctgggggctcagcaacagctgcctctgtcgttgtcatcagcaaagaaacactgaaacaaaaacacaagttattaagcaagtgtggaaattttagtaatgcaaaggaaaaatagtaatcaacttaaggaacgtgcgtaccttgatgcatcttgtagcgctgttcggatgactttcacagggtcgatgatcccagccttaatcatgtcaacatactcccctgtagttggcaaagagcaggaatcagctaatgaatcataaagattactatgcttttgaaggcatatggatagccttttcaaggactatctaaaccgcaataaaggaactcaacataatttttgttacagccagtaatgccaaaacatagctaaacagc

SEQ ID NO: 55971 - DNA, 1501 bp, Oryza sativa
gttctctactcctcttctctaaggttttacatttttttagaggttctcaagttttacttttgcatcataggacaccaagtcataaatttcatgagaggtatgtcttttgtaactgacgtgaacaagatgattagtgttcatagattcttatgacaatggggtcaatgtctcactgagtcaccgatcatattttgttgtgcaaggggatgtgccttgataattaacgacttccgtgtacaggatattcattagaatcatttataaaagataaaatcaaactaactaatgtgcagtttagtttcattctaggaccgcttcaacttggtccattgaacaacaaaccacctgtctgatctgctcctgcacggtgagcttcccctcgtcactccaggtatatttctggcttaccatctcctattcacctagcctcttgtccttgacatattcatgcttgagcagaacaacacggcgcaacgaccatgatatgcctcacaagctgaacctttctttctttcttgatctgaaaaccaatgaccaccaactcctccagatgagaatgcagtgctcttgagggctcctgctcccacactatctccaacttccgacgaacggccatctcatcatcgtcttcacaacgttgggaaaagtggacgtggagtctctcaagcgatggagcctcctcaacaagggcacagatccatgtggcatcccagcgcggcggcatgtccacgaccagcagcttcctcaggctgggcatctctaagaaaggactctccggcgtgacccacatttgaggtccagttagccgcagcatgagatctgtcatgttggccttgcagaaatagctgagcatggacagcacggcttcacgcttccacgtctccaataatggctgcaaaccatccccttcctgttggcctatgttgaaggtgagttacggcaccacgtcacccccttctgcccagggattttgtgcctgctgcaaatatgtgtgtctccatcagttgtgatcctttcatggatctggcttcttggtctttgctgatctctgtttcttgacttgaatccccattatctgatttctttttatttgttctttgtgtgtgtgtgtgcaggacagcaggagtgagagggtcacaatggtagagagcatcttgcagattggttgtatggtgagcagatgaatctgtggtaatgccttgtccaataattagtaaatctttgttcactgcaaaatacaaatttatatccctggctcctcccctcccaaacgcgatcgcactgaagtccccatctccttatagagtagattatgatagtgtactttttccactgttgtgtttagtagtattgccttcagcaatgcatctgaagctgttatgatccagtgttcaatcaatcaaatttaatagataacaaaacattagcgagaatttggatgtcgttgatattggttgtcgtttttctattactgtgatatgagtttagatcattttatttt

SEQ ID NO: 55972 - DNA, 377 bp, Oryza sativa
atatttttggcattttcttgaacttttgatataattctttcatgtttctatgttgaagctcattattcattttctctttaatgttcttttcatcctaaaaagctcattgctacaaggtgatgctaatacttctttttttttcatggagtagaaaagacacattttctctttgtaaagtggggatcaaaccatttctgagtttaaggatatataggaacttgtgtatagttactataagaaactttttggtaaggaagagtgcaggaatgtacatttggggggaaatgtttggagtgcttctcttagattgaatgatgcttaaaaggaaaacatgatcatacctttctctcttgagtaactagacaaaaatatgaagg

SEQ ID NO: 55973 - DNA, 1501 bp, Oryza sativa
gaaacaaatcttgtcttcatagaagaacttcgtacggaaaagactttatcttgccaaacaaatgaattgttaggaatattaaaaggtatccttcaacattgtatttacttcaatccaacatgaccctgggaataatttcaggggaaaaactcagggcaaggagtgcattacatgtcttgagacaacaataaatctattaactagatcaccagacccaaaaaaaaatgattaaagcattctatttgagcagaaatgcacaaaggtgactgacgaattcgacaacacactaaagctggaagatgtttgctgagagttcccgtcatgaaaaaaatggttatatttgtggtttactgcataacatcagaacagcttctaaaatcatttcaacgacaggccaacagcacagacaaatatagacaatctacatttactacgctagagtaaagaagataaatgttgttcagcaattgacaactaacaaaccaaattatgttaatataattgttcagtaatgccttacccgctgtaataatcctttggcaggtaaacatcccgaacaggaccaaacctttcaaaaggaactcgaagatcctcccctctgccacagttaaggtaatcaatgaaattgaattaagtgtgtaacttgtgaattgaaacatttgtctctttcatgaagaacacagtcatcaaaatggaatcgacatgccaattttgcatagttatcaattttcactacctgcagcttaatgggatgttgcggaccaagagacttccagaaccctgctccctccgtcctccatatcccctcctagggggacttcttcctctgccaccatagcccctcctagggggactgcgatatggtgggctgtacctcctcattgttttgtctgaagcacataacagaaaatgttaacagaaagaagacggatggaacaaaatgagagaaattagcgaatcaattagcgtataggcacaagatttagaaaattactgcccttgaaagtgttaagtgtagagtcaaagagaaaagcggaaatataatcagaaaatatgttgggccaactattgcaagcataagactacattgcagagcttttcaagtccagaaaaaaaaaactacgtcaattaaaatcttactttaacacaccgcacagtttatatacattcaggtcatcagatatgcgtaaagcaagttcctcatgcattgcaaaactaaccaaagtttacaatcatagtagtagcatgccaaattgccaaacacgattttcatgccatgacattcccgtactactttatccataggaaaaaacaatacaatatatctaggagtaagagaatgatcgatatattagataaaaaaaatattcccctcccaacggaaatctctaacgcaagtttctcatgcactccaaaactaacccacgtacagaacgtcaacaaacgaagctatacgttctccacatctaagttatatataaatctaacccttaaacctgtg

SEQ ID NO: 55974 - DNA, 1501 bp, Oryza sativa
ttctcagccgaaagatgagacagcagtcagcagcggacagatagacagatttgtcaacttttcaggccggccaccacaacaaagcccacgtatctgcagtgcctgcaatcaagcaacacaacacaaacccaaccacgcacaaaaagcagtacactttctgcgtgacacatcctaccaacccctgcctttcactgctgcatcatgaaagtaaaaataaataaataaatactccctccgttttgaaatgtttgacggtcgttaactttttagcacatgtttgaccgttcgtcttattcaaaaaaaaattaagtaattattaattcttttcctatcatttgtttcattgttaaatatatttttatatagacatataattttatatatttcacaaaagtttttgaataagacgaacgatcaaacatgtgctaaaaagtcaacaatgtcaaacatttagggagtaaattgcaaacattgacaacaaccatggaagcaatgcacgccatggatcgatcacctgcaacccaacaattgctccatgattaaaagggattgcgtttgcagcagcagcatgatgctgctgcattcacaagtccaatccaatcgttgcagtgtgaggaagaaaagagaggcagtgtagtgtactgctggcccagtcagtggtagatccaatcaaaagctttttcccaaacaaagtcgatggcaatattggcatggcagcatgggcccctgggctaagcactcacaagcatagatagatgtggaaataggcggttacccagttcaaggctcactagtggtagtacacaacaccaatgtcacattgtttcaagttaatgttcagcaaaaagcaaatgaccaccaaacaaagcagctctcaaaagactacaacatcctggactcccaacatatgagcacacaaacaggcgatgtgccataccaaactcatggcaagcacacttagcaataatacaacacgccgcttagggcttcggtttaattgaaacagcttggttggaccagaaggaagatggagactgactagaattggaggtgctgtggagatcatgcagctatcccatttcgttggttcaaagttctgtcagtcgctgcgggcaggggaaacatcggcggacctagagcgggatcctggaggcgaccctgaggagtgcctaggagacctccggtgtggaggggatccatcgctgtcaggtgggggcgacctcctgtgaagaacataaaccatagttagcactttcactctatgtattcctgttaattaatacagaataagactaacaaaatctgtcgtgagtatgcagcaaagattaaaatgctgcccatagttcaagtgaccctaaggcccacatcctttcatattcatcatactttacaagtctacagaaggttactactcgtaaaacaccagattggtgtgtaaatggccctattgcaataatgaaaacaaatattgcatttaaggaaaaagtgatggaagtatgaa

SEQ ID NO: 55975 - DNA, 1501 bp, Oryza sativa
cgtcatcaaacatgtcaccacattcattaatcataatcatcagtacaaatgctaattagctatgctcattattcattgagaggtgcagtacagtccatactgacaaacgcgttaactacgtaaggttgtggggtagtcagcctgggtacgaaacattaccctttttatttatttgatattagattattctctaatatttatgtttttttttcagtcagtccataaccataccatgcaagtgcaacaaatatttccccatgtattttttaattcgtgttttttttcagtcagtacataaccattttttagtcagtccataaccatactccttccatcccattttaaatgcagccatgaattttttttatccaacgttgatcatatgtcttatttgaaaactttttgaaaatattaaaaaaacataagtcacacaaaatattatttatcttttatcatctaataacaatataaatactaatcataaaaaaatttcaaataagacggacgatcaaagtttgacatggaaactcatgactgcacttaaaatcggacggagggagtcccatgcaaatgcaacaatattttctgcatgcattttttaatggttttttacggtgatatttacgaagacaacagctattccatccttcacgttcttattatcagcaccatggaattctttttggctcattgttcacaaattttaaaacttaatttagaattgatttaaggtattttgtcgtagtttatttttcagcattcgtagtttttagatagctaaaaaatttaccaataacttatttcgtgagttctataagccgtttttatggcctaccagatttacgtgaaacgatttaactaagaagctatgcactctttctattttcttttacattatatcggttcaatttttaactaaccagcaacagaaaaaaaaacagagaacccctcttctgtttttctccgggcatacttatgtgatgttgcggcattaatcgaatttgatttttcttgttctattttagagcattacttattatttttgaacaaaaatgctcagtacttattattgtgtcatctgatcacttattgcctttttttttctttcaccaatctggtgactttcttggcaggtgactaatacccaggtaattaaagttataataaaagtaaattatccggttaaaaaattaacagccacataatccaaccttacctacgtgttcatgactccaacactcactaccggccactagctacacaccaaaaaaaaaaaaatccccgtgaaattattcacccccaaaaatatcccagccacccacttcctaccagcatccaaacattctagccaggaacaaaatggataaacaaattattttcccaataaaaaaaggaataaaactttttttccctcccgtataaatatccctccactgtgagcagtgggaatgggaaaaaaatccgagaggtttagccatggaggattggctcttctactccc

SEQ ID NO: 55976 - DNA, 1501 bp, Oryza sativa
gaaactggaggaagtagcaattaaaaatggtgattagatttaagttcctcttgttcttttggggtattagtagactgaactaatgctgtgctagtgcctatatgtacaaattactatggggagaacagtttggtacttctttctcataatcttgtactttgttgagcttaattacttaattgctaatagcaatctggttgtgttgttgagcttagttacttaattggtaatagcaatctggttgtgagatcccattcgccactattaacatgatgccgtcaagaaaatctaaaagaaacatcgtgcctttcatagcacagtctgcaaatgagtgaatagtgattagctattgcaggtttgtaattatcaggtaaataaatctgcaggaaccttcagacatgcagatttgttcatctgcagaaagatataaccaacctgcagtagttaatcacaaaattgatctggagggattggttgtagacgaacaccacatcaatgtgatgtgttctgaagattgctgcaaacaaaggttactgtccctgaacttgacaactattcatactcagatactggtactgcaaaattaaggatattcatttgctgatgccaccgacatgattaccgaaaatagatgtgaagagacatggaaaaaaaatgcatgatcaatagttcaggctattctacagtacattgatgatctctgtgccttggcaataaataaatcaacggcaaacagagtatggcaatttacagcgttccctaataggcagataaattatgtacctcatcatgattacaagctctgcttcataaacagttaccatctgaagttctggaagtgcatcaagtaagcatgtataggatacaacatggcatggtatgtgctctagcaaatgtactaggttgcaccagctagaaccacctcactctttattatcatcagcttcttcagactgtctaagccattcttgtagtttgagttcttgttcttccttgaacttgttataattctccaccgatttggagatatcagtcgaagagctctccttcatagtagctgtattgttatctaaaagctggcttgaaacaggaagatcatccttctctgtatctgagggtgtcgatgcaccatgtccaccagcttgtgatgattcaggagctgcagatgactctgactcctcagtggtgtcatcttttgttccgaaatcaggctgtggccatctgagagtggatgccttctgcttcgcagtgttgaacatggaagagaaataattacggctgcttcctccgtcggttgtgcccaaatcttcttcccatgttcctgagcttttccctgattggaacccccaagtggggttctggattaacctgagtgtagtgattttttctcagaaccaatgacggaagatgaactatatgcatagaaattatactttacgggaagggcctgggatgatcaagccagagctgtagagtggtctgttagttactaagtttagaa

SEQ ID NO: 55977 - DNA, 252 bp, Oryza sativa
atatagaagggaatatatattatgacatgttgtaaattgttatgtgacaaactggcaaatggcaatggccttttgttctccacagtcctattggttgtatgaagcatgaacatgcattagtataaagtagaatctagaatagtttatacaccttttaaattaagtggtgaacttgtggaattggatacactataatggaattggatacaccattttcaaagaaatgagttagggtcctcatacaataggagc

SEQ ID NO: 55978 - DNA, 184 bp, Oryza sativa
ttcttgcacaggagaaagagagaggagagagatgcacttacaccgactcctagtgctctgatggagtgaaactgtgaaagaaaggtttccagtcccagtgccatctcatggactatacacagctgtccaaaattgggacccacatgtcctggactgtatgtgggccccacacatcacgggctca

SEQ ID NO: 55979 - DNA, 1501 bp, Oryza sativa
atatatatatatatatatatatatatatatatatatatgaaagttgttttaaaaaattatattaatttatttattaaaatttaaataattaatactttttctctccatttaatattataagtcgtttgtcagtggccacgctgatatgtgggtctcatgctgactcatccgccacgtcagataaaaccggggtcaaaaccaccgaatgatctaaagtgaacggttttattagttgagggacacccggtatttctgtggttaggggacgattttgtaactcgatgataagttgagggaccttcagtatactttttcctttattctcttctcaaaccagtgtacacaccagtgtacgctgtgcagcccaaacatatgggccgcaaggaggaggaggagggaatcccactccgggccaaccgtaatggcccacaattacgacggagccccaactacatgggcctcaaagaggcccatgtaatcgaaagcccataaggcccacccacttctctattactatctccctcgcgtccggccgcggagacctcccgcatccccccaccgatttcgtcccctccggcggcggcggcggcggcggcgcacggcttctccgggagctctacgcggtaactctcgccgcgctctcgctctctctctccaccccatcctctattcacgcttgttcccgtgcgtgttcgtgtggtggtcatgcggtttccgcttgtcgccgcaaaccctagattcagaggtggctcggatgggtcgcatgattggctcgcgttgattcgggtagcttgacctaattggttatttagtggtaaatatgtgaattgactgaattcctttggtttggggatgctggttggtggttatttattcgtacgcacaggtttaagggttagatttatatataacttagatgtggagaacgtatagcttcgtttgttgacgttctgtacgtgggttagttttggagtgcatgagaaacttgcgttagagatttccgttgggaggggaatattttttttatctaatatatcgatcattctcttactcctagatatattgtattgttttttcctatggataaagtagtacgggaatgtcatggcatgaaaatcgtgtttggcaatttggcatgctactactatgattgtaaactttggttagttttgcaatgcatgaggaacttgctttacgcatatctgatgacctgaatgtatataaactgtgcggtgtgttaaagtaagattttaattgacgtagttttttttttctggacttgaaaagctctgcaatgtagtcttatgcttgcaatagttggcccaacatattttctgattatatttccgcttttctctttgactctacacttaacactttcaagggcagtaattttctaaatcttgtgcctatacgctaattgattcgctaatttctctcattttgttccatccgtcttctttctgttaacattttctgttatgtgcttcagacaaaacaa

SEQ ID NO: 55980 - DNA, 1501 bp, Oryza sativa
gctatcaaccatcatcatggatgaacaacacaaaagtatcgagacgctcctcggaatcgcaacatctgcaggcttagcagtcactgttctagttctgtccctcatccacatatcaggatgccatctgaaccctgcaatcagcatcgccatggccgtctttggtcacctcccttctgctcatcttctaccttacatttcttcacaaattctcggggccgtcgccgcctccttcgccgtcaaaggtctgtatcatccggtgaaccccgggattgtcaccgtgccaaatgtcggcacggttgaggcgtttttcgtcgagttcataataacattttttctactgttcatcatcactgctcttgccactgatcctaatgcagtaagtgtggttttctgatgtattttgatcagtttggttttcttttctttgaaatgtttgattcaaattttgtccttttgatcaaaatcttcatcaggtgaaagaactgatagcagtggcagttggggcaacagtcatgatgaacattcttgtggcagggtatgtgcgtatggattgattaggaacaatacatagctttcctgggtattttaaactgtcatgtaatactatttgtgttgtattttacaaaatataatttagatttgaataatttgaacaggccatcaacaggagcatcgatgaatccggcgcgtacaattggcgcggctattgccacagggagatatactcagatttgggtttacttggtggcaactccactgggtgctatagctggaactggggcttatgttgcaattaagctgtagtttacaccaggtaaagtaaaacaatattgtaaaggaaatcaaaacatttatcatattgtgatatatgaccattacattttaaataagtaataactctgtctttttacaggtaacttgtgactctttgagcatgctgatataaccatttcgccagaatgtaaataaacaaaattctactagctccatgatcaagtatagacactgtaattacttctaatagctgtttttttactatctccgtgaccaaaatgtcaataattacttgtaatagctgtttttactagctccaagaccaaaatgtcaataattacttgtaatagctgtttttagctatggtaagaagaacacttcagtgtagatacccaataaagtgtgatttctccaagtccatcaattctacaaactaaatcacttctatgaaaagaacaattgaatcactccgaggtctctgagcaaaacaaccctcattaagatatacatttttttcctgacagcatcaagttacagcggcaaattggatctcacaactacttttctatatgaacaattatgaaattaagcagaacaaggtacaagattacttttattaataaagacagagttcaaggggaatgaatcccagtacatcgccgaacagatgttatgtggcactaaaccatccttagataggaaactgaggataggaaccagacttcct

SEQ ID NO: 55981 - DNA, 1501 bp, Oryza sativa
attcgctatactatgaagtatctcgtcttatactagattgctatattataggacggagggagcactacacatgctggagaagaaataaataaacataattcgaaattaatcagacgcatatacagtagtaagaccatattgaccgggaacctaaacaatagggcgctaatcgtgattcacctgatctgcaatggccgaaatgcgcatcatcgatcaacaacgccctcttgcaaggtcaccaaaatgataggaatctacactccacggacgacgatcgtcgcccgtgcattgcaacattgcgaactcagctggagtacgagggtccgttggcacggctctaactttcaactccaacttatctagagtcggagctgtaccaaacgatccatattttctgtttttggagtgaagttagtagagctactcctaaaaaataaactacaggtgtagagctgggttttttctgctccacagctccactccaacccaaaagatccactaccctttaatttttaacacattcacataaaaatgtcactgaattatcccaagctcaccttctccccttccccccccccccccccaaaacttaactcccacatgtgggcaaaggcagcgggccgatggtgacgctcctgcggtgacggcgggcgatgcgagcagcgacggcgcacgggtggggtgcgcgggcaacggtgctccggcgggggcggtcggcgcaagcgaggacgacgtgtgagcggcgcacagcctgtgacgggcggcacgctgacaagggcggatgggtggtgcaggggaagtagcgcgaggccggcgtgcgtggagacgatgcttgggcggcgcacggccggcagcagggattcctttttttcaatattttttagatcgggagctaaaagcttgtcaaacacttttggatgggtctccaactctaataggagctagctccaactgaaatagcaatttagagctaggagttgaagtttatagccctaccaaacacggcccaagacttcttgagagagagtcggcagtgaggacaccatcgatttgtcccggagcgctctcgcgcggatgacaaatcgacaaggcaacgaagggttgcagttgtagtagcagtaaacagcagcagccaccggccaccagtaatcgtcgtcccatacgccgagctgtaaatactttccccaagcccacctgccgctccccatgttaccctcctctccctcccgcagtcgcaggccagccaaaagcaaagccattgcctgccgaccaccgccgtctgggccccgaaacactgcatgttcgtcgtcgtaccgtcgtacgcagccccccaccacgtggatgccggaaagccggtgacggcggcgtagcagcagcacacacaccgccggtcgcgccgcggatctaggctcgcgctcgcgtggcatgcattgcaaacggaaagatcgagagcagggtttcatttaccgccggggccgcggttaccgcgccccggcggtaa

SEQ ID NO: 55982 - DNA, 1402 bp, Oryza sativa
agttttatgcaaattaggccctgtttagttccaaaaactttttcccaaaaacatcacattgaatctttggacacatacatatagtattaaatatagataaattaaaaaactaattccacagttagggggaaaattgcgagacgaatcttttgagtctaattagtccatgattagccatacgtgctacaataacccacatatactaatgacgaattaattaggctcaaaagattcgtctcgcggtttccaggcgagttataaaattagtttttttattcgtatccaaaactccttctaatatccggtcaaacgtccgacatgacacctagaaattttgttttcgcgaactaagcaggcctcccttagtccctcctttgggtctgaaggatttttctcttctcttcactggagtagatcggcgaaggagtttcaccagcaaccgcccgccacggtggtcgccggcgatggcctccacctccgccgccacatccgccgccccatcccgcggcggcgcgcgggagtggcgcacggcgctcctcaccctccgcgacgagtcggtggtctcgccctccccaccggcgctcctcgcgctcctccgccgcgtcctcctcctctccgccgccgccgccgccccgccgcactccctcgccgcgtccgccgccgcggtctccgcccacgaggtcccccccccccgctcccgcgcagcttggtctctgctctgcgtgtgctctggtttcggtctctctcacactctcgtctgctgctgtgaccgtgtgcaggtgggctcggatgtggcgttcctcgcggagacggccgcggcggtgtccccctgcgacggcgccgatgatgtgctgcgtggcgtttgccatctggtgatgattctgattccactcgctcgagatcttgctttaatgtggactgacaatgatagtgtagaacattcagattgtctacggattgatgtcccttaattgtccctgtttaatttttccttcgtttcaaactagtacgtgggtgggtgttttggctgtgttcatctttgctgtgcagaggctgggagtgttctcagtacggttgtatcactttgatgttatctaaaaaaagaattcagatgggagaccattagcacaaaatgtatggcatttttagttctcattactctaagctctaatggttggtgagatatcgtgctgcgatatggaattctaatatttgttgatcaatgtgactgacgaattaaaaccgtcggatttggtttttgttcctccgtgtcaatttgtttgctgaatacttatgctctgatttttctgaaaatctactcatgcagattcatgatatcatgtacaaaacaaatatggagatcgactcgtcttgtttactggcaatgctgaagtttcttgat

SEQ ID NO: 55983 - DNA, 201 bp, Oryza sativa
  unsure (1)..(201): unsure at all n locations
agaagaagaagatcgaatttgtttgcatgataaacaaaagaaggattatttgagcgaggggccgcgattcaaattttgcagccttttacaagantaaggaggctcttgccgggcccggccttattgccaccgcgggctccccaagtcctcccattgccacaagccgccgggttcacttgtccgccctcccgccaccccagc

SEQ ID NO: 55984 - DNA, 1501 bp, Oryza sativa
attaccccttgggatgatgagcattgtgatgaaatcatttggaaaccatccactttgcagcatgaaaagctgaaggagctggttgtagttggcttcgagggaacagagagacaggtttactttgttaactttgtgatggaagtatcaacggcattgcagcttgttgctctgtttagatatgggcgtgttgaagaaatggggcgttgggactggaaaatcgtgaggctccaacaccattggagtgatgaggagagatcccagattctgaaccagtttgcccatagagattcttgctccacaacttcagttcaagtagttctagagtgatctcttatattaatgtgttacctgtatacaaggctttaagttatactgcatgcattttgatcttacggagtcactgtttgtcttatgtttatgcgcattcataccgcttattagcaactaaactggtaaaacttttttataccgttttagcctagttttccctaagtaactgttcactgtattgtttgttctcttttcctcattaaaatgagacaccttcttctatatataaaacgtcgataacagcctgaccattaaaaaaaagacatttttatatatgttattagcgattcaaaagcaaatgttgtaaaataaaatatgatgaagaaaaccacaaaagcaacttaaaaaattagttctaaaatttaaattttgacttttaagtataagcgaaaatatattgctcttaatttatttgtgttactttttatgtgtttttttgcacgaactctgtttttttttatttatacatatccgtttgtatttagttgaagccttatgtttctacctgccatccagtttcgttctcaagttttacttttgcctaatttaagccgattttccttctgctagtcgactggcggggggagcaaaatcgagcactcccctacatacgcgcacgtgtgccccccgggccccaccatttgtcatgccccaacctgctatgtgtctccacaaaaatgttttcacctagtgtactcataatgtttcactatatatagatttaatgttgtagtattgtagtactgtacaaaatttgtcctaggggtattttggtcatttgaacaaatttatacagtgctaacggaggttaaccggacggcgatggtaaatcgtagaagttaagcaaaagtcgatgacatattgtagaacatgacaaagtcagtgacaaatcatagacaagttagtggcatataatggattgtctatttcactagcgatatcagtcaccaaagcaagaagtcggggtctcggggaccattttgtcattttgtcaaactggacctaggcccattggacttcttaggcccatggaccgtacgtggagccgaagcttccggaacccaaaacccttcttccctagcaaaaccctctctctctcttctcgaatcgaaattgcgaagccgcaagcaaagccgccggaggaaggagcaatcgcgagtactcgccacca

SEQ ID NO: 55985 - DNA, 1501 bp, Oryza sativa
tatttataatggaacggatggggtatttaggatgggcaatattttggtagtgaggaggtatacaaattcaccacagagtatcacaaaagtaataaaaactatagatttagtgccaatttaatcaccaaaccatagcatctatagctataacatgacagattaaactctataatatgtagttttatgataaattatattgtaatgtatcgattctgtagttttgtgatagtctaatcgaagcatcgctagttctatactccccctccgccccataatatagcaacctaggacgggatgagatccatcgtattttaggttgctgcatcattatacgacggagggagtaaaatttacttttttttttctgttcccctcccgctacttgttgggccgtgggacccacggttcagtggctacggcccgggtcaccgagctataagcctcgcctcgcctcgccccgtccgcgcccgccgcatcaaccaaaattccaaagagccaaaaaccctagcgcgccgcatcccccgccgccgcctccgcctccgccgcgggtaaatccctcctcgtcgtctcctccgctcctcgtgccatctcgcggctgaacaggggaggggatcctggtgagcatccgcatcctctttctgatgatccatctctctcccccgacctacctttgcctggaatttgcctgcgttcgttaaccctagcttctcttctagatctggaagaagctcttctcttaatttcagatccttagccttaatacaattaacagtttgtttgtttgttccccaaaagtttggggttcaactgaattgaaccctcgtgtcccaagttggatccgcccctgcttgtagtagggtgagtagcataagcaagtttagcctgattgataatggaatagcagcatcacacgttttcgctttgattcttttctttcagtgaaactctgatatcatgatcctataactgctaaatgaatcttctgacgaagcgcttggtgatgcctgctaaaagagcagttgttgttgctgctgctgctgttacagtgcaggctttttttttcagctagctagtttagttgtattcccattgttactatgttttggcggatagaacttcagttgctagtatgcaacactgcttacattattctatttaaatttgcagctattgcctcatcttctattatagcaactcatcctataactgctgaatgaattttcagagaaatcacttggtgatagctatttttcctgctattataacaattgttatttttcctgctgttacagtgcagagtttattattctttttgctagctattgtttaggtttactcccattggtactatgctttggtggatagaactccaagtactagttttccacactatttgcatttttttaaaatgttgcagctattgcctcatgttctattattgcaatcatcctaataattgatcatctgtcatttaggttgctgttactgccatattttcaca

SEQ ID NO: 55986 - DNA, 1501 bp, Oryza sativa
gtaaatttggtacctcttggtacctaggtactatgaggtaccatggggtaccaaattttacactaaatttttggtacctcatggtacctcctcaaggactgtaaaattgctctttcattttagttcaaacttatccttgaaccaacaactctcttcataaatgacacttatatccctcatcattcacatatataagagaaaaattgcatgcttgaattttttatagataatacatagtatattatgtaaaacgaaaaaaaattatgcactaacaagtgtatacgatagccattgcttaagtttcatgtgcacatattgaaataatgggaagtacatctataatgttgtttattcatgttggctttctcttttctagtatatagatgtatacaaattaagggcaaaaatgatattttctaatagaaatattgactagaaatagccatatggcatattaagtggacccaaggatgattttaagccaaaacaaatatttgaaggacctatgtggacaaaatgaaacgtgaaggaccaaattgagccttcgctaaaacttgagggactaaattagctattcacccatattttttcacattcgtgtgtttctaaaatcctgcattccaaaaaagctgggattttgtgcacatatagttacatggacaaatttccctctactttgagagaggggtaggagttggtactcttagttaggagcatttacttctatagagtaaaacatgtagtaagccttcaaatttattaataaaaagataactgtcgctcgatcaagaatctttacccattttgcacatagcaccatgcttttccttcctaagtcctcaaatataatgctaacttatctttttttaatacgattccaattattgtttaagatgtgagctttgttttattatgaataattagatagcatataattattgggagtcactaacccaaacccattttcagatcaaacttgagattgtagtaattacaacgatatctagattacatatgaacaataacattcatatatcaatacttgtattgtaatattgaaggtacatatgaagctacattagtattttgtatatacataggctgcgttcggttgttggtgttgggaactaaatccgtcacgcacgtaaaacagaaagatttattagcatatagctaattaagtattaactattttttaaaaaatgcattaacatgattttctaaagcaactttcgtatagatttttttaagaacatactgtttagtagtttgggaagcgtgtacatggaaaatgagggagatgagttaggcagatagggtaaataacacaaccatagagttgcatctaatcctttagaactttgattttggttgacgatagaactaatgaatcccactgtaaggcgcacacatggtgccaactagtttaattaaaatgttatggcgggcaagcattgcggaaatcatggtatagatttttgacatgttgcccttctgtact

SEQ ID NO: 55987 - DNA, 1501 bp, Oryza sativa
ggctctttatcagctagtgttttcaatgcagaaatgattctgttcctagtaacagagttactctcagtcctgacagcatgaagatggatgcattttgacagcatgaagatggatgccggccaaataattctgtgttcttagcacatagaacagtactgcactgtttggtagttgaaggtggacttttgagcgtgtgtttggtttatgtctgtaaatgcaaaaccgtacagtagcaagtacgtactgaattttctttacctgatgcttctgcttctcatattgtaaacgaaggcttcagctcactaataacatttttaactgagttcagtggatcaaaactagaatcagacaaatgcatctcaaatactccgattagaaattatgcaagacgtcacctacacctagattatctgacaaaagcaactgagtgcttagattcgcttgagccactcatttaaggtgccagaagcaggataatgttctcatgtggatgtttttatcatttgatgcttttcaagagctagaaaagtgtccctgagaaaacgagagctagaaaagtggctacttgattcagagggaggaaaagggcaggtgtctaatcggtgcattagtagtggaataatgcttagcaaggacaaatcagaatgggattctggagagggcaaagtttggtagttaggatttaaagcaacaaactgattgatagataatagaacaaaaggtacagacagttgacaaacaacagaacaaaattacagtaaattcacgctgtaactagctgtttggttaggtcaggtcataacaggtaaatgctttcatcattgttttataaacttcagaaaagaaaaagtgaaataagaggtgaaactgaagaagagccgatcggtctttcagcttccagcgctttcagttccttgacgcaagagctctaaacagctaagcagcatagcaggcatggaaatatggaatgcaactcttgctctgctaccgtttgaaatgcaaaaaaaaataatattaacattttaccataacagtgcataaattattactacatgcctcatgtcatgcatgcaaccttgccagttgccaccaaatggccctgattccttcccccatttggagaaattcttactacctttatgtctatttaattaccttgaaaaaaatctctaataaatagcacaaaggaaatgacttatgcagctgatttattagccatcacattcagttacttaccaacctacacaaagtacgtacacaagcacaaaagttggaatcttttagtcaccaaatcaatcagcaaaagtcgcaatcagggtgtgcaaatgtgcaattgcccaatccacagacggccatgcaaaattccccccccccctcgctttgcatgcttaaatctcgctatccatcgccatggatggatgattcaaccgcaaaagcaacctagttagtacaaggcagcacatgcgctgctattagtagcagctgctaggtgtcctgctat

SEQ ID NO: 55988 - DNA, 1501 bp, Oryza sativa
cgacagatgacggattcgtttcagtggtggtgccatggcatggaaatgtatttggagcttttccgtgaacgaaactgaatgtcccaccttggaatggaagccggcagaagctatcagttccaaggttcacacttcaagcatcacatgggccagtgttgcccctgttctttgacatcgccacccggtaatgatcgaattggaaagcaaaatcgatcgagacaatacatctcgcgtccaagttacggaggatgccagatcggagccgtgccgtactactcatgaaagcttagacgccacctagggtggtgtttggttgtagggactaaagtgtagtctatctcacaaaaacataagtccctatcatagggacttatatttttgtgagaggaactaaatttagtccctacttcccaaacaccccctatatccacgtccaatcattgtttaggccgaacgaatccatcatgaaagctgcaaaatgcagctccaggttcaccaacggtgcaagtgtgcaaacactggatggtgctcgtccgctcgaatcacatccgtttttcccaatctccactgcacactacagtggactagtgctagaataattcttcccacacacacaaggtcagaatctctactattataaaaacgtcagcttttagtatgtcatccatgtttgaatcgatttttaaattcaatcgtttttagaaatataaatctgtatttgagccggtttttaattttgttcgttttagaaatacaaaaggagttgtataagaaatctctttaaaaaaacttgcatgctaatttgagacaatcagacccctaattgcggctcatgattttataaaaagaatatacaagcgaattcccacggtgaatttcaccttagctaaaccgtaaaacaataataagattaaaatagtcttcacccgttgcaatgcacgggcatttttctataaaactaaaaaaaagaattaacctcgtggttaacctaacccaaaacggattagagcttgatcaaatcatccatgcctgttcttctggtcaaatatgaatgaactacctgcggtggagtaggtccacgttcttggaccaagccgccaccgtttatatccatttgcccacccgccaaccagcgttgccgatgagaaaaaaaaatccattattttctctcctttttcgcctcggaacagttgagctgatcgatcgccggatcagagtagattatctccggagccaagtgaccggtggcggccattatttttcctttttagtttatatttttttgaattatttttatttttacgctcatcgtcatcacacgtcgccgtccctttcggtttcatcatcgatcggtttcatccactatcttcccctccccaataagaattcgatctttcggttctcggtgaaccaccccccgtgttttcttcgtatatagcggatcttctgggtctctgatcctgtgaatttcgggaatttttgtgatcgatcgatcgatcca

SEQ ID NO: 55989 - DNA, 1501 bp, Oryza sativa
ctcccaagaatccaacattggtctgacaactgctggaagaaaaagacctgaaattgcaaataataagatcagctgaacctatttgatagaagcatgcagagtgctcctctgatgagcaataattccatagaccaatccaatcataccagaaaatctcaggaatcaaatttgctctagtttcttgttcaaatgtttaactaacattaaagcagtctggttaatggcttaatgcaacaaaatggatgttctacacactcatttctagcatgaagagtactgagaaaagtctcagggaagaatattacaatcttgctaaaggaagcaaatcagagaagacctaaaacatagaaataacaatgcgctactgaggaacttcaatgaaggcgcgatacgaagtacaaaccagctaaccaaaggcagaaattctggtaaatacaagcagaaagatactaagagctaatcaaatttttttctcaaaaaacaaaactagacaaaaacttgaagccttaaaggcaatttcaggaaatcgactgattaatgcttccattctcaacatccctaaagcttgatcaccaaatacatgtagaactatctaaactggctacgtcaaattatatacttagattttacattaagagcactttcataatattaaaattttactattatacgggaaagctccagacatgtttctgaaattctgaatgatactttgcctcaaaaaaaaattctgaatgatactttgcacaatcagggtttcctaaagaaaatttagtgtgcccatacatcgggcaaagtattgaacttaaaaattgctaatcattgtaattttcaaatagaacaaaaccacatggaatctagctagttcactttcccaagccacaaagcaactcattgttcatgtggcctcaatgtattcctatgcatcaaccattttctgcaagccagtgattaatagaaggcatccagtgctggtatttaggaagagactttagttagttcagacaaaggaagaccctcaaccttttcaacaccgtttcaagtttcacccctggcagcataatgcaaactaagcaagcgtttcaacaccaattcagagttaccagggaaccccagggatactacatttcagcacgagattcaaaggacctttatcagtcattattaccaacctatttctctacaaccttaaaagcagagtcgtcctcctaagtccttctgccaatctgccccctcctcccactgcacgcaccgcttacacgagtagcgttcataggtaaccaccggatccaatgttttatccctaatctcgttataacccatccctacttatatgggcctggcgcattacaacgtagagacatatattactagtaaataccagtgaagaaaaaatgcagctgatagaatatccttcttttttttaatccaaatcgacaaggtgcatcttagttcttacacaggccaactccatttagctgagctaaagaatgaaattgtt

SEQ ID NO: 55990 - DNA, 1501 bp, Oryza sativa
ttgaaggtgcatccacaggtggatgaattgacctatcattatctaaggttttgttcgattaaaccctatctcaaggggatttgaaggatattgattatacacttctcactatcccctccaatctattactcctatgaaggctttgttcggaggcacttgctacggctgcggcaattcaaatcggctgtcagttgcaaccattcacaactgctgcaggctacggtagctagtctagctaaacgcagccgaattaaccaaacaaactctaatatggttaagggtttgggtttgtctccattttgatcatttttgaagaagttcacgtagtagtagtacaatactaaggctgtgtttagatccaaagtttagatccaaacttcagtcattttccatcacatcaacctgttatacacacaactttttagtcacatcatctccaatttcaaccaaaatctaaattttgtgctgaactaaacacagcctaaaatgaggaaaaaaaaggatttgaattttttcaccctccgaggggagacgcgtccggtttacccggggagggaagaagatgcagaggcgcagagcaccaatgcatatgcagcagctgcaggcggcagcagcgaccacttgtgacctgcactactacacgtcctccctcctcctccttcctctgctggcttcttgctgatttggtgtgatctcttctgatacgcatcaacacgagaagcatcgaatcgagtgtacatgtacagtagtcgacagtactactacagtatggacattcagccagctgcatcgatctgcgccgttggatcgacacgacgtgcggcccggatgcatctgtcggtcgtggactgtagcaaaccacagccagtgatgtgatgagtgatcaatcgatggatctctatatcagctgacctgatgcgttgggggatccaaggttactactgcgcgtgtatggatcaatctttggtggtagccagggtttacaaaaccatcttattattacgtaacattctcagttttttaaaccacggcatactttgttgtaaccgtaaccgtgcggttaccgtaataaccgtcaaactatagagtgacggtaactctacacaaaacagtttgacgaattatggtggtagcgtgtcctcttgttttctagggaacgaaagatgagagagttggttagaggggtccgtccattggagtactagcttaatttgatctcgattgatacttgcaaaggttgatgtttaatcatagattcggtcctcgatctaataacaatatctaacccctctgctcaatctaatttagtgctagtacatgtatctatctggtcccgttgcgtgtcttcttttctactactgctcatttgctttagttgtgttctttagttcatcggccagctgaaaaatgcttttattttcttagaatccctgccgtttaatttgaaaatgatgtgaatctgaacatatattcatggtagttcatacgaaattaatagtgg

SEQ ID NO: 55991 - DNA, 1501 bp, Oryza sativa
tggatgactaattccagttatctttatgtcatcactagaaggctttcggacaccaatgttctcaaatctgattgaatatataccaaaaagtgattggagataacctacagatatcacatgagtacagtagataactaagcatattgcaccaagagtgtcactcatttatttaaaaaaaacaagaacaaacttcttaacaagttaacatagcttttcacaaccaaggaaagaactggatttgcactaactcaacaaaaagatggaaaatgaaaatatatatatatctctcataaccaagtcctagcaaaagcgctttaatagtttagtaacaagtcacaaacagtctttttaaatgaatcgtcacgaacaagtttgttctgcattattttcagcttaccttgttcgacaacaatatcagaaactgaatgaaggacaacatgcttctcattcctcaaaacaccaaaacaaggaaaagtggcaggcctagttacctggattatgagcaggggtgttagatatattagtaagaacctaagagagaaaacaaatagagtttccatctcctatccaacatgcagataccttatagacaatagcatgtggagtcaaacacaacttccttgagcggaagtccttccggcacacatatatccaaattggcaagtaaagcagcatgaggagtcctactccccaagctaagatcaacaatactgacagcagaatccaccaagtaatctgatacttgacaaacttgtcttcagttgcctcaaatgatgcatcatagaggatctcatcctcacttattcccttataatcatccggtgataaaccagccaacaagtgcctttctaacacatctacttgtactatttcatctgtaaatcccatctgtgattgtacaaatcataactaatgttccaactgaaaataccttaactgggagcaattaatgggaggttgagaaataaaacaaccaacaagtaaaattaaaatttccttaatctgaccgtgcaaaaatttaaagctagcagacactctgaaacccttctttttttcttttattgaacgaacagtcaaacccaaatgattccaaactgtacttcggcaataacgagttgtctactagttgtttgaatttaatggctagggggaaaaaacccacacatttagcagcaagcaacagattgcgcaggctaggtcaattgcaggacacgaacacactgctactgctaataacttccaaaaatagacgcatcaaacgagttgaagcctgaaaatcacagcacaagatttcctagcacgaaggagggcacatcgaatcatcgccatagctaagcagaattccgggagcggttaagcacgccgccgactgcgacagcgcagccgattacgttccgccggcaaagtcggcagccggtagctcgaatcgagcaggaaccggcgcacctaaggtgcccgagcgagccggagttactacgagaccgatcgaatctcttaccac

SEQ ID NO: 55992 - DNA, 1501 bp, Oryza sativa
gggactgctcattcttcaacttatgctattggagtacccacactctccagtacctttgccttgatgttcattttagttcccacaaatcagttctcaagaacatgttattgtcaatgtatatgcatttatatttttaagaatatttatacgttgagctcatttcgccatattgttgtttttgcaggtggtgagggctgagttttgggggcagtgtaggactaatccatgaagttcctgagcaagaatggaagtcttagcttgcttatgtcttttgtaaaaatgtcatgactaggaagtaggaatcctgaagaacctgatcgtatgaagcaacggatggaaaactatgaactactactactactactactagtacatctattttgtgttttgtaaaaccaagttgtggcttatgaccactgtactgcttgtgcacccagctcattacatgctatagtatgtatttacatgagacctatagttaatgtctgagtgctttgatgttaagtaagtgtttgtagttgatggcctgaagaacagcagtttccagcaacattgatgcctgaattattctaccctgatcagagggtcgttgtgactgttagcgctcaacttggacgaaaattttttgaaattatactgtttatcaattgattgtgcaaaaatataccggatagcgaacgatttgcggaaataaaccattagtatcgctttttggaatagcgataccgatgttcgctcgttgaaagtgcgatagcgtggcgaaatcgcgatctgacagagcgatagcgaagttgagctggcgctctcgcgcaagcgagacgcgagaccgcagcggtatcgcttttcccacgagtgagagcgccacgtggagaaatccccacgactacctcgggcggagccatcgctctcgcactttcgttgcgcgagaccgaggccggtttcgtaatatgaaaccgcgagaccagttatgacgcgacggggaagacgtgggcacgcggtatcgcgctttgcgtgtgcgagactgctgacgcggcatgcgcgcgagagagaaagcctgggggagggcagtgggcccgcggcgtcgcgctttgggagcgcgagaccgaacacggtgtcgctatacgcgtgcgcgagagcgaggagcgaggtggggcagcgctgtcgcgctttgagggcgcgagaccgcttgcggtctcgctctacgcgtgcgcgagagcgagtgcatcgagggcgcgacagtaggctcggtatcgcggtacgcacgcgcgagaccgccctcggtatcacgctccgcatgcgcgagagcgtcgccgcttttcgccaccgacacctttgtttcccatctctatttcttttttgctttttacacggattctgcctctgactgatgaagaaatctgctgtccaggaagctctagatacatacatgttattagtagttgctactacttgctcatctattggatggtttcagtgtggagtctgaatctgtttgtgatgc

SEQ ID NO: 55993 - DNA, 812 bp, Oryza sativa
ggaattacccggttagacagcaatacagcatagattaagggtaagtaaatcgacccacaaatacacttataggacccatgggctatccaccttttgggctaggtcaacccacttacatccttagatagccctgttaaatatatattttagatgtaaaatgttccatgttcatctctatattagttttgtcaaattgtctacttgaaaactgaattggtaaaatacttacattttgtcctcatatccatgtctatcacattgtcactgcatcgttggtacgaaaaaaaattgtcactaagtcctcaatattgatgaacaagagactaattgaaatggaagccaatggcatgaaaggcatggtgtgatgtagatgataagactttagctacaatgaatagagctaattcgaaatcagctatcatgaatgtataactctagcatgtagtctgtatcttgtttatcacataaacttcgggcttgttcacttcattaccaaaaaaagaaaaagaaaaagaaaaatccttatcaatctttggcattgccaaattttggcattatcaaattttggtaagataagatgaagatgggtagtatttagtttgattcctaactaaatattgagagtagtcttgtgagtataaagttataaaaatacaaaatttgacaaggttgtgttggtagtgatatgtttagtttggttcattatcaaatttaggtatggaatggttgagaacagtaaggaaatgaacaagctcttctttcaaaccacagtggatgcagaaaaccatatttttctccccttttttgttttg

SEQ ID NO: 55994 - DNA, 976 bp, Oryza sativa
tgtcgaacaaggtaagctgaaaataatgcagaacaaacttgttcgtgacgattcatttaaaaagactgtttgtgacttgttactaaactattaaagcgcttttgctaggacttggttatgagagatatatatatattttcattttccatctttttgttgagttagtgcaaatccagttctttccttggttgtgaaaagctatgttaacttgttaagaagtttgttcttgttttttttaaataaatgagtgacactcttggtgcaatatgcttagttatctactgtactcatgtgatatctgtaggttatctccaatcactttttggtatatattcaatcagatttgagaacattggtgtccgaaagccttctagtgatgacataaagataactggaattagtcatccacatgatttcaggaaggtactaaacattttgatttatctatctcagtctatctcgagtttttgtctcattcagacatgctttcttcaggctgttcttgtccatcttttgaatacaagcaatctgaatctcagtagaaaagcttatgtacacgatgatcagcagagcacgagttctaaacctataactatgtcttcggtatgtctatttcttaatggtaccttttaatagtttaaactgtaaagatcctttgcatttagcaagccctggagctatgagatccaacctttctgaatgtgcgatagttataaaactaagaacaagcatatattttgtatatcgaggttctgtttgtataataccttaggaagtattgtattgtagatatatagcttctaacaacatacatggttttgctaagtcaagattgtatttccatattaccctattaaacttggctaatgttttcattttacagaccattttcactgatccccgtgttttgcatgatatatatacaacacattgaatttttcaggttcctcctcttggagatttgatacttgagaag

SEQ ID NO: 55995 - DNA, 1501 bp, Oryza sativa
ttagttggagggaatgaaaccgatcgtcaaatcccgaacggatctccaatccgcccatctccgaacggctcgaggtttggttgaaactcacctgcttcatctccgactgggcgggcgcagccgtcgagttaacgggaggcctctctcgaagaacagtggtggggggaggcggatttcggggcccgacgcggcggcggcgcaccggagagaatgacgccccgcggcggcggcggcgaggagcggcgagctggtggtgggtggggaatagggcaaggggatttttattttttttttatttttttttcttcacaaatgcgatggccaatggaaaatggaaaatgaacggctatatttgcctgtagtttgctgtactttgctggctttcctaaagatttgatagtcatcaatatttgtaaaaatattttgtaaaattttaagaagggtatgacattgtggcaaatcacattttttatatgaacttaagcatgtgagattatggtcaaagttttaaattgtataccaaatattgtcctgaatattaaatttctacgagaactttatcctaaagattatcctaaatattaaatatcaaattttatatcaaagattttttttattggtatatatgctctcctctcatcaatcttttttttccttctatgttatctatttcgttttcttctccaactagaggtgagtcatcgcaaaaccaagctttaaaaagcagagaaagaggacatggaaagagaagaagaaaaaaccgagttttaggattttgacgggttggataatacaaaacgtgataaataagtagacataacatgttttttatagtatgaataacatgttaaaccacatgttttttgaactcataaatggtataattattttaaaaatatatatatacatgtgaatttcttacaatattgtttaaatccatttcactttataatttaatcattcatttataactgttaacaataatcataaattattcagctactcagccatatgtagcacaaaacaacgtggacatgcaaagaaaaataaaaaaaaacagccctacattttaacttcgtgccaaaaacgttaagcagtaaattataagtaatgggtaacactaaaaggaaaaaaaatattcgcttcatccaataaacacaacttaaaatatgatatgatgaacacagataacgttttgttgtataataaatctggatagttcatgtgtactatgaattctggttggttttttatgggacagagagattactgctcgttcagatttatagtatttggcgtccgtttaaatgttgctatattttaacggggtaatagtaataaacccgttttgttttccccaataatgccaaacatcacacgctaagcctgcctgctctgctaatccccctacgcaacacaatccccttctctccttccccggaagaagaacaaagagcagctgaggcgagcaagcaaaggcaacaccaagaaagcatccaag

SEQ ID NO: 55996 - DNA, 1501 bp, Oryza sativa
ctcacctcacctgtggatcttggttgggccttcggggtggttgcggatgaggaggacgaacagaggcgagcgttgtggaagggagggagagagagagagagagagagagagagagagagagagagatcttggatgctttcttggtgttgcctttgcttgctcgcctcagctgctctttgttcttcttccggggaaggagagaaggggattgtgttgcgtagggggattagcagagcaggcaggcttagcgtgtgatgtttggcattattggggaaaacaaaacgggtttattactattaccccgttaaaatatagcaacatttaaacggacgccaaatactataaatctgaacgagcagtaatctctctgtcccataaaaaaccaaccagaattcatagtacacatgaactatccagatttattatacaacaaaacgttatctgtgttcatcatatcatattttaagttgtgtttattggatgaagcgaatattttttttccttttagtgttacccattacttataatttactgcttaacgtttttggcacgaagttaaaatgtagggctgtttttttttatttttctttgcatgtccacgttgttttgtgctacatatggctgagtagctgaataatttatgattattgttaacagttataaatgaatgattaaattataaagtgaaatggatttaaacaatattgtaagaaattcacatgtatatatatatttttaaaataattataccatttatgagttcaaaaaacatgtggtttaacatgttattcatactataaaaaacatgttatgtctacttatttatcacgttttgtattatccaacccgtcaaaatcctaaaactcggttttttcttcttctctttccatgtcctctttctctgctttttaaagcttggttttgcgatgactcacctctagttggagaagaaaacgaaatagataacatagaaggaaaaaaaagattgatgagaggagagcatatataccaataaaaaaaatctttgatataaaatttgatatttaatatttaggataatctttaggataaagttctcgtagaaatttaatattcaggacaatatttggtatacaatttaaaactttgaccataatctcacatgcttaagttcatataaaaaatgtgatttgccacaatgtcatacccttcttaaaattttacaaaatatttttacaaatattgatgactatcaaatctttaggaaagccagcaaagtacagcaaactacaggcaaatatagccgttcattttccattttccattggccatcgcatttgtgaagaaaaaaaaataaaaaaaaaataaaaatccccttgccctattccccacccaccaccagctcgccgctcctcgccgccgccgccgcggggcgtcattctctccggtgcgccgccgccgcgtcgggccccgaaatccgcctccccccaccactgttcttcgagagaggcctcccgttaac

SEQ ID NO: 55997 - DNA, 1501 bp, Oryza sativa
ttctgacagatttgtgtgatcttggtgaacttacacactccaaatccacggggatttagttttaggattctacaatttttcagctgtgcggttagagattgattgtagtgaggattatgtatgttggttattactgtagtgcggctgaaagatgcatccttgtgtgttcggtcccagttttcttgcttgggtttggtatttgcccgtctgattgtagtatcagctaaggatgcttttcatttacttgcatatttctcaaattagccatggtgatcataatctctaataggaaagtatggagtattatatactgatgcctagttgctgttgtgaccaagtgtattctgcgagtagaagcactttattttgggctggtttggcagtattcatttgatggctagttctacacctatgtctcttctgatagctaagttctgttcatggtctgtatgctgtggccagaaatgtaaatgtagatgttatttttcaatgttttgttgttgttgcagagcttgcgaaatctatgttgaagtctattgatgggatggttccattaagttcatgtacatgataactaaccacataggttggaacttggaatattgtctttttagctggtttgtcaccatgcatgacataggcaaaaccaatggagtcaataaacaggatggttctgaagatagagtacaataaaatagctcagtaaaacaatcttctttagtatgtttcatgtgttctttgatgctttttcaatcagctacctcatcactgtgcaatcttaccgttgctttctcccgtgttcatgaaagttatgtcattcattcaatcattcttgatgtgtaaattctgatcaactctttgatttgcctttcacttgtcaaattacaactgaaagatgctgacttttttgggttgtcaacgcacagtttgagaatgtacaactccctcgtggaacgatgcttcacagactgcgtggacactttccgccggaagaccctcgacaagcaagaggaatcctgcgtccgccgctgcgctgagaagttcctgaagcactccatgagggttggcatgagatttgctgagcttaaccagggtgttgccacacctgactaatcaattgggtttggtttctaacgttggcaattttgtcagcataaaatctgtaatccttaaatatttgagtacttgaggatacgagagacatcatgttttcctcttaaaccgatgggcgactgctgggtatcaagttgaataaatttatattaaattcccatattggtagctattgagaagagccatatttctgaatatttttatggtatatcgtgtaatctaattctgttatgtctaatttcatatcctgaggttacaggaaccttaagtacatttttttaccattgctgtgttcaatggtcttgattcacatataatagtatccaccatctgtaaaggcaccttttcccttgccctctctctagacatctgctttgattgagagcaa

SEQ ID NO: 55998 - DNA, 615 bp, Oryza sativa
  unsure (1)..(615): unsure at all n locations
caattatgtcatcttacatgtgaatctgttcatggatagtgtggttttgtgnaactacactaccaaaatatatgtacttgagtgccacgtgtcaatatgtatatagttttctataatttggactataaaacatgtagttttgtgaaatttactctattttttaaggaaatatttgcgttgtccatcaactagcaacttgatgtgtttaatacatctatccttctgcttcttttaaacgtacaactgcaactcactgaatctatgcgattcaaagtgttgttattaacactctcatgttctcatgttgcgataatgttttgtttcctggttttgaaagatcagtttgtctgtctctcacactgacaaatcaccatctggtagttcccaatctccagaaataacaaccacaagattataaatgcatgcattatgagattggttatgcatgtaattatcatatcaccactaactagctcatcaatgttatgctgaaatgtaagaatccaaccattcataatactagaatcaatcgaaaaaatacaactaatttaatattaatactacacaagaacacattcaccaccatctacaagaagaaatgagaagaaattaaga

SEQ ID NO: 55999 - DNA, 1501 bp, Oryza sativa
tttctaaattctgttcatttgacctgaaattttcacgctaccatcaggaagcctaccggagggactgaaattccgaaatatcagaaatttcaaatgaatagcattgaaaattactaaatttgattttgtttgctaaattaaaaaaaatccgtccggaagaacctcctacaggcacccacgggtaataacgaaatttcagaaaattagatctgaaattgtaaaccctgatacgatgctgtgagatatcgatcccaacaacttcaaattcagtgaggtatatgtatttgtggtttgattaaaggcacgtatttcaaattcagttgatacatgaacatgttcagagcaggtttgatttggtcataaaatcatcaaactcaaatgcagtctaggtcatgcaataaatttaaattgaattcgtacagcaagttaatcaaatttgatgtgtacaagatatgtttaagtacgtgtctggtgtagctagctagcgccgtggatttgaaggaacgatgatttggtcagtagcttgagggatctgaattcttggcgtatgataaacttgagttcaaaaaatacaagacacatcagttttatatttcaattcgtgtaaaccattgaattcaattcatgcaagggaactgaatttgcatatttcaattcatactcttagctcatttaaattgacatttgcacgatgatgagtgtgccttttgggggtggaactggtataagtttgacttttggggaacttaatcaaatccagcgtggttcaagcaagaaatttgaattcaactcatacaagaaacgtattcaatttcaagctgtgcaataatgcatctatcttaagcaaagggtctgcatcatagtactgatgcatgattgaaacagctaagaacttgatcaaattcaacggtttttcgtgatgaaagtttaaatccagttcatacaagaaacttattcagattgtttgatttaaatatgagcaacaaggcgtcgaccttaagcaaaggttgacatcatggtgtgaaagcaaatttgaacctggccaaaacttggatcacatttgtccagaaacttggttcagattaacagtaattaaaataatgcaacctttgcacgtaagcaactactccctccgttccataaaaaaccaatctagtaccagatgtgacacatcctagtattatgaatctggacatacatatgtccagattcatcgtactagattatgtcacatctagtattagattcgttttttatgggacggagggcgtatataaaaatcgtcaatatttttatattttagggcacttatcaatactatcttcaactaagaatgacgcaattgcaccccaaacaaatatgcttttttaaaactccgggaaatgcatatagaaaactgacgtcaatgaatgataatgatttttcaaggccatttcaaccagctacatctttctggcatgataatgcttgaaataattgtgcagcttattctcaagcgtac

SEQ ID NO: 56000 - DNA, 711 bp, Oryza sativa
gtatttttaggatttaagtgtattccaaaatagttgtcacaatagagtattaattgtctcatcaatcaattctcattcaaatttttttctattctacccttaaccactcttacctatatttcatttaatgagtggcatcgtaatctttttttaaaaccttaatatatgatagtaacctaaaattacaattattttagtatggaggtagtatttatttttttctttgagaaacacagtacaaacgtaaacactcacaacgtgcgtaaatgcacgcatgcacgccgtatccctattagcaccttttcggaaatttcggtctcctgatgggaactaaaaacacaatttttttaattaagaaaaaatattcatatgtttttaccggaaaatatacttttgagtccaaaaatattaatatgtggccaaaatcagttcaattgaaccttttccgtccaaaattccgagttttgtttccattgttgcctggagatatatatatttttagtggagtgccggaaatattttggatttcccacatagagccctcactacatgggtccaataggttgttaaaaattcctaatttgttcgaattcggtaaacataattgttcaaattcagccaaaacatgctcaagttcaaaaactgcagcaaaacatcattcaaaatttccgaaatttaccaaaatttcatctttttttttcttgcaatagg

SEQ ID NO: 56001 - DNA, 1501 bp, Oryza sativa
aaattgccattttattgggtcaggagttgaagagaatgcaattgtttgtagtgtaagcaccggctctgactgataggccaggattcaggagaagatgatgaattgcacagccgaaccacttcaggaatcttgttgtgcagtagatggttggcaagagatgaaccatttgtgctactagcagcactgatgcaagtcttgaattgtatttcacttctctttttctttttctttttatggagatgagatgcaagtcttgatcggaggccttatcacaaacacttcaatcatttgtcttcagacaagtgtttgatgtatacagaaatactactttcttgaagtcacagagaacatcattgttgcaatttgcaaatgctgtgaagcccacatctgaagttagaaaacgacaactgctggttgtgttttcagactttctggatgctgtcaaacaaggttgtattgaacattggttcagcagtagtagtactcaatcccaactggccatgaatggtatttctgggcaccaaccctgcgtaataggcatgtaataatatgtgagataaattgtgttatgcgaatttcatgcgtccaatttggactgagtttatttccagaaaattcaaaggattgagttgttcagtggggactggggacagacgaatttggaacgaactaagttctaggagttacctatgagtatgagtccactgtctacatcttcatttctgtttttcaaagcactgtaatgacatgaggtacaacatttgtttcaggtctttatctgatgttaacgtgcaaatgcttatgaacttggagtttaagtgagcaattcatgattcaacatgaaggcattttttctttttttttctcgaatagacaggagagctgcatatccttccatataagaagaagaacaaaaataacatgaaggctttattttccaaaatatcaaactttgatttcttttccctaaaaaacttgtactacactaaagctctgcgatatgtaaataaaaaatcaccaggagtggtaacattgaactgaaaactaggtattggcaggatcatgttaccggaatttatacttggactcttggagaacaaaaacttcctgtacaatatgcttagctttccagaaagcagcgtactgccattacagcatccggttctgattcccacttatcacccaattgccactgtgtggtatttttcctatatatcctaatatttctgttcttccatctggttgtttcctgcaaacaaaaaaaaatccctatccatttttatctgttagcgcacttgttctctgaataagtttagctgctcaccttactacttggtgtagttcttaacatatctgaaccaaacatggtatgcaagtcatgcacttcattttcagtcttgcagaacagaaaaatcatctgaatttttctatccaaaagttcagtgagcaactcatacacttcaattatacaggatatcccttttttttttgcaggagcagc

SEQ ID NO: 56002 - DNA, 1501 bp, Oryza sativa
acactaatctttgacttataatttctcatatactataaggtttattgtaacaaaattataaccatcttaaagtaaatttaaatgtcaatccaatgatataaattttagtaaaaaaataatttatattataataatcattggtcaaatgtttttaaagttgaattttggaatgtgtgcacgccttatattataggatagagggagtatataacatctttaatttgacttttgaataggcatttcatcattcttcttattcaattcttttaccaataaaatataagtcatgtttttcaatttattatacaaataaaatttaagccatgtataaaataccttaaatgataaaacaatcattaatagtaaataaatgacaattacgtgatagttttaaataaaataattagttaaatatatgtctagaagttaacggacattgtatctttatctttacctacttaaaaaattggtagtgtttttacgtccatcaatccaacggtcatgacctccaacagatccaacaactagatcgctactcctcgactccttcccctcgcttactgcctctgcccccacttcccgagtcagagtcgaagttgatgagtaggaaagaagccatgtcggacatggagagggaaagaggagtgttgatttgttgatggatccgatttcaatcaccctaaacaaaatcagtattaccaaaaaaaagagaggaagagatcgaccgattgatttcttgggctgaggtgatttggacgatatgagtaggggtgcgatgcatggccaacatgcagcaacatgtggcgacaagagagctctcggtcagtgtcggctactttgtgaggaggcggtggaggggaggtctggcaatggcttcctatcttatcgatgaaccttatcgatgttgcatctttacaatgataagctacgtcatgtgattattattattgttgtaaaaacgtgaaataatacgtggtttaatatgtttgccttcactcgttgcaaagtaagatattcttgttagtacgttaaaagaaaagagaagtgcatacgatgtcggtcgttgaattcgccatatatattaatcaccttaaaaattaagatagcatactacatttttgttctccagccttttttttatatttttttttcacaagtgcgagatacgccaccacttctgtgatctgttgatcgatcttacacatatgcatgcgtgcgtacacacataacgcgcggacgcatgcatgagctaggtgtaattttatagttgatcaatcattcatatcgattgatgatcagttggctaattatagcttgagcttggcggcgatggcgagggcgccggtgacgacgcggttgacgttgttcttggtggccttgagcgcgaggctgggctccagctcccgctcctcgtaggcgttgccgcagtcgccggtgaaggtggtcgccgccgacatcttggtgatgaggctcgccttgctgtcgttggcgtcgatgcagc

SEQ ID NO: 56003 - DNA, 1501 bp, Oryza sativa
tgagcttgagcttcttcttgcagggcccggcgagccgcaccggccagatctggtacgtcttcccggccggcacggcgaggacggccggctccgtcgaggcgcaggcggcgttccaggcgtccaagaaggcctagacacgaaaagacagagtgcaccgtcgtgccagagttctcgccgaccaaaaaaaaaaattgcaccgagctcgaacacctcacctgcgtgtcgttggtaatgccgtcgccgacggcgccgaagtcgtcgagggtgaggagcacgcgcgcctcgccggcgccggagaagaagagaacaccagctgcaacagccatggccgcaacaaccagccgcatcacggacacacgaagaatcgccattgcttcctgcaccaaagaaccgaacaaggagacgacacgacacgattgaaggagaagaagaagaggaagattagaggaagcagggcaacaaaatagcaggacacctagcagctgctactaatagcagcgcatgtgctgccttgtactaactaggttgcttttgcggttgaatcatccatccatggcgatggatagcgagatttaagcatgcaaagcgagggggggggggaattttgcatggccgtctgtggattgggcaattgcacatttgcacaccctgattgcgacttttgctgattgatttggtgactaaaagattccaacttttgtgcttgtgtacgtactttgtgtaggttggtaagtaactgaatgtgatggctaataaatcagctgcataagtcatttcctttgtgctatttattagagatttttttcaaggtaattaaatagacataaaggtagtaagaatttctccaaatgggggaaggaatcagggccatttggtggcaactggcaaggttgcatgcatgacatgaggcatgtagtaataatttatgcactgttatggtaaaatgttaatattatttttttttgcatttcaaacggtagcagagcaagagttgcattccatatttccatgcctgctatgctgcttagctgtttagagctcttgcgtcaaggaactgaaagcgctggaagctgaaagaccgatcggctcttcttcagtttcacctcttatttcactttttcttttctgaagtttataaaacaatgatgaaagcatttacctgttatgacctgacctaaccaaacagctagttacagcgtgaatttactgtaattttgttctgttgtttgtcaactgtctgtaccttttgttctattatctatcaatcagtttgttgctttaaatcctaactaccaaactttgccctctccagaatcccattctgatttgtccttgctaagcattattccactactaatgcaccgattagacacctgcccttttcctccctctgaatcaagtagccacttttctagctctcgttttctcagggacacttttctagctcttgaaaagcatcaaatgataaaaacatccacatgagaacattatcctgcttctg

SEQ ID NO: 56004 - DNA, 1501 bp, Oryza sativa
aaacagtccctttattatttgtatgccatttaaatgattatgaaaaaattaaaaaaatcaacgagataaattaatatatgataaataactttacaacatcaaatttaacttctacaagttacaacgaaaataataaatttaactatgaatatatatattaactagccatagtttaatttgttttttattacaactagtagaaattgaattttaacttacatgttgatagagtgatctatcacatattaatccatcttgttaaatttattatcattctttttataataatttaaatgacatgcaaacatcgagggattagaattcactctccatatagtagtataaagggtttatactctaaacgtacctctaaaatctcaactgttcccaatctgaaccgcgcgtatccgatcggacggtgtaggtgacctcgccgccgctgccgctttgccggcctgccggggtttgccgccgccgccgtgtctcactctcacgtaaaatgtggcctctccaggaatttctagttcaatttttcaactcgaaaaactgctgccggattctatataattatctcatgacctgaagtacgcaaatattaggaaatgacaaaatatcaaataattagaaggggtaaggatttaatctcaggttgtctagcccaccaccttataaaactagccggaatacctctggacgtttctcctccatggcatgaagtctgaactctgaagttgcaaattgtcccaaatttgaatgtggaaaggctgttccaggtgacgtgtgtcacagattaagaggacatcattaacttccacactcgagtggattaatcgaagccaataataatggattcatcattaaaatcgatcctcatccacagcgcctcgctgctcttccaacaagaagttcagaacacactctgacatggctcagtaattctttactgttcgctcaaattgctacatattatacagattgcagatcaaagtaagaaacgctgcagaaacaaactgaaagtttccggcgaaagcacgggagactaacctggacaaaacaatcgatcatggcaaacacgcacggttaatttctcccggcttcgacgacgaggagacatctgaaaacgaagctgagacggaggcaagcgtacaccaccaatggaggaagaagaggggtggagactggagacgacgatgggtggccgtgcgtgcagagcgaggcaaagcgaagaagagtacaaagattcgcacttcgcggcaaaatattcctaccgcgcgagcgaatattcctccgagcgatgctggatatgccctatacgtttccctttcacgaaggcgtcaaatcgttcgaccacgtgatccactggactctctctccatccaaggcccaatttaccgcctacaaaggcccatatttgaatgggccctaaattttgatcggccttaggtgggcctcgcttatgagagcttcgagagggcccacgtgtccactctctctctctctc

SEQ ID NO: 56005 - DNA, 1501 bp, Oryza sativa; identical to SEQ ID NO: 55900

SEQ ID NO: 56006 - DNA, 1501 bp, Oryza sativa
gcattcagaacctccagaggctcgcaagtcagatattagatggagactctacgtcttcaagggtggtgaaccactcgaaggtagttattcttgacttgttactctatatatgaagctaacttttttccttttgtcatgctatctgttcgagttaatagtttttaataaatagaagaaaaaaacattttttggatttgccagtctgtagaggcatgttcttgtctagttcaacagctgtttctctatttcccttcccaacatggccaaaccaaaagtaggttctgttaaaagcagtaagcttaactgactgtgatgaagcgagtatggaacataaaaacattttcgaactagcttaatttcggagagttttggaacgaaccatttaacgtgagcaaaggcactaacgagtgggtcactatgatatgagcttgcattgaatcagtatcattatttacattttccccggggagtaaaagggctctttcttttctagagtaaggtcgatatgtgtacacggcacagccacccaagttaaatgcatgcgtgtgtgcacgtgcctaactagagtggaggtctagatctcataaaaggtgttcacatgctttgagaactaaacatgcccttatctgtggcttagttgtctagccctggggaaaggaaagagaacctttgttcaatcgatggatcaaacacaggaccattggtttgtaataatgaagcctgcctagtgctttgctattgttcagttccttacgatacactggcttgtgaatatatccaatgatactgtttgagcattggtattgtatggatagctcactagttttagttttgaacggaagtgaaataactgaagtaatgaagtttattgtgatgaacagcaagttaaaggttgggcattatagtggtataaattaaatgtgtacggtggtaaaaaaattcacgtgcttacattagtgattaaatacttcagttttgctcttcttgtttgactgtgtcttgtgatgctatcttgattgaacagaaccattatatgttcaccggatgagcagctacctttttggaagggaacggaaagttgcagacatccccacagatcatccctcctgcagtaagcaacatgcagttcttcaatataggtaagcatagcaatcttattgttttttgcctttactagcatattgcctgtgcgtggcaacaggattttaaataaagaaaattatcattaactcattattatcatcattttctgtgtatatcgccccttaatttatgtatatatttgttactgacatgtgcactgtcctattttcttctcacaaaaagtaggaagttggtggtaggggtggttgacatgtaggccccccttttctattccaaaaaaactagggagctggtggtggggtggtggcagattcaccactcaccatcaccactgctcccttttaaaaggagtatagattgagaaataatattgtgattcactcatctctttgccttt

SEQ ID NO: 56007 - DNA, 1501 bp, Oryza sativa
acgactagttgatccaaattaaatatatattttttgatggttcagcaatactaaggctgtgtttagatccaaagtttggatccaaacttcagtcattttccatcacatcaacctgtcatacacacacaacttttcagtcacatcatctccaatttcagtccttttccaaactttacaacgatctaaacacagcctaactaacaaaaccgttgactcaccaatcgccacacacattgtcgacaagtacaagcgccgtacgcaattaaaccctacctatgtaaagagctcgccgcgagcgctgcatcttgcaaacacacatgcatacatctctcgatccatcgatcgaatcgatcagcttccttctgatctccttcattcccgccatggagagttcgtctcgatctccctgcatttgcaagctgctgccgatgctgatgcttcacgtcgtcctgctcgctcctccgctgctccaagctcggccgctcgcgctcggacatggacatcgtctgctggagtcgtcgccgccggttataatgctgccgaccgacgacggcgaggccgtggccgccgcctcgccgggactggatgtgccgggacagctgggacgatccggcggggcgccgccgccgcctcagtcaaatcggccggtgacgccgctggccggggtcgacggcggcgtgtcgggggggagggcgccgaccaatactccgccgtcgcctcagccgggtgggtcgacgaagccgctctccgacgacgacgggaagccgccgctggggatcgctccgccgtcgccgcagggaaacaagccgcctatcacgtctccacgtctccgaacaagcacggatcccccgctccggccgccggcgccggcggatgatgccgccggtttgctccgcctgatccgcgacgccgtcgaatacgtgatcggcgaactcgaagcctgatcgatcgagaccgaggaagaagatgaagttatataaactgtaccattaattaccaactgtatgaatatatgtctagcttaagtagacgagcacatgtgtatatttattttgcatgcatgttaatttcgtcactagctaagtaggctagcatatatatctatcgatcctcatggtagtatttcgaccttaattaacatgtatcttttcgatgtttcaataagtctgaaattctgaatcaataaaaactaagttgtattcagattggtgtcttaattataagtttgccatgatttaataaatttcaaaatttgtaattaataatatccggttgtacttagtttgggtctcacaattataatattttcagttttgataactttatagaatttgggattaatgcttattgtcgacgggctatactcgttgacgagatttgtagagtatactcaaatagttatagaaaaaattaaaaaaaaaatagtaacatcaattgtgatgatataagtctatacacaaacatgcatgactaaatttgatctataactaaagaaacaaaa

SEQ ID NO: 56008 - DNA, 1501 bp, Oryza sativa
aactctatcgtcgctaggaacaatgacttgaaccctttctcatcttttctctcccgatcctacccatcccagacttaacggttagatgtgttttggtacctagcggtaccataaagatgctccatggtacgagcgtgatatgacaagtagtagtactagtacagtccatggtacattgagattcaattacaacaatcaattataatgagtaattaaacaactatataaacaatattatagtatactacatgataagatcgatagctctatagcaagctagcttactgcttgcaattatttctgtagatgcagccatggccggtgtagggcatggcgaacgcggcgcacgagtgaccctgcaggcagacttgcttgttcgccgtgagcccgctgaaggacccgccctgctgcagctgctcagctccgacgaccgccatcgccgccgggaacaccacctcgtcctccagctgctgccgccgccgccgcggaagcagcagcatcgcgcctgcagccgcgtacctgtcgacggccacttcgctgccgccgccgccggcgacgacgacgacggtgacggcgtggaggaggaggaggaggaggagggcggctgccagctgggcggaaacggccgccgccgccgggacgacgcggcggcgcatcgtgcacccgcgctttatatattttttcctcctctggccgatcgatatactaattgcgcgagcgagcttatggtggtagtagctgtgaacgcttggagtagaacaattattggaggttaagttgttgctgtcttacaaaatgtctccaagtgccaacaacagacatgtgagtccgtgactaactagcagtatactccatttgggtgcattgggaattggattttcatccctggatggacatccctcatttctgctatactctctccgtactcgtaaagtaagttgtttagaacagcgacacagtcttcaaaacataattttgactccttatttttataaaaatatttattgaaaagtgatatatgtatacttttatgaaagtatttttcaaagacaaatctattcatataatttttatattttcaattgagggttattcatgatttatattttcaaggtttgatttaaacattgtcctaaacgatttcctttacgggtacggagggagtatcatctaaatagttataaaaaaagtttgatgcaatttaataatatggattaatagaaattatatcattacacaaacatgcaagactaaattcaactttcacagaaaaaagaacaaattaacttcacaattatatttgttatttttgttccaacttgtagaagctaaatttgaacttacatatttgtggagtgatatattttatattaatctatcttatcatttttttaaaaaaatttattactatttagatgacatgcatgcaagaaataaggggatatcttctcaaagaaattgaaacactttcccggtgcatcgatcaaacacaaagaaatag

SEQ ID NO: 56009 - DNA, 1501 bp, Oryza sativa
caccacctcatcctccagccgccgccgccgctggggatgatgatcgtgatccatcagcgccgcagccacgtcgacgtcgtcgtcgacgccgaccacgcggcagtggcggcggccagcagcgtcgtccgtagctgtcccggcgccggcggcgacaatgagtacgccggcgacgaggacgaagagcggcaatacaccgtactgcatcgttgtcgtcgtcatcatcacacatataactcggagaactatacacgtagtaactatatattgagttatctatatagacatgcaattgaataatatactcgctaaatatatgacgcctgaatttttaaataatatttgataatttttttattcaaaattttcacgtaaatataaaaatatttatatcatgcttaaagattatttgatgataagtcaagtcataataaaataaatgatagttatataatttttttaagaagacaaatagtctaacgttaataaaaaattaacggtgtcatatattaaaatataaaagtagtacatatccagcagatacgtacaacgatcacgtgaagacgtgattcatccctcatcgccatcgatcaaccacaacacgacgatcgatggagttacgatgcaaaacaccgaaacgccgctactacaccaggtggcaccatacgtacacatacgacacatgcaacggacacacgtcagatactcggatcacagtcaacacgaagaagaggcccagcagcccacagacaatttagttagcgcaaggcccacaaaactgtgcggctcggcccacatctcgacgccgagtttgaatttacgcccttcatacgcaataccagaaatagcgcgtcactcaacctacaaaaccaatatacttaaggtcttaggatagtatatatagtgtccaattttagatgatgcgataagtgagaccaacatatcagcgaccacatgtggcaagaaggaattagtggtggagggggctcggggtgtgtggtggcaaagtgagaggaagatgatggagcggctaccttgctcggctatttggtcaccagctactccctccgtctcaaaatgtttgacagcgttgacttttttaaacatgtttgaccgttcgtcttattcaaaaaattttacgaaatacataaaactatatgtatacataaaaatatatttaacaatgaatcaaatgataggaaaagaattaaaaaatacttaaatttttttgaataaaacgaacggtcaaacattttgggacggagggagtatatgaatattatgagatgttttgagtattttcttttcataattattgtatggtatttgaagaagcgacaagatcgtcgttgtccctcaagggggattaaatgggtaatttcccccaagtcacattcagcttattatacacaacgccaagcaaagcataagcggtcgtggtaatttaatcaatttcaaaatctctcggatataagtgctcataagaataaggtgtacgcacgtg

SEQ ID NO: 56010 - DNA, 157 bp, Oryza sativa
attcctgcagccctttttatcatttctattaacttcttaagtgcttcaccagtctggtcattattctgttatgtatttactatacattgtgactggcacgcaacaggtgatatcatgccagaaatatcacatttgaatatttgacctgaatttcaga

SEQ ID NO: 56011 - DNA, 436 bp, Oryza sativa
cttttgaagttgcttatagagtaagacgtgcatgtgtacgttcaatagagtgaggatgtgtacgctgtgaacacctgcgatgcattgtactgtgtttcttaaaaaaaatgttattacttggacgacaggtaatgtaaaaacgaagccaggcctactgatactaacgatcacggcccatcaacgcacgtcgatgcccattcgaggccatcaacacggcccacccagaaacggccgcatcaatccgggcacgaatctcgaggcagagccccaccgccttccgcttcgcttcgagagccgcgtagcgagagacaaaaacccctctcgtcctcctcccgccgccgccgtctcgacctcgcagcctagggtttgcccccctctcctccttccagaagcttctagacgctcgtggggggagcatccgccgccgcagcagcca

SEQ ID NO: 56012 - DNA, 1501 bp, Oryza sativa
ttaaataacttagaaaaagttgtgtaataaattctgatgtacaaacatcatggagaaatcgtatttttaaaaggtgacacatattttgcatctctattatctaaagagaacgggccttaactttgatgcaatctattgcaatatagtttacaatagtacatggcttcttatgtacatgctatgaagcaacacaccatgtagacaatgttgttttcagttactagatgctagattatggcgaacacactttctaagccactaaacggtatgatttttttaaaaaaataattatgtatatataagtgtctttaaaaactttatacattgagaaatttcataaatctttacacaatctatcgtaaaactataggtttaataacttgtcttacaaaacaacatatttagtttctccattataacgaactacaggtttttgccttgcacattagattcaccgtcacctgacatgtgggacctacctacaatatcaggaaactacatatttactcaaagaagaggtaacacaaaagcatgtaggtgcatatagctacacttgattacggaagctacgaaatgcaaaaatctaatacctaattacatatcacttcctgagactgcagatgggtaccataggtcaggtgactacatctaatgagcaaggctaaacattatagttttatgatagattgtgcaaaataccaacaattttgtgaaatttactcattcagtaatgttgactagccctttgctctagtttaaccattggcattaataccgtttaaacccctttttttacaacaatgaacatgatttatatgtttatatttatcgtgtaacaaactaactttaattatatatatttatcgtgtaacaaacaaactttaatgatatgaaatatattttaatactcattaagttttatttataaaattggagtgatcaaagtaaaacaaggcaaagtcaaatttccaactgggttaagtgtgacaacccattagtaaaaagaccgacactaatgataaacatcagtgttaattccaaacacaaactagcactaatgtgatttggtcttattagcgcctgtgtgtggatggaaccaacactgatatgcctagtcaaacccatgaaatagaccaaggccaagattgcaaatccacccaagtttctattgtcccaactcctaactctgtcacatttcataagaatttttcttgtggtgttcttggggagacgtgtaatgtggatgggtattcttggttgattgatgataatcctgttagtttagatcacccacggatgataattttgtttcctattcttgaatcaagtcagtgtgtatgaatgtatctgtgtgaatgcaaaagggtgatggactaaaatttcattatctaatgtacatttgtttttccttacaggaaaaagtacgaattaccctcctcgaactatcgcggtcgtccgaattaccccccgaaccaaaaaaccggacattcttatcaccccc

SEQ ID NO: 56013 - DNA, 1501 bp, Oryza sativa
  unsure (1)..(1501): unsure at all n locations
aaagctcaataaaaaccaataaaaaccttatggtgtgggttgatatttcggatctgtgaaataatcaaagtttttctctcacactctctacatgactacacaaattagtgaattaccgtggatctaccattgtgaacttgaactgtgttagataaacatcacgatcatcatctattattgaatataaatctaaattcgcacgaattttgaaatcagagctcaaaaacgtaccctaaacatgtgtacaaaatcacaattgtatatcacatggtaaaaaacattcagaacgccagagtacaaacaagctaggatcaaaagagggagaaccacttggttttagacttgttcttgctcatcatctccttcctcttcctctccctctccttctcaagtttttcttcttcttcctcctcctcgtcctcgctactgacgctgctgctcgtctgatccttctcttcctcctcctcgtcgtcatccttcttggtggatttcgccttgccggcgccggccgtggcgacgtcgaaccgcgcggcgtccatcgcccaccgcatcaccttgtccacctcgtcgtcctcgtcctcgtccgactccccgcccagatcctccagcctcaccctcgtctccttctccggcnccgccgcccccttcagcgctgcgaaacgcgcctccagctcgtccatcccgccggcggctgcggcggagggagcatcgggttgcttcggcttcggatccggcgggcggtgagacctgagcgcgtcgaagcggcgggcgaggtcggcgtcgaggggatctgcggcggcggcggcggcggggtggtcgagcgagggaggaagattcggagcggtggccgaggacgacgaggagacgaggtgggagttcgcctgcagcttgagcatcaccgcgtcctgcgccgcgcggaggagcgcttccacctccgcctcttcgccgccggtgacggccgccttccggccgccgccgccgccgctcatcgtggtggactcgtgggtgggggacttttttctaatttttctccactttgtttgctgctttaatgacagtatggtgggcccaaaaattgtactaggccaacatgagtagagcccaatttagtgatcaatgggccgggccgattttacggcccacgatgccaagctattattaatcccagcctaattctaatccctaccttaattaaaccatttttccccacagaaaaaaaatattattaactaaacaaaaaccatcctgctccactgtgcctttcaatccacgcgtccgtcgccgtcgccgcctcgcgcgcatggaccaccacccgccgccgccgtcgccgccgcgggactccggcggcagcctcgaggtgcgcctcttctacgtccgcctctcgccgcgggggcccaccccaccgccccgcctcgcgctcgcgctgcgcagcagccgcggcggcgacgaggaggaggccccgacgcccctttccctcccgctccgcctcgatcgccgggac

SEQ ID NO: 56014 - DNA, 1501 bp, Oryza sativa
tggtcatgtgtaccacattgctaaacattgtgtattgatagagctgaggagataacaggtggcttagctcacttgatccacatgcaaatacattgcaagctgccctttggctaagtctgaaacctatttgggtttcattgtactgccaactactccagcaaagcaaagctgggaatcacaagaaagttggacactgggttgaagaaaatgactgcaagttttccatctgccaaatgccaaatgttctttcatggtaggcactagagtagtatatatgttctggtgttatctggagtctggagactgcagaggctacacaacagctgagcaaaatccaatcatggtgagacaccaaacatgatacctcagtccctctatttaatttgtgtttgctactgctagtgttcaacctctagattcattggaaatgatgtttagtggtcagtggatagatggactactagctgctttgtctctctcccccctctcaaaagtacaagccaatttttctttctcaaattcaaaatagcatgaaactgttactcactcaccatacaaatatatatcagcaaacaagtgacgaatcttcgaatgctgatcttaccctcatatgaaacatagaaaacttttccaaatcttaaagaaaagaaatctctcttttcgaatataggcatctcaccaaaaactcctctgttccaaagatcaattttttttaaaaaaaaatcataactacattcaaaccatttacactcttctctgtaagaaaaagttaagagtagcacgcttcctaaacttctaaatagtatgatttattatataagagtttagacataaaagatcaccttagagaggtgccacaggaagaaaaccaaatgaattacagcattttgaggccggcgtacaatcattaaacagtttgggcatcttcatacgctttgcacatgttaataatggaatcgatcacctgcaatgcaacaccgtgccataatcaccattgaagattctagcatttctttgaagcaataccgtatgattttcttttaaaaaatattttttatatatcaattatttatcacaaaatcatccatccattctttagttcggcatgaagcaaaatacaatttcctagtagagcatatatatgcaaaagatccaaagaggagagaaaaaaaaaacaattcaattctcttctcaactcgacggccatcttcttctttctctctccactccgtcgccgccccttggcctccctcaacggccaccgcgcccctcctccgccgccaaatcgcacccaaccccttcccctttaaactattccacctataaggccgcgccgccgccgccgacgagagagacggccatgacctcaggttctccctcctctctccgcccccccgcaacttcctgaaattgcatctaggtccccctgacgcagcgattgttccctcccttggagaggtggccgtagctctccggcggaaggcggcggagatggcttcca

SEQ ID NO: 56015 - DNA, 1501 bp, Oryza sativa
atgcttccccaagcttgaaccctacgcgcaaatccttcccgagcccccaccctgcgtcctagctcctttgccaagccacgtcgccaccgccatctcatccttctctcactctgcaatagctgagggcattatagacattagtctttcaaacccaataatccattcctccaataattcggagaaacaaacaactcataagttactctactatagattattataatccaacttatagtaatccgactcaataatctgaattacaataatcttaagttgaaacaaacaggattttagaccatagtgttataatatatagataaacaacataaccctatgttttacccaaatttatcgatgtcatttgatgttgtcccatatattgtagatccacccaatactaccctctaacatagatcactgacatacgaaccatgagatgtggggctcacatgtcagccatttaaagcatatggcctagtttacggcatatatgttccaacgctttactaatattatacatgggctgaaatggccacgattcaagccgagcccatgcaagcatttcgtttttgagaactccatgcaggcattaggagaagaaatatatgcaacgacgacaactctaggtgggtggagttgattgatcaattggtgaaatggtgagctgaggctcttggcagcgatctgtttctggcttcaaacttatcgatttcttttgtaatcctctcctctttcactgtcctagatccttctagtatcttctagagacttgtatctcttattcttttcctcctcgctccaccaaaataattgtgtgttgtattcagcattattgcaaattctgattggagaagaggctgctaacatattaatcttgagtgcctgctcatgaggtttccttgcaaggccatacgtccaacgaccaagaacatactatcaacaaacttatgaggctgaacatatccagcaaagttaaggggccattacggaacatttctcccaaaaaagaacttgtccatgaactgaacatactggcaatgtttaggggctctcacggaatatttcagcccaaaattccaaaagcatgcagaacatgagagagctaacaaatacgtgactgacatgtgggctccacggaccgtgaccccacatgttagccgcttaaacaactctcgatgagccaaaatgttcgtaactgtagaccccgtctcgccttctctctcctctcttccctctaccttccctttcccctctctccctccttcccccgacttcctccccgtcctcggccatggcgttcttctcccatcaccacctccagcagccgcatcctcaggctccgccgccgccgccgccgcagcagcagcagcaaccggtgcccccttccttcaggtacgcgatctcaattccattctctgcgcgttcgtgcgtacgaattttcgcgctaaaaattccccgccggattccgcgcttcatggcaggaacgcgctgccggtgccgg

SEQ ID NO: 56016 - DNA, 1501 bp, Oryza sativa
gccggccatgcatgctgcagtagtacgaacgtgccagccttgggaaacaattttagtacctcgtgggatgttccctaacttatattcaaacatgtaaaggcctgcttatttggtgaaataaaaatatttaggtgtcacatcgtacgtttgaccggatatcagaaggggttttcagatacgaatgaaaaaactaatttcataactcgtctggaaaccgcgagacgaatcttttgagcctaattaatccgtcattagcacatccgggttactgtagcacttatggataatcatagactaattaggctcaaaagattcagttacgattttccccctaaatgtgtaattagtttccttaacttatatttattggtccatacatatgtccaaagattcgatgcgatgtttttgggaaaagtttttggggaactaaacagcccctaacaccatcaaatagttatagaaaaaaagaatcctctaatgttaaaatccaactcacacatttataaataatacttcctctgtcataaaatataagtatttttggacttcgatactgtcttcaaaatactatctactttgaccaacaatatctataaaaatagatgtgtcttaaataaaaagagctgcatactatgataatttgtttaacgataaacctagcaacatcaatttacaagattgatttttttattttttctattaatacttaaggttaaaaatatttgatttgtcaatattcaaaaataatgtaaggagtaaataataataataataagacaaatccaacattcacaactgaacttgtcttttgtttttttgtcttctcggtgtgtaaatcgagtttaaataggagtaatagataccatgcacttcaatacttcatattattatattttataaagtttttcactattattttaattaaaataaataaatatgaggagatacccgtcttgagatagcaacatccatgcatgcatgctatagcctgccgatcaagacaggctactagctagaagaagatttttcatctggacatcctttattttgttacatgccatctaagtagtcataaaaaaataaaaattaataacaagaatgattaatatatatacatggtaaaattcaactcctacaagttgtagaaaacaaattaacctgtatccatagtcatatttgttatttttattatattttatataaatcaaaattaaatatgtatatttgtatagtgatatgtgttatattaatctatcttgttaattttataaaaaatattataactattttcaatgatatataagaaatgatgaaatattttcccgtgggttgataacgctttcgcgtgctatagctactacgaaacctttgtcgaaactactggtggcccgtcactcaccgcacatcaatcacacatgaacagcaatctcgatcgctgcctgtctgcctgtctgtctgcatacgactatgccgccatatctgttcatcttcttactgcagc

SEQ ID NO: 56017 - DNA, 1501 bp, Oryza sativa
tgaaaaactgaaaaccacagaccattagtagcttctgttgatccctgtcttaatttggaccatgtgcatgtccagttagtttcttcggttcatctctgttgctgcagcagtttggtagttagttttcatgtgctgttgattgctgctgccactcatctggccggccactgtcgatctccgatcttgatttttaagtctttatctagattttgttgatgtatctactatagtcaaataaaaaggcatcattatttaccttaattagagttttgtctggatttcatcccttgatttgtttcaagttactaccttgttatcccccctcccccagcgcattggtaaagctgtggttagctctgtatatttcttgtgctaattaaccagttcatggatgaacacttgcagaaaaattactgagcagctaggaggcgtaattaaagtagtgatgttttgtggatcagtttaaagtgttgtcatgctcaattagcagagcaaataggtgaagaaaagtgtgtatgctaattactgaaaggatgcatatgcatgggggacattggagcacgcctgcttaatttctgaaacattgatctgaacaattaaatttctgaaaaaatgatctgaacaacatgaccagatttcacataagtgctttctgtccgtgcatcatggatgccatgactgctattttcttgcccatgatgatctattaatgctgattctaggattcaaaaaaaaaaggattgctcacatacaatatttgcaacaaagaaagtggcacactagcacatataatggcatttggtttgtgcctaatcaagctagcctagtataatcacttcacaattccctatagtacgtagtttttggttacttgtcacaattgtttcttagcttcatggcttacatatggcgcgccaattattttactacacctacgtattttgtcttgatcttaatatactagtataaaacaaacgagtataaccatcacaagtttttccatagcaaacatcttagaaaatatataaacccaacgttaattaatactacattcatattttaatgtacgacgccgttgatttttttatccaacgtttaaccattcgtcttattcaaaaaatttatgtaattatcatttaatttattgtgccttgattcatcatcaaatgttctttaagcatgatataaatattttcatattttcacacaaattttaaataaaacgaatggtaaaacattggtcaaaaactcaataacctcatatattaaaatacggagggagtaattagaaaaaccaagtcctctactaggaatgggctgaggtgacggtccaagcactagacggcccacaggtcggcgcgccttagcccggcccattgatccacgccgcggacctaggtgagacggcccaaacgcggcccgtttaggtttggggtttttggcgtggggagttggggggcaaagcaagcgaagcaaagcagcggcgacacggcggcgatgg

SEQ ID NO: 56018 - DNA, 595 bp, Oryza sativa
ctcattcctgcgattccaaggggccctaaatttcctccaaaacttgtatgggaacatgcattccataggaatttcgtaggattgattccttttattcaaaggttatataggaaaaaaaatcctataggaatgaaaccctctgaaattcctataaatttcctttgaatcaaagggcccgactttcataggaatcattgtcacatcacagtatggtacacaactatatttaggtctatgccagatactgtataacctttagcatcttcaaaccttttctgatggcttgtttcatgccatgatctgggactagcatgttccacattcagttttctttaccttcgcagaagtcaccttgagaatgatttcaaactgctaaatggttctttcaaggttccaatgactaatgatgcatgagaccagccatatgcatgtaaaagttttcagaataatatgtacttttctcaggaggcttgtccagttctgctattaacttgtagatgctcttcaatgcttcaccaaactgttctttatggtgcacatgtatggtagcttgaattttagtaactccttttgcttattgtgcttatatctcagg

SEQ ID NO: 56019 - DNA, 199 bp, Oryza sativa
caaacagtccatactccatcctgactatgtatatggctaggtgtcacttagattagggcttagggggcctgaaagtaactagttgtgaccctggtctggtctcgaaaatgcttaattgtagtttgcacatgatgttgaaatgtactgttaactttttccctgtccgtgatttatgtgatggcccattaataacttgaag

SEQ ID NO: 56020 - DNA, 1501 bp, Oryza sativa
gtatgtttgtgtcttcattatattgcttttttgatggtgtgtttgcttgcgttatcgatatgtggtgttgtgtttctttttttttatccttctgattatagccttttatacaactatagttttatttctttcccaattactatatcaatataattaaaacctcgcatcattttccattatcttaaaaaaacctcgcataatttggaacatgaaaagaaacaggctaggacatctccatacaaagttaggtagcctttgctcctgagtcactgttgagctgattaattaactaataattaattaagcctagacttgttaaatcaagaatgtaaccctctatttaatcattaataaagttctctcttgaccttaaaaaaataattaattaagcttaaccgaatatgtacgaagaaaacatgcttacggaatagtcagcacaaaatagctaacctttttggtggttaaaaagctttcctttggactaaatatagaatccttggacatgtatctaagaattactaactaattatatattacttcttctcagaaagatcagtataacaacacagggagacctcagcctcagctgatcaccagttgccattctgtcacctcaacttagaacatacttcaccttgctcctctctctctctctctctccttaattctttctcaagtcgttttctctctcaatgttgcctgctcgtgtagcctataataatattggctacgtgcgtttgtttgcgtaggtagttctcctgtccagcgtctgtactgcacatagattctaccacaagatcgacagcaaatggcaaccaaattaatgcaatattatggcctgcatgcactgcaccacccttaatccttccatctcacaaaatcacacattatacataattaattaattaattaaaaaccaaatatatatatatatataattcatcactgatgacagctattcacaatctttgcttatctctaatttaatcacataattagtttatctctcctcaagctggtgcatctctctctacaactagaaagtagctagctagctagtattaatttgtattgcatcccttggcataagggtgagaagctaggctccaagttcatttgagagcaaagggaaagtgaggcctccatcagctagctagctctcctcctcttctccttgtctcttctccttcgagtttgctcccctacaggagagaaaaggattcatcacatctcatctcacaacccctttcatcgatctctcctagattatctctctctccaatttgctccaatctttaatttcctgcctttgaagctatagctacagccatggaggatgtctgtctcatccatggcgtgtagctagctagtttctttctttgcacttcttgagttcttgttaattactaaaggattgcggccatggatggagatggtggagctcgtcgtggtgtaatcggatgagtgcgtgagagacatgagacgtgcatctagctgcagg

SEQ ID NO: 56021 - DNA, 1501 bp, Oryza sativa
gagtttgacatgttaaggtaagacaagtgagaggtctagtccatgtttggtgaaaggaaagaaacttgacatctgaagaggaggtaaacctctcaccgaacctcttttttggaacacatttgcaatagactattaggagctccacagaactacagctcatcattggtgtaagaggaaaaagcaaggaaagctggaggaaaagggggggtgcatagaaaaagaagcaaaagaatcagcagtagacagccctcctaccctctctgagcaaatattaatctctttcctttatttctttcttccttttaagtaagagcatggcccccctaattgttcttgaagcctgcttatatgtggagttggaggaagaaggaaggaagcctaggaaagcctcccctcaccttctcaactcaccaaacgcttcttggtaggagaattgccagaaaagtttcccccttctccttggatcctttaattacctcctggcaattgcctgctagctcataaggccggacagggagagggttggagaggagaggagacacaggtgctgggaagaggcctgtggggatcaagaagatgaggaggtgggtcttggccattgccattcttgctgctgctgtatgcttcttccttggagctcaggcccaggaggtgcggcagggccaccagacagagaggatctcaggtggggggcctttgtttttcttgtgttattctcttcttggttttgatcttgatggatacattcttgtcagttagtagaactcaacccaagctgcttatttgtgcatctaagaaactgttaaagcaaagcattttgaaatcatttagcctgtcaatttgatttgtttgtggtcagacctctccaccctaaatatataggatctatttcagatcagacgcaaatggaggttgtttatgttggtgtattattctaaatgatttggttgagttatggttcaatgcttggattcagtttaaaccttgttttattgaacatctactggtattgatacacctgttgatggtaggcattctttcttattggattttgtggtcctcgagacatctgctgccaaaaaacttgaatgccattctgtcctctgaaccttcaaatatttttcctcctcttcatcttctttatgatatgcagtatcatgttcctaggcaccaatatgataagaacatagccattagcctaattatgtttcatttaatctagcataggaacacacttactttatccctgtaggttgcttaggtatcataccttgatcccaagctatgcttctaaaatttagaatattcttttccctaattctgtgcaaggtctatagatactccatagcttttgcttaatattgtggcgaaacaaatgcaggaagtgctggtgatgtgttggaagatgaccctgttgggaggcttaaggtctatgtctatgatctcccaagcaagtacaacaagaagctgctgaagaaggatcctaggtgcctgaaccaca

SEQ ID NO: 56022 - DNA, 1501 bp, Oryza sativa
aaaagcgtgtgattcgagagaactaaatgctcgtccatagcaaagattcttacgcaaaaattctctttggtttcgcacaaattaagcatgactgttcgtttcgtcaatccaacacaattatatggctggacagtcaaaacagcttggtttattcagctctgctgcgtaatcaaaacacactgagttcgtctaaacaataattgactggaacagagaacaggaagaacagtaagcagaacaaaacggagaatgacgaagcaggaagaaagaacgaaagaatgagtaaattcaattcgttcatgcagttgcggatggagtaagttttggttggaattggatgagatgcatctcgtcgcgtaccttggcatgggggtcctgggcttccaccgtggccctgagctcggcgaccttgagccactccccttccccggcatcgcctcctctgttgcccgccatggcagaggagaagatccaagaggaggaagacgatgatgattagggcgagagagattaagtccgtatggtctaaggaggagagtaggaagagagcatgtggtcgtaatagttccaatacagaggtgtaggaagtcagggaagctccccagaaagtaagcggcgtggggagactattggatccattcgcagcatgcatatacggtcgtggtttgagtttgacatcggattaataaacgaacttgacaaacaataatagtacttttattgttcaaaatatacctagctatagtaagaatctggacatacttagtgttataatttagacggagcgaaagcacttgacgaggcctcaacgacagcggaaactccttgttttttgccatgtctatactttgtagctatattttaggttagaagaaataatttgtactccctctattataaagtataaaaacttaaaatcggataagacacgtatcctaatattatgaatttaaacaggttgttcagattagtagcattatgatgtgtctcatcatcctatgttcttatacattttttttgaacgaatgttcttatacatatgttaggtaactattatctaaaaaaatatgttaggtaactagtggtttacgcaatatagtagaagacattttctggaaaacatatttacagtgaaatatagaacctattttgcacaacttaaatttctaaagctgaaatctaaccaaatagttccaacttttttaaaaaaaagtttagacagcttcacaactctacttttaatccaacttttagaattgaatttaggacttgaaaatctatactttgttgtaataacgatcgttatcagatctgttacacatagtagtgtttgaatgtaacaaagataaagataaaatattaagtattttacgtaaaacgagatagtaataacatatgataaattgaattttaattattacaaacttaagaaatggattaatctcatatagaaagttttcgcacgaaatgcatcgtttagcggtttaaaaacatactccct

SEQ ID NO: 56023 - DNA, 1501 bp, Oryza sativa
ggtcgccgaaacaagctcagtcacggtcacggtctccgtcacctgccaggaaacgggagtctcggtcgccctcaccacggagcaaacgattgagaagggctcagagtgagcgggaaggtgcagatgctactgagggtgaccgtcggaagaccaccagcagggaagagcgggactcggggaggtacagggagcgtgatgagggaaaggatgtgtcaagggatagaaagactgagagggaggatagtaggggctcttttaaggacaggaaactggatcatgatgatgatagggatcactcaagagatagaaggtctgatcggtcgggtgcttcaagggagacatggtcaagccgagatgatgaaaggcgtgattcaaggggtagaaggtctgatggggatgatcgaaaagtcaattccagggagcaaagggcagatcatgatgatagaagggattctgcaagagagagaagggcagaccgggatgagagcaatggtgaatcagggagatcatctaggcgtgggcgatcagtgtctccagaagagcataggcataggggtagacgtgaatcccgccagtcaccgaggtcatctagaagtgcagcacatggtgaggtgtgtaatgatatctgacccttttcttatacatatccacctgttagttggcgtagtgtgttcttttgtttcatgattgtcccttgtttctgttctttgtctgataacctgcacccaaatgaatagaagtgaaaaaaaattactacctccgtacttgtaaaggaagtagtttaggacaatgtttaagtcaaaccttgggaatataaatcatgaataactctcaagttgagtttgaaaatgtaaaaattatacgaatagatttgtcttgaaaaatacttttataaaagtatacatatatcacttttcattaaatatttttatagaaacaagaagtcaaagttatgttttggagaccgtgtcgctgtccaaaacgacttcctttacgagtacagagggagtacgccttgttatcagcattgttgacactaaacttgtgggtctgtattccatgtaaacccttcttgcttcagagttcagattctagaggatataattagttgcccgctatccttttcatttcataccaatttggtttcttttcatgtttgctatcatatatggcccgttagttgcaacctaaactttgttttgatttatttcaggatacaagctctgtaacagatgcagcgtcacggtaagcatgcaaaactctatattcaatacgaattgtaaatttttagtagaagcattgcttgcaattgttttcttgttgtatcaatggggctacgcgtgttatgggtgtcataccctcttgctggaatggttttgaacttttgatgcatatcagcatatccgttaagcaactgtagcagtagtacctaaaacaaacaaatgtatatttgaccagctacatgagcgcaatgtttttgtacctgaaattttagaactga

SEQ ID NO: 56024 - DNA, 1501 bp, Oryza sativa
gaaaactacgctaaggaatcacctcacatccgctcatgaccgtgggcacggctgttcgaacagtttgttaacctctgcagagggggtacactttacccacacgacattactaacccggatcacccagctcgtggggatcagccacgtcgggagacctccaagctttcatgacaaggcatttccaaagccgacacaggtttaccatatgctgacgagaggggtcccagaccaacaacaggttaggtcccagaccatactgtgccaggaagcccaggggtcctccccgacaccaccccggcgaatccacttgtctctcagcatcaaggctcccctgattagctaattactcagccaggggtgtcccattccacccatgtggttgcactatcatatgcttggatataattccgaaggaatcggtccttaaatgcgaccgcacaagcatcccgcctaggaatggccttgtgtcacgagttttatttttaaagctcattttctttcacaaggcaccgacccaggcgtctggttttccaatcgttttgtaaaccaagttttacccaagatgtttaccatattttaagtttgacggcgaccgtcgatactcgcaccgagtgcaagaatactgaggcgcgaccaggtggttacaaggaaacatgacataacaatttaacaacggaaggatcaaatgcaacaagttaggtatgcccactaatatgcctcgcagacggggcaaacatattatgtgcaatcctatcaatgcataatattttgcaagtaatataattaagttcaattataggctcaagatgttcaaaggtggcttgccttgctcagggtcttgatcttcacgaatcttcgagaaatccctgatcgacgaaaatccgcaaccgcaactaggcacaaacaatgaaaacctaaacaaaagaccaaataaaagatcctatttaggctaattaatagtgccattagatagatcacaattttacggaattattggaagtggaacggagtcaaacggagttacggatcgcgagatatgaattttggaagtttatttgaattaagggaaatatttgtggaacaagggaaattgatttatgaaatttatagaaataatattctcaagaatattattgacaatcacttgacatgcgggaccaagggaatgaattattgaaatcctgggattaagagaaaggatttatggaatttggaatataggaaatgatttatggagcaaggggaaatgatttttttgaacttatggaaaagaatattcccgagaatattctgtttagtcactcattgacgtgtggagccaacaagggagataggtggacttttgtgtaagggagctgatttggtggagggacgaaatatgaactttgattcaagagtgtgttcactgggctcggacggagggagtaagagtggactttgttccttttggccgaggaggggggttggccgatgggcctggaccaagagcggggaggagaga

SEQ ID NO: 56025 - DNA, 1501 bp, Oryza sativa
catcggatgtttgaccggatgttggaaggggttttcggatacgaaatgaaaaaactaatttgataactcgcctgaaaaccacgagacaaatcttttgagcctaattaatctatcattagcacatgtgggttactgtaacacttatggctaatgactaattaggctcgaaagattcatctcgcgatttcccccctaactgtataattagtttttaaatttatctatatttaatactccatgcatatatccaaagattcgatttgatgtttttgagaaaaagtttttgggaactaaacagggcctaattcatccacaccgattgttacaactcccgctgctactcgctttcgcgcttctccattgaccttgaagatgggtcgctctctcgctccgcctcgagcccatcgatggcaacgagtgcataccaatcgggttcccttgccccatacccacacccgtgcgggtaacgggtatccaacgggtacccatacccatatagttaacttgtagcatttatagttttgtactataattagccatattagagttgtaaaccatcaatattttctctagcaacaatctattaacattagcgtttaaaggcaagtaaaaaaattatacaaccacattacataatcaagaaatcgaataataatttcatataactagaatgtaacaatgcttaagatgtgaaaggagtttcatactgatttagtagtcgttgagacttatattgcttatagttttaggctcaatcaacgggttttttcactcacgggttggtgggtatgggtgggtaaagaatagatccatacccgcgtacccaatgggtaagagttttgcccattagtagacccatgggtataagagttagaacacaattagcttctaatagagtaaaaacccgtcgagtcacgggttagaggtccccattgccatctccgtcctatgttgggccaattctgttatgtggacgtgctgcggataggaagtaggaacagatggccagaactgaggttggagtactattgtttatttttgttgtatgaattgtgatgttaatgtcatgtgttcagtaaactggatagaaacattatttgttactgcggctatgtcatcaaacgcttcactattgtagtaaatcaaacagttgccagttcaaaaaaaaaaacagttgcagagaactgttgatggagtttcggctcatgatgcaccatatgatagtgcctgttcagaacaaaaaaaatgtagacgaaagctaatgaaatcttcaagagttacgagccatgccaactgtcacaccccaatccggtaccgtcgtacaacggcgcctgacagcagcgtgtcgtaagaaaaacggcgtgaaccgcttcctacgaaaccgcgatctcagtaccagtcccaggacatagcgctggtaccaacagtgacaaatatgaatcattgcaatccttaaattaaatagagtacttatttatcttaacttaggttgcagctcaga

SEQ ID NO: 56026 - DNA, 1501 bp, Oryza sativa
ctttccgttgagtaaggcattgaggaagtagctagaggagagcaaacaggagtgtcagtgtgctaaccaaatgctctacaaagtacaaatgcgtgtgcccgcttctttttgtttttattttctgtgcgtaaaataacaaaaaaaaattatactggaaaagacccaatgttgaatttattaagaaagagggtgagtacgttcagccagatttgaacgcaggtcgcgaagagcacaacgtatggctgcagtgctgcaccatgccatctacgctacaccgcagtcttaaaagtatttcctatattgatttcattttgtggcagtgtttctttaaaccgtatgcattgatttaatttgatttgtgcatgtggtgaattcctctatgcaatcgaagggactaaatcagattcatacgtacattgattatcattgtttatgacgcagtgaagtcctcattatcaatcaagtagaggtcctcattatgactaacaagtggtatcttcttgcctttaatttctttcaaaaaaaaaaaagaaaaagacaaacaagtggtatgcgcactagatacaatgaccatattccctccggttccattttaattgacgttttggacaatgacacggtatacaagatgcatctgtgatctttttttttattataatatatatataataaataaatgcatgttgttctagttcctttaaactaaatatttttaaagttattgatggttaaagttataaaagtttaacctcaaccttatctaaaacgtcaattaatatggaaacggatagggtattctttatgactcggcgaagtcttcttgcatccatgatccatcttaatgggattcacataggttgtcgtgttaggccgtgtttagttcagagctaaaaatttttttaacgtatacggacacacatttaaagtattaaacgtagactaatagcaaaataaattatagatttggaccgtaaactacgagacgaatcttttgaacctaattaatctgttattagcaaatatgggttactgtagcacttatgattaatcatgacgtaattagactcaaaagattcgtctcgcaatttacatgcaaactgtacatttggttttttttcttctacatttaatgctccatgcatatgtctaaatatttgatgtggtggaaaagttgaaagtttgaagaaaaaaaagttaaaatctaaacatagccttgctagtggctttattatgcgatcagtctgattcagttagctagatatattattgactgactctcgtccaagtccagtttctttaatgttgcatgcaagttgactagtagtagtagtaaatttttgtagtagaagtaaaatttgggtatattttataatctacaaacatgagtgtttcccttaaatatgatcaccctaatatccatttgaatgtaaattcaaatatcaatcgaataataatattttcagcaaatataattcaatccatgttatattaagggcctagt

SEQ ID NO: 56027 - DNA, 1501 bp, Oryza sativa
agaggcaggtccgcaggtgcgtgcgtactagctatacgttcgtgataaataactcaagatccgaatacgagtacgagtacgactcctcaccattaaaataataaaaaaaactctctaacaaagaatacgagtattagtatatgacgttagggttgtgttctagcgtgttcccaatcgaaaacagtgcgcaccgaaaagggaacggttcattagtacgtaattaattaacttagctattgtttaaaaaaggatcgatatgatttttttaagcaactttcgcataaaaactttttaaaaaaacgtattatttagcagtttgaaaagcgtgtgcgcggaaaacgagagagataggttatgaaacatggggtaaggcccttcacagtgcaacaccgtggaccgacgctatggggcgccacgtcggaatcgagctttgcgtggcgctaggttccgcgccccagcagagacgttctctcccacggagggaagcacgattcctccctgccgcaggcccatgccaggcgaggaattgacagcttttctacgttgtggagcgcgttgccccgcgcctccgcccgctcgtgccctcgcgctgcccattgaagggttttccccaaaatcgcccaccaaaatcgcggcaacaaatcaaggaacacgcccaccaaaattgcggcaacaaaatcgccgctcgccgctcggctccgaggggatttggaaaaatcgccaacacaaatcgcggtaacacaaatcaaggtcgacgccaagctccgccgctcgttcccgaggccgccgccagctccgccgctcggccccgagaccgccgccgccgctcgtccccgaggccaccacgctcctctgcatcgtgcgccgacggatggggaggagggagaaacggcgcggcggccggggagctcgtcaactcgccgcccagggccgggaggggagaggcggcatcgtcgagccggcgccggcggagggaggaggggcgccggcgccggcggaggggcaaggggagagctagtggagttgggggaggtgagggcgtaatgtgaggagggaggatgctgctctgacgaggggatttggtaaagtagtatctgtgggtcccattatcggtgcttgcacagtggagaaaatgtctttgcaactcttcatcctacgggtcaccctgtggtacctcatagtgggtgcttgcactgttctaggaacacagccgtaggtatggtgttgaactaattatcacgtgatttttgtcagattttcaccatagtccatgtcccttggaaaaggcacgggatcctgttctgagttttctgggccttgcaatttttttccctatatccagaaaatgaaaacataacacacgccggttccgagctcacgaacaattagtgtcagaccaacagacacttaactcaccagaacttgtctgggcgagattggtcaaaattgtatttctcaatttgtgagagcacataaagattttgggagtacgcaaggaata

SEQ ID NO: 56028 - DNA, 156 bp, Oryza sativa
ttttttaatggattctacacattttttcttgatttactgagactttgatgggcttaaacggagctcggatgaattattatgaattttaagagattcactgtgtttattactataaaagaaaaaccttaaatcatttattgcgcaataattcccagg

SEQ ID NO: 56029 - DNA, 1501 bp, Oryza sativa
ttctttaattgatcatacctactattgccaaacttaatggtatccttttcaaagagttcataataacggctgggctcaatacgattctcctgaaaaaaaaatcaaaacataaatattgactgggtagaaaatattattagaaatgcgactagtgtatctgattagtagtaaaagtatcactggaggacttacattaatgaaagttccattggtactaccaagatccatcagataaggcctatcaaacaaagcagcaaaaaacatcataatctagactagcatacagaactaagataatcatgaattattagtacttgttattaaaaaaaatatatgcgttactagcaaggagtacctcacttgctttgacatcatgccatctggctgctccttctctacaagtctgaaaaggcaaagagatgggtgaatcacaatattatttctcaatatatactccttttaaaagggagcagtggtgatggtgagtggtgaatctgccaccaccccaccaccagctccctagtttttttggaatagaaaaggggggcctacatgtcaaccacccctaccaccaacttcctactttttgtgagaagaaaataggacagtgcacatgtcagtaacaaatatatacataaattaaggggcgatatacacagaaaatgatgataataatgagttaatgataattttctttatttaaaatcctgttgccacgcacaggcaatatgctagtaaaggcaaaaaacaataagattgctatgcttacctatattgaagaactgcatgttgcttactgcaggagggatgatctatggggatgtctgcaactttccgttcccttccaaaaaggtagctgctcatccggtgaacatataatggttctgatcaatcaagatagcatcataagacacagtcaaacaagaagagcaaaactgaagtatttaatcactaacgtaagcatgtgaatttttttaccaccctacacatttaatttataccactataatgcccaacctttaacttgctgttcatcacaataaacttcatcacttcagttatttcacttccgttcaaaactaaaactaatgagctatccatacgataccaatgctcaaacagtatcattggatatattcacaagccagtgtatactgtatcgtaaggaactgaacaatagcaaagcactaggcaggcttcattattacaaaccaatggaacaaaaagatgaggcttctgaaggatgaaaaccgtatgaactaggaaggggcactgtgtgcacacttcaaaatctccacagctccgaacatatgttatgcagtaggctggaccaaactggcaaacaattgcatggatacataatgcatagtttgcttatcagaatcaaatgctctgaataaggatgattctatgaaaaagtcataccgttaatctcacttgaggttaaggtgatgaaaaggttctataatgatgtaattttttactctctggagttttcagt

SEQ ID NO: 56030 - DNA, 1501 bp, Oryza sativa
taaaaaataaacttattctagatgaagagaacattactactcactccgtttcaggttataagactttctagcattgcccacatttaaatagatattaatgaatcagacatatatgtatgtatagattcattaatatttatatgaatatgaacaatgctaaaaagttttataatatgaaacggaggaagtagtaactagtgagagcatggttgtttcttatcccctcttttattttttgggttaattggatccatgtcataacaaatttgcaactcttaaaaaatatcattaccattcacctatttggtcccatgacattacaactttacatctatttgagatataccactacttaccactacttactacttaccctcttcctctcccctgtctactcattccggcagtggtgcatggcgaggtctgggtcggcggttcccctctcttcctctccatcccctctcacttcgggcagagtaaaatcggcgacctcgataccgccattgacatcctacgtttgtgttcctcgtcactccactatcgaatccacctccatcattgacaagcacgctggccatgcctaggtggctcgccaacctacacttgcttgacgacgacagagtctctaagtggcgcctgaattcaagatgaggttccgttcggcttgaggggaacaataaggtggccaaacgaggttgacctcgaattattccctttccctgatacacacgctagaggaggagatgggttggtagaggggagggaacgcgcgacggtggcgaggggatagggagagatggccgccggagaggtggaggtggatcggtgaccatcgtggttaggctcatttcattgaaaatgagtgagtggagaggggaagggagaagggtaagctgatcaaaatttttaatgaatccaccagatagatatataaaatagtaatatatcaaaaataattgtaaaattcaaataggaatagtaaataacaatgatatattttaaaataggtaagtttataaggggaaatatgtagtggaaacttaaaaaatacaatacagttggatcgaaaaatggacgtccgacatttatccacgtcatcacgatttactcatgagtacttatgatgatgtgaacaaatctcgtacattttattttttattgtaattttaagtttccacgtatttttcccagtttataatggcaccgtctccctctccccatcgaggaagagtaaacccaaaaacccatctcgctagccgccgccggccacaaccattcctcacgacgggaggaagacgaaaaaaaaaaaaatcccactccgtgttggtaaaatccgactaccacttcggcctgtctcaatccaagaattcaagaatcgaactcctttggggtcgcctcgctgaatcttccttatatatacgcgctctcccattcgcgtgtgctccaaatcgtagtggggggaagtggagttgacgagctgtggaaaaaaagcctatcgcaa

SEQ ID NO: 56031 - DNA, 1501 bp, Oryza sativa
ttgttgacaaggtaagataaggagtaggattcacatcgacatctgacttgtgtgcccacctcaaaatgcatgtattttatgccaaatccagcttgttttgtcgtggggtatgatgaagagcacggaagtcggaggacggagcagcaggcaaggggatctgcacggtcagaccgccgttgcctgcacgttttgcccttgtttgggagcgtaggcaggcacaggcgtatcttgtcccgccctctgtcgctcgcctcagcgcagctgccgcctgctgctgcctggtttatctctttgggagcgtatggcgcatgcttcccagctgacgaggagtgaagtccgttgggcagagtaaaaaaactgctagttttatcctggaccggtcctgtacagcgtgcatcatggatgataatgcggtggcatgagacctgatgaataattgttgagattgggggggggggggggggacataatggtcagggttagagcttatgatcaatgatagcgccctccaaacctacacgtcccagttcagtcattcatcctgctagccccgatcgcctagctggtctctatagatagcacatccaactcggtcattctcacaaaggtcacaatctcactctctcctattcaatgcaactaggcatggcgctggccgctggcagagttgtagggtgcggtcgttttgagcttataggattagattctcctcgttttttattagcacgctttttaaactgctaaacggtatatttcataagaaaactttctataagaaagttgttaaaaaaatcctacaaatttattcataaaaatattatatattaatacttaattaatcaaatgctaatcacatttctcgttttaagtgcggctaaacgttccaccgccacagctgacacgatcgtccccgtagagtggcagcaccacgctgcggtgcgtgctgggggttgctggtgaagtgctgattactgcgtaccaggccaccctgttgctgtcgccggatcgccttttgccctcccgtacttcgtgccaacacaaaagcgcgatacatagcccacgttgcgctcccttttccctccctccctttccgccttcgtcgccctcctccctggctaggcttccttgcttcatctccactcgcccaccggagaattccttcctctctctcgtcgcgcccattgtttgctttgctcacatatgatctgagtcgcggaagactcagtcggtggcaaggatacggggatggcgggcggtggcaggtgcagctcgctgctccgtggcttcgtgtcactcttcttcctcctgttcatccacattggccatgccggttgctgcttctcgacgggatcttccacgcagacgctggaggaagatgacactggacatggggccgacgggaggggcggcggtggcggcggcagcaagaggaggaagatatcgccgctcgcgttctccccgtcggtgtcgtcttctacggtggctgacgagaggtccagag

SEQ ID NO: 56032 - DNA, 1501 bp, Oryza sativa
gagataagagaaatgaagtttccgtaagtgagaaaaaatctgcattggtttctaccaagagtacctccaagagcaacccgactacacttaagatgcaattaagctcagcatctagtatgagtggtaaagatcctgcacctgcaaagaagcactccaaccacggaattaatttctttgataggtaatttaatactgataatttcattagacatcaagatgcaattattattgcaagacggtgataataaaggcttttttttcctcgttaacacaaaaaatacaggtttagaaaagagagaccagtggatgcaaaagctcgaaatgacgcagggcaacaagtagctacaactctaagagactcgcgtccactgatcttcaaatacaatgaggtttgctccttgagttattcatcatgatgccacaatttggatctatctttaactatctttgtgcgctcattactataaggaatacattggaaacccacatgacctgcacttagtagtgccaaataaacagtaactataaactgctattgtcacatttcctgttattactgaagttcattacgttatcttacttacattgctgttaaatctatatacttacagcactagacaatcatttgattctcgaagtgagtatttttacttgctcagagccccagttatgaacagatcctgctcgattttgtctcagaattaacacgtggttctttttctaatggggacataatgttgcgcataatgctgtggcgtttgagttattcctctgtattccctttttatttctgtccacttccactcaattgtcgttagagtttggactcgtgtttcttgggcaatgtcactaagaagttttttttcatttacagggcttcacaaatgctgtaaaaagaccagtgaaagttcgagatcttctgctctagctaggtctgtttgcccccctgcacttcgttataaagtcaatgtttcgctatatgtttaccccgtgtacatttctgatgattatattaggctattggacggacacgaggaattctctatagtagaaaggcatgtaaaatgactaaaatcgtgagtataaattcctgatatcaagttttacaagcgtcaaaccccatgaacttgcaaatatatctcatggtaaaaacaccaacatggaggagcatgatagccactaacctctactccatcttagaaaaaaccaacttctgtggctgaatttgaacaaatacatatctaaattcatcatagaagtagattttttttttttttggggatggagggtgtatatgcttcctcttcaaaggaaagagagagaaagagaaacagtacggggctgttaggcctagaggcagttgggctgacgttgttaggcggactgggctagcccaagtccaaggccgtatcctagacagcaggactgtagtcggcggagtcagaaaagtcgtcgcctcgacaggcagcatctagcgactggtgagagcaagcatcaatgg

SEQ ID NO: 56033 - DNA, 1501 bp, Oryza sativa
acgcatacccattcctcatagctactctaggtcactagggctgtgttcggtacttgggggttggaaacccatcttcccgcacgaaaaatagagctgtccattagcacatgattgattaagtattagctaattttttaataaatggattaatttgattttttaaagcaacttttgtatataaactttttgcaaaaatacaccgtttagcagtttgaaaagcgtgtgcgtggaaaatgagggaaaggggttgggaactagaagttccgaacacaccctaggtcaggaggtgcaaaaggagagaaacattaatgctttaggttgggttcagtagagagtttggcttttgcagctctcccgtttactctgggcacgttttttaaaactgttaacagacgcgtttttttaaaaaaaaatatagatgtttatttatataaaaacaaataaacctaatttataagtttataataattactattcaattaatcatatattaattacctgtatcgttttgcttgatgtggaaaatcataatcctaacttcctagcgaactcagccttatccttccttttgaatccccagtgaacacactttggcccattctttttctattaagatatagatttttcctcgattttaattcctgtgtgttccgtacgaaatttttctatgtagaaattactttaaaatatcaaaaaaaaatcatttttcatgtttataataactacaacttaattaatcatacgctaatatttttctcgctttacgtgctgacctcataaacaaacaccactgttgttgtctctagccttgctcttaagcaaacttgaatgcgagtgtctctagccttgctcattagcagacttgaatgctgagggtgagaagacaagtgtacctaacaccagtattgtagaaaatggtcatcctccatctcaaaataagttaaatcctatacggcaagcatatgtcgcattacgccaatatggtcttcattacttagtcacgaacacatgaatcctatcattagcagtttattagtcatttgaagcatggtcgcctagcacttgtggaaagaaaagaataacctatctttggcccgtgttctgtcacgggtgccgacggtggtggagcagattgtgcaagaagggcggcaatgggttgagacaaggctgttagtcacatagcttagtttacttagggggtgtttggatccccgccacacattgcctcgccaaacatgcggctgccacaacagtttggctgatgtttggttaatacgtgagttgtggcagccacactttttgctagttcatttgcatgcttatttccgccacagctgtggcgattatttctctcgccacaatctctggcgacgccacaacttgatgactggtttgggctgtgaaccaaacagacccttagttttgtttctctcaccttcctcacacgagtcacattaagtttagcatgctcttcaatgtcatattgtaccctcctatcccc

SEQ ID NO: 56034 - DNA, 1501 bp, Oryza sativa
ctgcgcgtctgaccgcgtggcgttgctcacacaggcgagcgaaagcgagagacacaggcgggtgggggggcgacagagagggagagggagagggagagggagagagagacgccgccggtttcttccgcctgctcccgctcgttcttcctcggggtgggtgggtgagccggtccacgaggcggcgtcggcgacggcggggcaacactgccgcagcacaggggtcaggagacggggccggcgttggcggaggagaagattgggcacaacgagactatagagcaagcgacgcctccttttctttttttctccgatccatcaggtgaactaggccatgcgtctgaacttgtctcccttcccccctcttcctccggctgcttcatcggctccttaccttgttggtgacctagaaccgcgtgtagattggcaagattattttttgttttttgtaattttttttgcatgtgttttctcgtgattttaggggaagcttctcccatctcgttgactattgagaacggatattcgaatggagtgagggttttgtatggctaatcgtgagctgagctgggtgatctggtcttcgtgacagttctgagcacgaactggggaactggcttcgcattgaggttccaagaaggtcaccggatttggcgcatgggggtctccgccagctgcttgtggggtggctccgagtcgagggggaaccaaaatggttctgctgcggtgacgtctcctcgttcaggtatagtatttcactcacttggttccagagatcatgagctagctaatactgtcagaattttaatgctgcttgcatttcaaggtctgcatttgcatttaggaaaaaccagtgttgttttacatgaaaatggcgattaaattactacctatcctcttctgccatgtacacatgttgctccaggatatatatggttatggatgtgtcgaacaatcattctttggagagtctactgagaggattttctttttctttatgttattgaagcattcaaagggatgaaatgatgagaaattcatgttttttttaataataggaggaacgtctgaatattttctgtcttttcatacataggaaagtgttgttggcaagtttctctttttaagacaaaagcaaggctcaacacaccaaaactcacacaatatatgcttcatgagtataatcatcactcaagataacacatccgaaaaaaagttcttgatgttcttatgtcttcctttaagcagtgccatctgcaaggaagttttgagcgagctacttcctgcattagggcttaggggtcctgttggaaactatactgtgtaaaaaaaaataggaaacaccatgtaaaacggtatgcattataattaatcatgcatatatgaggatattggtcttaaccttagagcagtcaaccttaatggccactatcatgttttagtgaactaatacatgtacttctttttattacttctctttcctatttttctaaacaaacattga

SEQ ID NO: 56035 - DNA, 1501 bp, Oryza sativa
cctcgaagaagcgcctcctgtcctcctccgccgcccgcgccgccgcgctcccgttgatcaccgcgcttgcctctggcttccccgcggagcacctcacgccgccgcgcctactcgtcctcctcctccctcctgccgctaccgccgccctcgctctaaccggggccgccgccgccgccggagtggcggggcgggcggcgaggcgcgagggcgtgaacgtggcggcggcgatggactccattgcgataggctttttttccacagctcgtcaactccacttccccccactacgatttggagcacacgcgaatgggagagcgcgtatatataaggaagattcagcgaggcgaccccaaaggagttcgattcttgaattcttggattgagacaggccgaagtggtagtcggattttaccaacacggagtgggatttttttttttttcgtcttcctcccgtcgtgaggaatggttgtggccggcggcggctagcgagatgggtttttgggtttactcttcctcgatggggagagggagacggtgccattataaactgggaaaaatacgtggaaacttaaaattacaataaaaaataaaatgtacgagatttgttcacatcatcataagtactcatgagtaaatcgtgatgacgtggataaatgtcggacgtccatttttcgatccaactgtattgtattttttaagtttccactacatatttccccttataaacttacctattttaaaatatatcattgttatttactattcctatttgaattttacaattatttttgatatattactattttatatatctatctggtggattcattaaaaattttgatcagcttacccttctcccttcccctctccactcactcattttcaatgaaatgagcctaaccacgatggtcaccgatccacctccacctctccggcggccatctctccctatcccctcgccaccgtcgcgcgttccctcccctctaccaacccatctcctcctctagcgtgtgtatcagggaaagggaataattcgaggtcaacctcgtttggccaccttattgttcccctcaagccgaacggaacctcatcttgaattcaggcgccacttagagactctgtcgtcgtcaagcaagtgtaggttggcgagccacctaggcatggccagcgtgcttgtcaatgatggaggtggattcgatagtggagtgacgaggaacacaaacgtaggatgtcaatggcggtatcgaggtcgccgattttactctgcccgaagtgagaggggatggagaggaagagaggggaaccgccgacccagacctcgccatgcaccactgccggaatgagtagacaggggagaggaagagggtaagtagtaagtagtggtaagtagtggtatatctcaaatagatgtaaagttgtaatgtcatgggaccaaataggtgaatggtaatgatattttttaagagttgcaaatttgttatgacatggatccaattaaccc

SEQ ID NO: 56036 - DNA, 1501 bp, Oryza sativa
atatcttaatcccacgatcttcggagagaaaaaagtaaataaaaaacatattatagtccacgcggcctgcaagttccggactcgcagtgggtggatggatgcattcagaggaagggaacaagacgagacagagacagcgagagcagtagtgaatagtgatgggccatggaaaaaatatcgcaaaagaacaaacgagatgaaaagtagatgagaatattgccctattcgataaaagtggtactccctccgtcgattttgagtttttgtttacattgtttgattactcgtcttattcagaattttttgaaattattattatttttttggcttactttattatccaaagtattttaagcacatttttcgttttttatatttgtacaaattttttttgaataagacgagtggtcaaacagtgaaagtaaaaactcaaaatcccttatattatgggacggagggagtatgtttttaaaccgctaaacgatgcatttcgtgcgaaaactttctatatgagattaatccatttcttaagtttgtaataattaaaattcaatttatcatatgttattactatctcgttttacgtaaaatacttaatattttatctttatctttgttacattcaaacactactatgtgtaacagatctgataacgatcgttattacaacaaagtatagattttcaagtcctaaattcaattctaaaagttggattaaaagtagagttgtgaagctgtctaaacttttttttaaaaaagttggaactatttggttagatttcagctttagaaatttaagttgtgcaaaataggttctatatttcactgtaaatatgttttccagaaaatgtcttctactatattgcgtaaaccactagttacctaacatatttttttagataatagttacctaacatatgtataagaacattcgttcaaaaaaaatgtataagaacataggatgatgagacacatcataatgctactaatctgaacaacctgtttaaattcataatattaggatacgtgtcttatccgattttaagtttttatactttataatagagggagtacaaattatttcttctaacctaaaatatagctacaaagtatagacatggcaaaaaacaaggagtttccgctgtcgttgaggcctcgtcaagtgctttcgctccgtctaaattataacactaagtatgtccagattcttactatagctaggtatattttgaacaataaaagtactattattgtttgtcaagttcgtttattaatccgatgtcaaactcaaaccacgaccgtatatgcatgctgcgaatggatccaatagtctccccacgccgcttactttctggggagcttccctgacttcctacacctctgtattggaactattacgaccacatgctctcttcctactctcctccttagaccatacggacttaatctctctcgccctaatcatcatcgtcttcctcctcttggatcttctcctctgcca

SEQ ID NO: 56037 - DNA, 1501 bp, Oryza sativa
ctttttcagctaattcaccccatcattgaaatgtactatttggtccaccattaaaatttatgttttctaaaaaaaaatattctactacttacgcctcatgtttaaaacttttaaatttattttttttcaaatatttaatttattcttacgatcaactagctaatctgcgatagtaatccgctcaacaccttaaatcaaagagaggtaagttgctgaggtctacatgagggagcaaggttgctgaggtaagttgcaagtgaagcctatggggaacatggatggagcttcaaaccaagaagattgcaatgaagctgtttgggttgtccttcaaaactccttgttgccttggctctctagggcatgctcaatgtatatagattaccttagtattatggtgggacccactgaaacatattatcatgtccacaatgtatatgtcaagagtggatattaaggtggatcccacaaacccaaaattagctattgagagagggagagagagtaacactaccatgagagaggaagaagtactatattttttttattccttgtgggtagtctttatgcatatggctagctcaagcaaatgccacctataaggattacactcacaatgtataaagttcactttagaggcttaaaaccaacccttatgttcacattgtggttgcccagagactatatgaactcttttcctggagatgtaacccaatgtttgagatgttgcaaaacaattagagtagcgttttggctcatgttggctttagggttgtttagtacttttgtgactcagcgtcacggacaaattgggaataaacaggaaagatacttcttttcatgcctatccttgaggtgaagtgaacttgagatgtattaacgagctcttgttgccactgctttttcccaaatgttacatggcctcgttataggattagactggcttatacaacctcaagaggtacgtgtgaagttacaggaatgtcctcaaaaagcttggaaccctaagggcatatttgtatatttaggcggtccttagggcttgttgcaggtactagcttgcgggagtggttggagcggtccccttgttatcttctgtgataatattctcgtctggtggcgtatctacaaagctccttcatcattcttcatgtaccactcatctcatgtagtatgctcgaattgtatcttcctgaacactcaactcgaacactacttgcctagtttgcacgttgttccctccaaacagcttgatcctcttctagttgtctggttagaactcgagaagtatttacctctggttaaaaaaatgcccgaagttacatttggatcgaataggaggtacaaccctcactccctcctacagtagtgcctaacatgaatctctatccccagtaaacccagaggtacctaaaacatactgggaaaaaaatagatgatcacacgagggaaaggaagtgggggaggcgtttttttagctttcttgttatttttgttaagacct

SEQ ID NO: 56038 - DNA, 1501 bp, Oryza sativa
cagagaatgcaagccgccataacaagttttacctctagttgaagatcaaaaccgatgcagctcaactcgaaagcaagaactcatcgaaacaaaacgaaagtaaagggtggcgatgcaccgagattgtattgaacgtgtgttctattaattacatggggctcagggtctatttatacccgagtttaaaaaatatgtccatgtcggacacgactcttatctctaacaaactctaagatgctacaagtctttgcggcagactcttgcccaaacatatctataaggaaattacataaaatatactaattaatagatacaattgccttctcaggactctatccatacgtggcaatcctcatgaagcacatcaacccaatccgacaacgtatgtcgtgtcatattgtcggattcggctcaatcggctgaccttgtccaactcggactctgccgatcctggtcgcagccgattcggactttagttgatccttgctctgtttccggaacgattccatcttgaattccactccgatcctatcttcatctccgatactcagattatcaaatttggttgttaacagaatctttcaaatctaaaaattcagaacatgatttgaatctaaatttcagaacgcatgtggttaggctcatccctatgattcaaatctatttaggacagaggtttaacttttgcttgcctttaatgaaacccatttctcctgaagaaaaaaacaaattccattttacgcccccgactttttgaaaggaacggttatcacatatttacgttttgcttcctttaataaaacctatgttcctaaacaaatgaaaaatatcattttacgccccaactttttcaatggaatgcttagtgtaatttctcggtttattttacaccgtaaactattaaaaacgattcaccttactattatcacttatgtcttaatgtttcttgaaattatggttgtttatataggttggaaacactcagatgaatttaaacatagatgttttaaattttaagtaaatagttatgattcttttaaatatgttagaacttttatagtggtgccatctataactctataaaattttagtttgaaatacgactagtatatagacaaacaaagaatagaaatgctaatgctagtaaagtgaattatttttaatagttcaaggtaaaatgagaaaaaaaaagtttaggggttaagtgatacatacgagcattcaggtgcacatactaactaactaataccttcaaaatatattttaaccatatttttctataattttcgctgatatttgttagttggtgtgtacacagtaaggcatggtctaattctaaaagaaaatcatcgtaatattatactacaacctttctaattgctgggaggtatcaacaattgtctagttctaggtcaaggacatgcaaaaagccaaatatatgtacgtagttgatggtagtttggtggaaatataacattctgtaactgtatatactacatag

SEQ ID NO: 56039 - DNA, 1340 bp, Oryza sativa
cagtataccactctctttcatccccacagctccagcgtcgtcattgttgcctcgtcgcctgctcgtgtccaccgcctcctacttccatccatctaaacgcatggatatccccttttccccctcctccttccactgccacccaacccccggggccctaatccgtgctactccactagagtttgcagtgtcaccggtgccagagaagaaagggagatcaccagagctacaagataagggtctacagcacgaatcgcaaagcacatctagtgacccaaaactataagggcctatttagattgtagctaaaataaaccttaccaaattttagcaatgccaaaattttggcaagatggcaatattgctaaaattttggcatgatttcttatgtattgactaaatttggcaacaaactaaacgtagatacttttttttgacaactttattaaaaaatggtatagttgaaaatggcattaaagtaaacaggccctaagatttggggatgtttttttatcgacaaaaggttagtgattattatgaaatgaccatataagtttatgcttacattgtaaaacgtgtgaacggtctccttttttgaccgcttaggcgtactcaaagtagaaattgggagtgatgggtttctatgctataggccagaggagatgtaggacttgttcatttttcacttggaaaaaacttatcaaattttagtaattttaccagaatcgaagtttagtagtaagataataaggtaaggatgtggacgatgtttggtttaacacattactaaattgtgtagtagctagagtagaaagttcccgaattactaaaatatggttgcattggtaatagtatgtttagtatgctgccttgttaaattttgatattaccaaaatttaaaaggtcttcgttttaaatatttttttaaaaatagaaataggaacaaatctaactatagttcacaatagatacatggcaatttctatattaacatggcagaaggaaatcggcaattgtaaatctgtaaccagagtcccatgccgtttggatccacagggccaaaagttctggaaggcactcgatgattcggcccaggcggccaggctccaaatcaggtgttttccagtgcattcttgaactgacgagaattatcaggatcccacctctcaacgccgcccacagcccgtataaatccggcctcccctcccgctctgcggcccagacaaagatcgaaagcaactcgcaaatcgcgatcccttgtgctcacatcccaagcttcccaagcacacactgttttagtgttcacaaacacagccttccttctcgcccaaatccgtcaacca

SEQ ID NO: 56040 - DNA, 1501 bp, Oryza sativa; identical to SEQ ID NO: 23982

SEQ ID NO: 56041 - DNA, 1501 bp, Oryza sativa
tgcaaaacaaagcctgaatttttctgagtttttttgaccaagtacctggcagtcacgtggtctcctatcctcacaagggatggagccgtttactctagaaaaagaatcataaagaaatatttagaacaaagaataacttctacctgttgtttttcaccttctctttcgaccgtccgatcagaatccatcgattgtagcatccattggcatagcaaaaatacttagtctgtctttcttcatgcgtgcgtacagctgtacttatatttacattaagaaaagatctattctcacatacgtactctgtatctctagtcaaattcggcacatgtggcacaatacgttttatttgacctagagtacatgtatacggaattaactaataattataggcaatacatccatttcatccattcatccatcgttatcgtaataattaacatgctaaatgccagtaacagctacgtatattttgaccacatgcacgtgctgacgtgcacggattttatactggtccgtgcaaattagtgaccgtttcatagctaagccagagtgtacagctctgaccaatctttatctatacgtgtattagttcctgcatttttactatttctttttacagtagagaagttcacatttccaacctcatgtattttactacttatataggtagaatactggaattgcttggcatggatgtcgtacacccttagattacagctaagaagaaatatattagtaagattcccatcggattagtaaataaattaattacttgctgcctcgactagctatctatggatgtcaatgattttggccacccgaccatagggtatgagaggccacatgctgttgcccaccatgcaggtaattaagcctgcagactgatgatcacaacggtagagtagggactacacgtgatgcacaagtactacataataatctatgtgcaatgtgctcggattaattatattagcatatcatgtaggcatgtagtatttatgcatgcatcccatagaagcagggacagaaatttaaaactgtatgtatgcccatagcaaactgaacaagaacagatgaggaatttaacaatgcaggtcaatagtggctctcatgtggtttttagaggacaggagaggaccaccttcatattgtcaaggtgccaattagcgaaagatggagattaatggttaagtgagagtgagaccacacatgtatccattggcaacacgtagtcgctctaactagtcttttaattagtgagtctcatcaacagtgatagtgtaagaccagcctaacccactaataaagtagtggtataatttaattaattagtagatcaataagtggttatacatagctgattattgcagagtggtcccttaattaacttcctgattacttagaagcaatgcaaatacagaagatgataatgaagaattgatggtatttatggaggctgctagtgggattaattgtgtgaaatggaactgaaaactgcagg

SEQ ID NO: 56042 - DNA, 1501 bp, Oryza sativa
gtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggtttaaccgttttacatagcggagtagttcgagcggcaacaacacacttgaaaggaaccagagcacaccaaaaacaccagtaattacacctcacataagtgatcgatacacttgaagccacagataaatcgtttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctccacctccaccttgacctcctccttcttcagccccggcacgtccgccttgaacacgtgcgcctccggcgtctccttccagtcgatgcgcgcgccggcgaaggccgcggtctcggaggaggtgccgcgggggaaggacgggaagatgctgccgctgcttctgctgccggagccgaaggggaagccgtcgaaggggtcccagaggtcgagggagaaggggtcgaacacgttgctgcggcggatcagcgacattgtgtattgtgtcttgctgttttttggttgtctggtttgtgttctagatggaaagagggtgatctcaattctccagaaaggctggtgatttttcgatcgaagaactgaattccttggcaccctggcggtgggtggtggcaacaatttatatagcagttcgtgatggtccatgggttctactggaagttttgcttccggatagttctcgtttgttcgttaatttgggccgaaattggaagtggtcttctggattgttctaggcctgcttatggcctagattattctggagagtcctggacgctatgggctacagcccaccccgctaccggtggtgtaaacttctagcccaagctatctcgtactaggttctagcccatgcgggggcaaactggaagtttctagaagcttattccaagctccacgatgccctctcgctgccctctataaaaccgcgctccccttcaccggcagaaccacgaagaaaacgcaaagcaaaccaagcaaacatcagagtaagaactcagagaagtccgatcgttccacctccaaattcgcagctattccgacga

SEQ ID NO: 56043 - DNA, 395 bp, Oryza sativa
gaaatgctcaagaagaaaatggtaagaagtaaagattcaagaacattgctggttgctgctatacattgtcagcctgtcatgtgcaatgctatttatgtcctattgattgacatggttagtggtatgacatgattatttggcctaatgaacatgcttgttatgagacgacattagctgtactagattaacttcttgctaattttctttgccgtagttatgattcgccagtagaatgacactgattttctatggcctcttagttggatgagataaaaagagatgagtatgatgagattaatttcttgcctgtttctgctggatgccaaaattgcaagctttgattcccgatttaatggcggcgatggccgcagataaatcccagcttggtggatccc

SEQ ID NO: 56044 - DNA, 1501 bp, Oryza sativa; identical to SEQ ID NO: 23961

SEQ ID NO: 56045 - DNA, 1501 bp, Oryza sativa; identical to SEQ ID NO: 23963

SEQ ID NO: 56046 - DNA, 1501 bp, Oryza sativa; identical to SEQ ID NO: 23972

SEQ ID NO: 56047 - DNA, 232 bp, Oryza sativa
agttgttagttattcacaggctgtcgcacgtgtggaacgaagaaggaaaaggaagtatccatgtgctttcctgatgggccacccttacctttcttctaaaattcatcatcatgtctccacactactgccactgcaaacagtgtacgcattgactcgatcaatcaacggggagggaacacaacacggcggccatcgatggccggcgttttgcagatcacatcgtcgacgacca

SEQ ID NO: 56048 - DNA, 221 bp, Oryza sativa
cctcctcttggtataaccggctccccctcctccgcggcgcggtagaagtaaagcgggggctgtcaataggggaggggagtaggcggcggcggggggggtgcgagaacgctggcgactgggcgctcacccgcctaaagccaatccacccacctaaccagttggcgggtcacggagaggggacaggagtagtagaagaagtaggaggctcctagctaccaccg

SEQ ID NO: 56049 - DNA, 1501 bp, Oryza sativa; identical to SEQ ID NO: 23986

SEQ ID NO: 56050 - DNA, 154 bp, Oryza sativa
aaatatgcactttagtctataactttttggttaatgaaatcgcaacaattttgaggaaacataactttaaattttataatagaatatctaaggaaaaagtatgaattacccccctaaactatcgcggtcgaccgaattaccccctaaatctgaa

SEQ ID NO: 56051 - DNA, 1501 bp, Oryza sativa
cgaagatgaccgagctcgagtacatgcagtagccggcggcgagcaggttgctccccggctggcacacgctcacgatgcacctctgctccacctggtcaagctgcaggcacacgcgcgcggacagaggcgtttcgttctgttagcaccgtgtcagtgtgtgcatgagcgattgctaggcgatcgataacgcgttacattttggtcgtcggcgatgtcggctaggcactcgtcgttggggctgtagatgccgaagatggagccggtggagacggcggcgtcgatgttggaggagccgtcgagcgggtcgaacaccacgatgtagttgcccgagtagctctcctccacggccaccggcacgtcctcctcctccgacgcgatcacgccggtgcgcccgctcgatttgaggcagttggagaacacctgcggtgcgcatagcgctcagcttatggtcggtcgcgcttgttgcggtggttcgcgcactaaccacgacgagctactgataatttagtcgtttacctcgttggagacgacgtcgagttttttctggtcctcgccctgcacgttgacggcgccctggacgccggtgaggttggagatgggcgcgcgctgcaccagcgaggcgatctgcttgcacgccgtggagatgctggccagcacgatggtcatctcgccgtcgatggtcccggcctgctcctgcttcagcagccacgtcgtcagcgtggtgatctcgtagctgctcttcttgctagcctccgtcgcggcgggcgccgaggccgtgtcgacggccgccatgcaccgcacgctcggggccgacgacccaccggcgagcctgccgggctgcctccggaaggagaggccgcattggagcgaggccgccgcctgctggcgggagagcaggagcaggtgggaggatgtcgtggctgcggcggccatcgctgctgctgcttggttgcttgctctgctcgcgctctcctctcgctgcggctacctggtcttggtgccgatggcttcttgttttgttccattggttttagccgcggtttgtgtggccggagagagggcgggaggtgagtgtgtggattgggggagaattgtgaggatggcgttgcctcagatactagcctaattgcaactccttgtccttcagccagcgtcacgtacagtcacatacaagtagcatcgccttgctcaggggcagtatatacttgtgcttttgattaggcagatctattattcgtacctatgaatatagatggtcatatgacccagcccaaggccaggtgatttgacccggcccaggcatggcaggtcgggccatgccggcccagcctaacagccatgtcgtgcttgggctgccacctcggcacgttgggtcggcatggcccggcacaaagttcagtgtcgattggaacgatgagcccagatccacatagttccggaggacaaaggagcaaaacggtggtcagctgtcgatgatgaggctgctggctcatatgggttt

SEQ ID NO: 56052 - DNA, 390 bp, Oryza sativa
cctctggtttatattataagtcgctttgatttttcctcatcaaacttaatcaagtttgatcaactttatagaaaaatttagtaacatctaaaataccaaattagtttcattaaatctaacattgaatatattattttgataatatatatgttttgcgttgaaaatgctactgtgtttctttaataaacttagtcaaattaaaaaaagtttgactagaaaaaaatcaaaatgaattataatatgaaaaggggagtagtaatattgtggagagtatggttactaagtgtacacacggtctacacatccgattacagataggtggtgagctatatgatataataggccagtgatagagtaggaccggtcgtcatgttgccttctatcctaagg

SEQ ID NO: 56053 - DNA, 335 bp, Oryza sativa
agagccgatttagagatcaaaatcagcctctaggccgatttagatcgatataggatactacccgtctcgtgggcaaaatggaaggttttcaggacaaacctaaaaagaggtgtcgcactctcgcagcggcggcggacggtttacggcgcaaaccgacaaagatagactaaactagagtaaaatagaaaaacatagtaaaagaacgattcaagtagattgtatttggggggttttacaatgaaccggccttgtcgcttaaataggggttggtcttgccctctacaggcccttctccatgtccaactcgggatagaaaccaaaggaaacacgaaaca

SEQ ID NO: 56054 - DNA, 1485 bp, Oryza sativa
acagcttattaattattatggctgagagcctgtcagcctgagactgatggagagtggccggtggtcgccttagtggcagctgtccatctcttccatcacgcatgcaggggtcagattattccacccgcatttctttgcaatgtcctcgatgcagattggcggaaccaccaatccaggatagtggaatgcaatcagagatgtccagattttgtcgtcactaaggtcgtcatcccggcctgttaacacaatacaaacagaattaattagcgcatgcatgcacaagtaattaattaggaatagaagcgctaacacaatacaaacatgcacaagtaattactactaattaggaagagagaatcaagctcagctagattgtgagaaaacatgagatggatggatggatttacctccccgggtttcggtagcggaagtaatagttggacagataacaagaactaaaataagaacacctgctatcttcgtcatcttggtcgatttcatccgatcctttgctcctcctccgtataaataggctccagcccatgtgacgtgagtataataattaatataatgtatgcgaattttgctcaatatcctcttcaacgtcttactatgtttttggaatttggacgtgactacacggtaattaagtgtgcacatgacccgttcgcggcagcctccgacaacaagattttctccttccactagtaacgtgtactcctactccggccactaatcatgcatgagcggcatgacagaaatgtcacattcagagcagtgtgattaaagcgaatgcatgtctttctgtccacctgcttgtgcaagcaactgttagctaatcccctcctccactttactgtctgtgtgctcatgcagattggtttaaccctatagctaatataattaattaactaggcatgaaagtaaaaccaattaggaaacagcagagaaaatgtgacctggtgtaaacgtacatctatatctatctatcatatactaaaagttcattaaattaacttcctacaaaaactcccaagccgccatgtggtctcctacaaacgctcgtaaaccgccacatggtgttctaataaattaggaaaaaaaaatcggtggacctactaattttacccattagatctccatctcaaagaaaaaaaatcaggtatacccaccacgatactcccctccacatgtggaatcgtatgtcctcactaatccccacgtatacgagttctacatacaaaccactatccaccgatcgctaataagtcatattgcttacaagacatttcatgcacaatgtacctaatataagaatcagctgatatccaatgagcatgcatgcatgtcatctagcaccaaagataaagaacgatactccgcgagtaacatcaacaactgataggtaggtagagtatgccaccaagctacaaccaacagtagttgactacaagtaaactgagactattagtagtagtgttccga

SEQ ID NO: 56055 - DNA, 218 bp, Oryza sativa
tatgtagatttttaccgaattaagtttaattaggactattgaagtatacctatatcttagctataggtagtactataacactggtggtttaaagcttgacccatataaaaagattcttatgctaggtaaaaattcaaaagttttcaaactgtatgaataaaaaatggatctttttttgcgcgttgctgaatgttccttttcatctttctgtttgtagg

SEQ ID NO: 56056 - DNA, 396 bp, Oryza sativa
cacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaa

SEQ ID NO: 56057 - DNA, 191 bp, Oryza sativa
aaagtttcaaatgtttgttatttctttgcatatgcattgaactatcgtcatatgttccctgcaaaccatttgaaatatttatgcgacaaagtaaaagtctcaaatcatatttgtgaaatctcacatacttaggaaatacatatatttttcattcattacatcactttttttgtccatcatccatatttagt

SEQ ID NO: 56058 - DNA, 680 bp, Oryza sativa
aatcccttatattatgggacggagggagtaggaatcagggttggggaagagggaagaggggactccctcgggtttagaggaagatcgaggcagctatggctcgacgataagctgatacagatagaagtgaggcatttccaaagccaaagtgatggaggaggatgatgagcgacgatagcgggggccgtggatccagtaataggaattacaggggacggagagatcggtattaagaggaacatcgttgaagatggggaagaaggcacagagtggttaggctgcaatgacggattcagcatagtgagttgtgggagaaggagaaattgctgggagtggtcaaccgcatgcaaagatcagttttggccgcttggaaaaaccattttttaagtagtgaccggcacataggaggagtcagacaatgagattggtgtgatgcgactgacgactgtaatagttatctctttttatatatgtctataggagttggtttgaaccattgaatcttgaccgaaggatgaaataaaaaaaagaccgaataggagatctctcaattggcaaccatcgccggtcatccggttgctacataacatccgtgaattttatggccgaacatttgtagtagctattgatggacaaaatccacaattccctgttctccatttctattgttctttattaga

SEQ ID NO: 56059 - DNA, 1093 bp, Oryza sativa
gttgagttcttcacgtttggagaagacaataagctcaaagtattcccaccgaatacctataagtttaagccaaaaacccacataatattagatgaagtccaagaatgcattttagataatttctggtatcaatacaataataagagggaagaaaaaggctatatgctatcaatattaaacagtcttgctgaatatttccatctaatgaatgatataatgccaacatcagaaaataatgaagtaataccacaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatccccccaaattaaaaaagaattgaaagaagaaatacttaaagaattaaagaaagaaatgaatgacaaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgaatgaccaaagtatgaattgaatttgaatcaatccaaaatgcaaggacagtgaatgacatttgactgttaaaaatactgtggagaatattgctttcggcggaaaagaaaggcgcaggtacagaggtgtctccaccttggccaattcaaggacaaagtaaagccaaaaagaagataagcatctccatggtgcgagccagctcgtgaaaatacagtatctagaagataagcttgaagcacagtcgagcctcccgag

SEQ ID NO: 56060 - DNA, 657 bp, Oryza sativa
ctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgtttttgaacagtgttttttgtccgaagcataagtgtggtatcagagccagtcatcatagagaaatcaaattcagaagctaatattggaaaggtaattactaccaaagataatctgaatataaggtgtaggctaaatcacattgaagaccatagttggcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggaatataagacaaggcagaataagatattacaaaacagtgactatatcaaagaattattagaaataataaattctagtaaaggaaaagagatagttttggcttcaacaggcataattacctcatctcaagctattaattcagaaaaa

SEQ ID NO: 56061 - DNA, 279 bp, Oryza sativa
acaacttcggtcagaccgcgatccgtcaaattcgaaggtaacttttatttccgctaaaagttttcagtttttgggtataccaaccattcacccccctctggttggcttagttattgtgattcgatcctacaagtggtatcagagccttgttttcttctttggacttttatcgatctagagtttttgccatggctactcctgctaggttttcaactaagcctcatgttttcgatggaacggatttttctcattggtgtagtaggatgcaatcttacatta

SEQ ID NO: 56062 - DNA, 301 bp, Oryza sativa
tctctgtctcattgttgatctagttgaagctagctgctatgctgacaatccagagtggaggttggctttaagcttgactatttctatttgcaacgaaataatacccttcatgttattcatacaggacatagtcataaacattgtcagtttgtgataattcagtactattttttcatgaaacttttgttctaggcttctagcaatgtaagaaaataaaagtatatctgaagaaaacatgtaagaaaataaaagtatatctgaagaaaactgaactttcatatacatcaaataatccattagg

SEQ ID NO: 56063 - DNA, 789 bp, Oryza sativa
ccacatttgctaatggtttaaatccttgttgagagattgttactagaaaattataaaaatatccctagaattatcattcgagtgacatcgttatagggtttgtttattatgttgccacttttaactacaccaaaagagtcaagttttggttagactataaaccaaacacatactctcttcgtttcatattataagtcgtttgactcttttttaattaaacttcttttaagttttactaagtttatagaaaaatatatcagtattttcaacctaaaacaaacatatttatcaaaatatatttaatgttagatttaatgaaattaatttgatattttaaatgttactaaaactttttttttagacttagccaaacttaaccaagtttgaataaaaaaaatcaaacgacttataatatgaaacggaagaaatacttatcaatgctaccctaccaaattttggtaattcgataagtttctactcctaaaaaattgttttacaaattttgataagttaacaaactaaacacaaccaacactaccaaaatttgatttgatagtgccaaaatgtgttaaaatttgacaatgacaaattttagaagggttgaaagtgcataccatctgaacagctcataaattttaaaaaacagtggtaaatttacaaatgctacaggtaagttccagacaccttcagaatttgaaacgacagtaagggaaatataaaaacaaattcgattttgagaatttgcaaatcttgacaccatctcgctcgttgggttgtctccgtcgaagc

SEQ ID NO: 56064 - DNA, 1501 bp, Oryza sativa
ccatgccaattactggctctaacttttgcacacaagcatcatcagtactgcttatattcgtgtctcccacgtcttctttttcatgatctaaatataagaataagtataacgtgatcattattgtgtatatgctagtttaacatgcaaggaacaatataaaatcctattcaccatatataggtgaaaccaatctaatttaataacaattagcagataacttatggcagagattgagacaaactaatcgggtcttgccaagtttatggacaattaacatactctttgaagatgaagggtggactggggcttccgccatgcgtcttgcttcacgaggacactgatctctatcaagaatcaccaatctaattttagagatctagcagtacagaagaacagagaaagaggaaagaaactctgtgcggcgtcgcgcgcgacgtcaaagtatttcgcgggtgaatggttctgttacctgattttgtgggatcgtggttaaacctccgtttacattgttacttggttgattgggtggacctaccttgtgtacaggtgtcgcgatttgatttggcctgtatattactatgtgcagggttccctgcacctgagccggactcctggaaaagtgctccaactccaagcatatgtgtgactctgcgtgttgtgtacttgtgttgcctggattttagtgaactgtgtgccacgccgtaggagtctaggaggatgttatcgactctcgagtattaccttttttttttcctgagatatgtcaggaaattcgtttttttatatggcgtcaggaaattcgattcagcacaaaaaagtacgggaatgtggagaagaggattcgttggatattcccgtgtttttgtttaattgaagtgcctagcagatggatgcccacaaatgaacatgtgggtttcaactagtatacttccctttgttactgatcttcagtaaaagacagaagtatcaccatcgacggaccacatgcaacaaccggttccatggtgtagtggttagcactccagactttgaatctggcgacctgggttcgaatcccggtgggacctacttttttttattgctaatgtatgcaatttacccccaagccaccagattcaggagtaacaaaaatggttcctggtaaatattagtagtactcaaaacaatttagctccaaattacatccaggaacaagaaaaatgaaaagatgttcttgctgaagataagtactcgtgatagaatgagctactttgagtcaacaagattcaggagaaaaggatatgatacatcagtgtatatttcagtctcgttttaaagagaagagtgtacatgaagtactacaagagtgcaaatgatgcaacagttagtggaaacaattcaatcacagcgagacactaaaatacattaggatttaggcgaagctttaaaacaaaacgggatggcacacaatgccatttaattttgttcgttttctacctgtaatatgagcaacgatgttgta

SEQ ID NO: 56065 - DNA, 453 bp, Oryza sativa
atatccaatccactttgtcgtcagataagcgttgacataaagagagaacattcccttcccttttcaacagagaagaaaaggaagcaacagagatctgctccttgaaaaatattcgtttgttttcaattgcttgtgaatttctttggaccgtatcttcctttctcatcttcgtatacgcataaccattctattctatgtgcgtgtgattatacggacggggtcaagtaattacattcaatcgcagaaaaatcaattaacatctaatcgcaaccaacaaaaataacatgcgtgccgtgtcaggcatgttgatgcagctgccgatctttgttgatttgtgaagccaagacaacgcaagacgcgtcagttccagtatttctcttctctaataattttctgattggaatacgtatgggcttaagttaagtttatgcaataacagattgggcccaaaaa

SEQ ID NO: 56066 - DNA, 1501 bp, Oryza sativa
gtattttaggctaaatatgtttttggctgtccccaatacatgatttttgggagtttaattttagtcatctattggagatgctcttactccagtttattttgggaatgagagaatactactctacctccgaggcatcttcagccatccaccattccaaccgcaccataggagcaactcctttgggcttcagcgtccgcaatatgggccactttaattggtcctggaatgaatattagactctccaacaatacgagtgacctaaagtgaacttatttctcaattggtccatggaggccacactcgaatcgaaatatgggcctggcacatggaggcccatttgaaatgaaggcgatgtgccctattagaaatgaataagttcatttcagatcccttaactttacaccaaatccgattttcgttcttagaaaccaaaaatcagatgcaaccggtccctgaactgtcaaaatctgtgcaaacgaagtccctcgacggtttgaaaggcgattttgactgatgtgacgtttgcgtggctggtttgattaggacttcgtcccacgtaacattgacatggcgcatatgcgacaatttgatcccggaaaaataataaaaaaacgtaagcatcacgtcagccaaaactgtctttcaaaccgtcgagggatctcgtttacaccagtttttgacatatacagatacaggagccggagtcggagccggatccagaattccagatacaccgtgtatcatacacgaacacgatcaatcacctgattccttcaactgtttcgtcagccatgacgagcgtttctttggctcttttcctccgaagtactagtactacattcttctcccatccagtcctcagcaagcaagaacttgggcaatcagttcactgtcctgcactgcgcctgccgctaactagagatcgaactatcgaaggcaaggcatgctgccatggacaagaccatcgttctgtacccgggcctctacgtcagccacttcgtccccatgatgcagctcgccgacgccctcctggagcacggctacgccgtcgccgtcgcgctcatccacgtcaccatggacgaagacgccaccttcgccgccgccgtcgcccgcgtcgccgccgccgccaagccgtcggtcaccttccacaagctccctcgcatccatgaccctcccgccattacgacgatcgtcgggtacctggagatggtgcgacgctacaacgagcgcctccgtgagttcctccgctccggcgtgcgaggccgaagcggcggcatcgccgcggtggtcgtggacgcgccgtcgatcgaggcgctcgacgtcgccagggagctcgggatcccggcgtacagcttcttcgcgtcgactgcctccgcgctcgccgtgttcctccacctcccgtggttccgcgcgcgcgcggcgagcttcgaggagctcggggacgcccctctcatcgtccccggcgtcccgcccatgccggcgtcgcacctcatgcccgagt

SEQ ID NO: 56067 - DNA, 812 bp, Oryza sativa
catgtcggggtattaccaggcgcaggagatgtcgacgatggtgtcggcgctggcgcgcgtcgtggcgggcggcgcggcggcggcggcgcgtggcgtgcaggagaggaggcgggaggagcaggcaatgcacgagctggcgggatacgcctgcgggggcgcgccatcgccggagttcgcaggtaatggaacagcgaacacgcgtacgctttgcttaccaacttctgctctttgctttgcaacttttttttttcacgaaacgtggcaagcatggtcaatggacaaaccagttgcaactttttaggcatgccccccaaaaattcaccaaatataagcgcttttgcgtatattttaacttcggtttcatatcatatcctctgttcaaagtatctaaaaaaaattctccatttggaatttgtacggtgcaatatacacatgtggtgaccttctttaaaaaaaatttccagagcatgcatgtacccgagcactgctacatgtactaaaatttatactaacaataatctcagccatttgatttagatagataaatgttataaaaaaatctaaatatactcgtagcatgacacatcggttttagtaagaatttagtaaaaaaaatatagtatgtatagtcttttccagtgttatacccttagttaagcgaacggaaaatgacaaaccaattgcacctctatatagtttaaagctttacagcggagttccattcaaacataaaaaacattattttccttttcttttcgcccaaaaccaacaattttctttattaagcttaaatagcaataccacttgtcact

SEQ ID NO: 56068 - DNA, 597 bp, Oryza sativa
aatttatgtcggatacgagacgctgaccgcgtcaaagcgtcgggtgccggcgctgcgctcgccacgacgacgtgcgccatgtcggcacaagcttaatcactcgtagtctcgtactaatcacttgatcctactgccgacctggtaattaatttgcccacgctaatccttagaaaaaaagaagaattaccgatgataatttccaaccgtaaaccgtaaaccgatcatagatttactacgcttgttcataccgggacatagataaataaattcacaaaaacagaataaacaaaaccaagggaagcgttgctgcaaagggatgatatatgcaggtttgaaaccagctttagaagacggctattctgtcacgttgcttaatctcctttaatttcttcttttttttctctctctcttcgtgccgattactagaatacgcacgccacaaactagccctataaatgcgcgagtcgtccgctgaaaactttcggaagggttgaaacgagaattaacgagataaacctctcctctgaattctgatccctctctcttgcatcgaagcgactctgtagtagagagactccggtgcatatgagacgttga

SEQ ID NO: 56069 - DNA, 1501 bp, Oryza sativa
tctattgctgagatgtacatgttttatagatagcaccttactttaccattgcggctgctctaatagtaggaagtgggctctgttattatccttgctctaaaccgcttaaaagcctaggcacacctagttttgagcgaccacgcttctcaatctatcgaacaatgttattttttttactttctttcaatttttttttcaaatttacagtagctaatactcaaatcattagtcatatgctaatgacccatatcgttttgcatgtaactaaaaaattatcggtgtctaaatatatagcgggacccccaacttcgaagaaaacgatacaaatctcaacaaaaaaggaagctaaattatgaaagaaaatttaacaggtagatagggtgacgataccctcattcctattcaatggaaaattcaggtgagaatcatttctatactcttttaaaagactccaacgatagtgatagtgatgatacatcatccactatcattgcaatttttacatactaacccttaaatttcttaatattacataacaactaaatataaatggatagtcacatactaactccgtcctaaaataagctcagccatagatatccgtatccaacgtttgacgttcgtcttatttaaaagaattatgaattttttttaaaaaaacaattattcagacataaagtactatttatattttatcatctaataacaataaaaatattaatcataaatttttttcaaataagacgaacggtcaaacattggatatgaacagtgtaaaactacgcttattttggaacagatggagtataaaattaatgtggatagacactttgtcctataaaaaaatgttggtaacatatttcataaaaaatacattttaatttattttagaaaatattatgatattttttcttgtatctatagcaaaacacggatgtttagctggtatccaacaagatacatagctgtgtaaaaagtcggctcaatttcattcttaaagcttgttaatttttagagtatatctcaataaacttagtcgagtttgaactggactcatcatattaactgtatgtaagactttctgtgaattaacaggacttcttaatcgggatttacgtgattttttagattagccggagttttccaccgtatatttagctgtatgcaaggctcggaccgagcctgttgacggctacgagcgcaccacgtcgtcgcctcccaaccaacggctcaggttcagtgaggctaggcgagggagggaaaacgatggcagcggcgtcgctggcactcggatcgccgcacgctgaatcgtcgcgatccagccgttgatttctcctccttgccccttatacgttatctggatacgacatcggtgccgtacatgttcggaaaatggcatgtcccatgagtcgtacgtggtccccgcatggtagaatcttactactactacttcatctgtctttatactgtttgaacactcatcttattaaaaaaaattgta

SEQ ID NO: 56070 - DNA, 535 bp, Oryza sativa
ctactatacaagaatggtatggataaagcccgattgaaaataaaaatatgagagcatcaaagtatctcgttttcttaaaagggaataaaaagggggccataatataacagaggtatcaactctaatttgggtggatgaactccaaatttgattcatcccccccttttggaatctaatttataatgtatgccttaaatgataaaaatatacaattgttgtactacataaataacattggtgagtatagtctctatctcctttctgtatcgccgtggttattcttatacgatgggttcatgaagtagagtttggaggggaggaagaaaaatagagcaagagtaagaaaagaaaacggtgcgaataaagacattgtcagtttgttaccaaaggtaagagaaaatctatgatatgataattttatatgatcaaaggagaaaccgtctaaaatattttagatacatgatggatgcagttggcatggacggcattctcggagtcttctcctatgactatctcccatcatgtggtttctagg

SEQ ID NO: 56071 - DNA, 1449 bp, Oryza sativa
ctactatacaagaatggtatggataaagcccgattgaaaataaaaatatgagagcatcaaagtatctcgttttcttaaaagggaataaaaagggggccataatataacagaggtatcaactctaatttgggtggatgaactccaaatttgattcatcccccccttttggaatctaatttataatgtatgccttaaatgataaaaatatacaattgttgtactacataaataacattggtgagtatagtctctatctcctttctgtatcgccgtggttattcttatacgatgggttcatgaagtagagtttggaggggaggaagaaaaatagagcaagagtaagaaaagaaaacggtgcgaataaagacattgtcagtttgttaccaaaggtaagagaaaatctatgatatgataattttatatgatcaaaggagaaaccgtctaaaatattttagatacatgatggatgcagttggcatggacggcattctcggagtcttctcctatgactatctcccatcatgtggtttctaggctctccatcaacacctgtagttgatagtgtggcgggtttacttgcgatgcaaagtttgccctacgtcccgatcaaaaggaggttgcgctacctaatacgttcttctctggtgagctactcacaattgcaatggtcttcttacttatttttggcggtggcttttcatggtgtggctgaatttctctctcatcatcgaggttgcctcaacctccaacttttggacgttctatctaagtttgcgtcttggtgtcttcttctatagctcgtaatggttttactatcctagcccatgttagtccaaccactattgttgtggccaaagtgaagccaagtagttagttgcttttatttttctttcattttttaagtatttctttgattgttttcatgatcaaactgtaatttatctatcttcaaagggcttctttgattatcttgttgtacaatcatatccaaatatccacttatagggcctaattcaaaggtgagacacgcctggcacacaaaacgagtaacactattaatgctatattaacttagtattaactgttataattttaatgatagggtttatttgaatttttaaagaaacgtttatatacaatttttttaaaaaataaaacacatcgtttaataatacatggagtagtaaacgagtagctagcccaataaacccaaatgagaaagtaggtgtgtctgagagtaggaaaaaggaagattgagaaatatgcaaaagcaacgtaagttattagtgtatgacaatttacgtattaattatttcaatattgtaaataaattcatatacactactacaatagggatttttctgtgcggatgaaatcgattttcgcgtgcggaggattcgaccgtctagaaggaatcgtctgcgaaaatgcgcgatttttcgtgcgggc

SEQ ID NO: 56072 - DNA, 1138 bp, Oryza sativa
ctgtttataagctaatgttgaaaagtaaactacgataaaaaaaccaaaaacatctcaaaacctttttattttaaattttaattttggttatagctaacaagctaacaagtatacatgtaaacaatgaaaggttaatgattctgtaattattttttagattattaaagatttatggaagttagccaattacactaagaaaatacaaccgtactaagtacacttttggtttttccctataattatattaccaactccgtttcaaaatacaagcatttctatcattctaaatactccatatgaaaaaaaaaacacttgtccatatacacactgtccatgcattaaaatagcacttgtctatacatatttttttggaagttttatatagtcagaaatttttatattctagaatgaaaaaaaaaacagaatgcatattaacataatgccacaacacaacgtctgccaatcatgaaacgaaacctgaagtgtgaaacagtgaaaccataacatcgcaatatttcccaatcatcacgaaacgagacctgaaagcgtgctccatgatggcgtaatcctgcatgccaagcggtttctgataatacttcctcctctcagaataaaatctcgtacaacagattacacattttactaagctggacacatatatattagtacatgattggtttattttggcacgaaataaagacttgtttagttcccaaataaaatttttcacgctgtcacatcaaatatttggacatatacatgaaatattaaatgtagaaaaaaaaccaattacacagtgcacctgaaaattacgagacaaatcttttaaacctaattgtgccatgatttaataatgtggtgctacagtaaatatttgctaataatagaataattaggcttaataaattcgtttcgcagttttctaacgaaatctgtaatttattttgttattagactcgtttaatacttcaaatatttatccgtatatctaatgtagtcatgcagtgataaattttttttccaactaaacatttgctaattaagtttacactagtactgctccactctacgcacatcgaaccatatttttccctcatcacgcagcttttgccatgtgctctcccctccactgtgcagg

SEQ ID NO: 56073 - DNA, 1501 bp, Oryza sativa
acaggagcccattgtaaatccaaaagttagtgattttgaaccaaatttcaaatcttgggtgctaagcttgtgaaaatttgaaaccaaaatattggttcagacaaaacatgtactttagcgaacgttgaggttttcttttaaatttcttttcgggagtagctatataacatgcgataattttttattaaaaaaatcaaatgtaactaaaataattaaagtataattatattgtaactactctacaacttatatgtagtaactggcctagatttatcacaaaatatatatgttgcggtggtagtggagggagcgaagttgagccccagcaaccatcccgcaccctgggtatattcggctactatatgcaaccatcatgctgcggcaactacaaatacaagacattgtgcctgttggctgcactacagtaaaaaaaaaaggtgcaactgaatagagctctagttttttttcttcatcttgctaacatgaatgttcatcaaacttaattaaacttaaataaatttgattttgatcaaaatcaaaacatcttataatacccctgtaaacacgttgtactcgtataaatgtagggatacgagggtaaactgccactggttgttttcaacttttcaacgattgaaattcaatctcgatcgagtaacttccacgcctgtccatttagcaaacctacggtacatacagcgaatgatgccgtacactcctactactatacaccacacatacatcactgacccacgtactagtatttattagctctactgccgtgcgttgatcaaattaaacgtcgtcgtaggcgttgaacacgaccaggcagggcagagaggcaaagggtacacgcagccacgagcgcacgcattcatgaatgcagcatatgcgatgcaaattaagcgacggtggcctagctaggcgggcggcgctgcagggtcagaccgattgacctccgttgatgccttcaattagtgtggttatagttgtcacatggtcaccacgactggatttttcatattttggtccttttaaaaaacttattttctcaaatagacctctagaaaaacttatcctaaaaatggtccttttggggcgccagagtggccggtgccgtcgtccaacaggacggcgccagcctctctggcgccgtccccctgctgacgtggcggggcgatgctgaggtggctagggagtgcgccagagtggctggcgcccccccggaaattttttatttttgttttatttgtttgatatttttttcacgcttagagaaccaaccatagaaaaattgaactcaaatggacgtaatatgtgacctgtagaatttttcctctcctctcctctctccgaactagtgcaaaggagagatgtacaacttttttatttttattttattttttgatatttttttcacacttaggaactcacaggaatcaaccatgtaaaaaataaactcaaacggacgaaatatgtggcatgtggaattttccaaagt

SEQ ID NO: 56074 - DNA, 498 bp, Oryza sativa
gtgacttgtagaattttccaaaactctaccgaaacggacaaaatatgtcatctattaaaataggcgtaactttctcatacggactcggaatcaggcaaataatatatgcacggacatctacagaaaatgttacatccgattctcccccgctttgccgggttcggcgatattaaaacctccaaattccgcttgcaagattgtgttttcgaggagagaagtttttcggtagaactttggaaaattccacatgccacatatttcgtccgtttgagtttattttttacatggttgattcctgtgagttcctaagtgtgaaaaaaatatcaaaaaataaaataaaaataaaaaagttgtacatctctcctttgcactagttcggagagaggagaggagaggaaaaattctacaggtcacatattacgtccatttgagttcaatttttctatggttggttctctaagcgtgaaaaaaatatcaaacaaataaaacaaaaataaa

SEQ ID NO: 56075 - DNA, 1501 bp, Oryza sativa
atacagagaagacaaccttaaggtcttcggagttcggcatttaccaggagatgcttccagtctcagctagagtgagtccaatgcagaagtctgaatccagaagccaacgagagggatcgatgtcgccatatcattgattacaggattccagtagaacaacggcacgaccagcattcaaaaggcagctctgaatctggttgcgatggcaacatgtcggtgatgatgccaatgtcctctgcattgaccaccagatgagcctggaatgtcaagttgtagaggtagaaagacctgttgctgacaatccgaattcaacagcacagcatattggagaaatagtacggtatgtgaacagaattgtcccactagagtggtctcaaaatggaacgaagtgatgattgccctatcaagaaaattgtattgtttgtaagggtacaaaatggggttgcattctagatgaaatcgacatcctccagacgatatgagggtaagagtgtgcatgaggaacgacaactgatacgcgcacaggagaaattcagagcaatagaattacaggtagcatcctaagtatcatggatcagtttttttttacaaaaagaatcatcctggcactatcagatgagactagcagaaaaaagacccacagcgaagtaatcgcccacttctttgaaaacagaggtacatacatgaaaaatggtggaaagcactgatgaatgccgttgaagttcatgaagggcatttgttcctgtctgtgcagatgtgacttgaatgaatcagttcatcagcttaatgatccatgccactggcatctattcagacttcatagaaactgcctaaagagcttctctccgaaatgggaatgcaggttgggagactggagcacttgttgtgatgccttctgatgcgaggtccgaacttcgacttctttcaccccgactcgggtgctgtacctcatcttccactgtaggagcttgtgcatccgtctttgatatcaatttggagtttgagacagcctcattcctactatttctgtctccacctcccatttcaatatcaatgccatcataattatgtcgttgtgagatcttcaagagatcaccacctatgtcaaggtcatcttccacttttgtccgagcaccaaccggctcttcttctctctccacagcacggttagctggtggagctcgcgcttcctcttgtataggttccctgaacttgtgtttggaaggtggaaccttagtatagaagacttctagaaagttattcatacatcctcgatcataggcatttggtctgccatctgctctgtaccggaaattttcatatgtggtctgaaaagccaaagcatccgtatcagagatcatgcaatgtaaaaatatttatgttcaggagaagaggcatctaaaaggggttgtttcaaatgcttggaatgcttgccctttgaatcgcagggtagaaaaaacggaggaatagaaaaacataggattctgacaggaattgaagt

SEQ ID NO: 56076 - DNA, 677 bp, Oryza sativa
gtatcagtacctatgtaaaccgagtaatccggtagtatttgcgtgtgtaaaactgtaaattgggtaattctcctctagtgtgaaaactagtcggatttcatatgtaattttgcacggagctagattatccaaaagtcaaattatatttgatgttttgtttctaattttctgtgaatacaagtatgttttgtatattagttgatatatagtataaatttataatctggatctgacgagccactatgaacatggttctttttgttcctttcaattatttataggttcttagtataattggtgcctcattttagctttttttaaaaagtcttttgtcgattacctcattatttacattcatattgcacatatcccatgcagctgtggtcatgtcacacataagtactcttattgtcgcttgtgctacaaccaaactttagatggtattagagtgcaccacaaacttttggtggtatacagctaaagtcgtgaaatttctatgacatggaaccactttttcccaactttgagtttgtcgattatcttcaactctcgaatactcttattgtcgcttgtgctacaaccaaactttacatggtattagagtgcatcacaaactttttggtggtatacggctaaagtcgtgaaatttctatgacatggaaccacttttttccagc

SEQ ID NO: 56077 - DNA, 1501 bp, Oryza sativa
tttttgtgttacaatttttccctaatggtttttctcagcaacggaacagaaaaagagaaggtatgtgagtgagaggtgcaaatggaccagtatttattggtgagttagtgtcacaaacctgtgcatgactgatgtagaatttgagccggttcatctcactggcgattctttctaagagaatgctttgtgtctccctaacatctgtcccatcatccatgtttggtggtgtggcaacgttgcctgagtagcccttatcaccagaaacagcctcaacatttgatgaatcagatggggcggatggtagttccttgatcagtttctcaacctggaggaacaacaggaaaatgtggatttcaggtgccttgacagtaacacctttaggtgatggtttatacaattgaatgatgttgcaaattgtgaaccaatggaaaccttgacaaaataatctgagaagaccatcagtcataagatagggcaatttttctaacatggtagaaaatagcactatgacaggtttaatcacgccaatttcttcatgtacatgcatcattgcatctacattcatggataaaataatactcagagttagcatatggatcatccgcatacagggacaaaaaaatgttcacagcaataatatgatgtactattgctgcattaaaatggaagtgctaaacctctccaatttcctagtttgaactagagtcaaacactataagctttcatatgattcatgaaaatgaacaggcgaacatcgatgggaaggggactggaagggcacagtttcagaaggttgatggttgacctccagacagatgtcacagatcccatataaagtcggatctaccaatgcagtgctgatggggaaatttagctaataggaataagctacattcgcgtttaaccaggagcggcggagtaggatcgaaccttagagacgacgtgggaggtgtcgagcagcagctcgagaagctcccgtgcagccgtggcagccgcgcgctgctcgagtccggagcggagtgcggcgagcccggcggctgctgcggcgcggaaggaggcgaccttgtccctgagctcggcgagcgggggccgcatgcgcgcggcggcggcatcgacgcccttgaggcgggcgctgaggccgacgaagtcggcgtagtcgcggttgatgaggccgacgagctcggcgcggagggaggcgaggtgggagcggagctcggcggcgaggctgtcgaggggcacgtaggagcggaggtcggcgacgtaggcgtccgggtcgaagtcggggcggaggaaggagtcgggcttgaaccacggcgggtgcgcctcgatgggctcgccgaagaggtccgtcggcggcggcgccgccacggcgagatccgccatggctctggctggatctgcggcgcgggtgggtgtggagatctggcgcttcctcctctactggggatgggtggagagtgaagaaaccgacgccgaggtgggctcgcgcgcgccgctttct

SEQ ID NO: 56078 - DNA, 1501 bp, Oryza sativa; identical to SEQ ID NO: 29776

SEQ ID NO: 56079 - DNA, 1501 bp, Oryza sativa; identical to SEQ ID NO: 37084

SEQ ID NO: 56080 - DNA, 1501 bp, Oryza sativa
attgatatacttggaactgggcgtcttggtgctggttcagatatcagtccacttgctttcgcttgagctacaactgcttgcagtgcatccattgccagaacgaataacagtggcgataaagggtctccctgccgcaatcccctagccggcttaaaagggtttgattcattcccgttgataaggatgctggtttcagccgtgaggaacagagataccaaccataatctccacttggcaccgaaacctctccacttcagcatatccaatagaaaacaccaagacactgtgtcaaaggctttggagatgtcgagtttgagtagaatcatttccttgtgttgcctgtggtattgctgaacgagccctttaacaaagatgaagttttcatgaatagatcgacctcttatgaatgcattctgtgtgtagggcacaagttcattcattcttggggctagcctctgtgccatgacctttgctgctaacttggcgaagctatgtatgaggcttataggcctatagtctttcagcagtgtaggggagtctttcttggggatcagagtgatcaccgctgtgtttaacatttcaaggagccatggtgggacacaaatgaggtaaaaggagaagagctgatatttcctgaggttgaaaagctgtttatcgaaagttgccctaggctaactgccttaccaaaagcgtcaaatgtgatttcagaatcgtctagcggagttagcaccgtgtgtcgttctgcatttccagcattgaaggaaatggaattagatgatttggatatctttcagaaatgggaggcagtcgatggaactctaaaggaggaggtagcatttcctcagcttgacaaattaacaatcaacgagtgcccagagctgactactctacctgaagcaccaaaactaagtgtcttaaacatacatgaaggcaatcaacaaatatccctacaggcagctagcagatatactacttcattgtccagtctccatctgcatttgtcaactgatggcacagaaacaacatcggtggccaagcaacaagattcgagtgaattggtgattgaggatgagaaatggaatcataaatctccccttgaacttatgaacttaaatgggtgcaaccttttattctctcacccaagtgcgctggctctctggacatgttttgttcagctcatagatctgaatattcggaaagtcgatgcgcttctctactggccagaaaaggtgttccagggcttggtttccttgaggaagttaggtacagtatttatcaatgcaagaatctgacaggacacacacaagctcgtgggcaatctacaccagcaccaagtgaactcctgccacgtttagagtccctacagataagctgttgtggttcttttgtagaagtccccaacctacctgcgtctctcaagctattagacattagggggtgccgtggcctggagtccatcatattcaatcagcagcaggataggacgatgttggtgaatgca

SEQ ID NO: 56081 - DNA, 1501 bp, Oryza sativa
ctctcaactaaaaaaatgtgtaaacttcaaaaaatcataactattttattttaaatccgttttgagtgaacaaaattttgtccaaaccaatgaataatgctctttgtattaaaaatattgttggaaactgtatgtttcatgcttatattgaaaatttatttgtgatggtgatggctaaaattgcatataatgcaaaaaagaatcaattttcatatgttgtatccagtagctatattagtattaaaatacctatcattggttgtataccaactctcaagggcaaatgcgtctttttactatgaagttaacggtcaactgacggtggagtgacggcaatggcataaaagggataacaaacttgaactggtggcatagaagagagaagccaatttgaagtggcatataagggaaccggttaatttagagtggtatataagggattctctctattaataatttggccttctatctctagagaatattattcttttgttgcattaaggagcatatccagaattaaattagaggggaactcttatttttctttctacccttcctactcttcctcttctcccgcttcttctaccctcccttcctccttaattaaatggtgatctagcgggataggaggactcgagttcccttagcatctacgctggatttattttaaatatttactcatatatggattattgctcgatacttttttgctttttctgtgtgtgtttgaatcgtctcaaccatcgcaacagcttttatatatatatatatatatatatatatctacgctccatgcatgcatatatatcaagcagttggtttaaacttaatgaggacgaagatagctgctagctggtgccatatgatcgatcgatccattacatagagctaggcagcagcgcagctagctagcctcaactaatttgtctttcatgtattttgtctgttggctcccaaacaaatatatgtcagatataataagttaactatacatatataaaatgtactgcatgctacagcgtagatcgatcttggaattagagattgttaattaatctggcgtaccgatggatggttttggcagtacgcatgtcaaccacgcaattaacatcctaatctagaatcagcgaacacgatcgagctagaagacgacacacagctagctagtacgtcttcatgcatctctctctctctctctctctctccttgatcatgcatgctgatgctgctggctctggctctctcttccatagaactattacagccagagccaggccacatcatgttgatgcatgtggtccagcaatcaagacaaaacagcatgagatagatagataactagctacccaccaaatcgctcttcttctcttacgcaaagattgcattgtaccttccatcctacccgtacatatatagtatattattgagtgagactacgtagtggtataccgtttcaatagaataacgtatgatgtcagcacgataccaaataggtatcaga

SEQ ID NO: 56082 - DNA, 1501 bp, Oryza sativa
tgctcaaactaatttttccatttaatcttggcccaagaccatttaaatactatcctcgagcgaaccaaagcatcaacggaatgacggaatgaataagtacatttggactcccacaaatatacgtgcaatttaattcgtatccctcaattgcaataccatatatattgaattcttaactattaaaaccggtacattttgactcccttaatggttttgacttttgagggatacaaattagatgcaagtataattagggacttaaagtggacttattcctcaacagaatagcccaacgtgtacaactgatgggctaaattagcagccgaacgtcatgcccacgtactcctcagcccaatctcttaccgggtccttcgttctcacctgcgccacccgctagctcactaaacgggtccaggcgaaaccctagacctccatttccccaaattctgcgcgccaaaagccacaagccctcgaacaccttcccgcccaatccaaccagtacacaaatccagaatagatctccccctttccgccgcaagagaaagcatcgggacattgccttgtgtcactgcgtgtgttagggaaggggagggagagcgagaggcgaagccatggatgagggatccgcggatgcgggcgcctccggccgccgctcgcgcgcccggggctccgaggcggtggcgcggtccgcggcgctcgagcgcctccgcgcgatccgcgatgggggcgcccgcgccgccgccgccgtccaggtgaggattgaggccccgatctacgacaccgtcgccgaggaggactacgccgcgctcgtcgcccgccgccggaaggacgcgggggccttcatcgtcgacgacgacggcctgggctacgccgacgacgggcgggaggaggactggacccaccgcaccatccactcctcctccgacgagggctccgacggcgaggatggcgccccccggaagcggaagcagccgcgtccgcagtcgaagcgcccgcctcagcagtccgccgccgcggcgtccctctctgccgccgccgccatgatggggaagcaacgactctcttccatgttcacctcctccgtgtttaggaagcctggcagcgaccgcggtagggactcgtcgctggcggccgacagcatcgtggatgacgtcatcgcggagttcgctcccgacgacaatgaccgcgaggagcggcgccgccgcgttggtagggtttgtgccccggcgccagcgccaacaacaactgctcacatcaaggctgaaaatgtggcagtcgatacggcaatggcgttcagatcggataatgttttcgaggcccatgaggtttcagatcatggaaatgatatggatatggaattgaagccagacgtggaaatggagcccaaattggacacacctcttggtgctagtgctgaattggcgaataatagtaacagcctggaggaaccgaaacaggaggctaatggggaggttaagatagagaaggtgcatcgtctgaa

SEQ ID NO: 56083 - DNA, 1501 bp, Oryza sativa
catggcggcggcggcagagagggacgccgcggcggcggactgctgaggcgggcgcttcgactgcggacgcggctgcttccgcttccggggggcgccatcctcgccgtcggagccctcgtcggaggaggagtggatggtgcggtgggtccagtcctcctcccgcccgtcgtcggcgtagcccaggccgtcgtcgtcgacgatgaaggcccccgcgtccttccggcggcgggcgacgagcgcggcgtagtcctcctcggcgacggtgtcgtagatcggggcctcaatcctcacctggacggcggcggcggcgcgggcgcccccatcgcggatcgcgcggaggcgctcgagcgccgcggaccgcgccaccgcctcggagccccgggcgcgcgagcggcggccggaggcgcccgcatccgcggatccctcatccatggcttcgcctctcgctctccctccccttccctaacacacgcagtgacacaaggcaatgtcccgatgctttctcttgcggcggaaagggggagatctattctggatttgtgtactggttggattgggcgggaaggtgttcgagggcttgtggcttttggcgcgcagaatttggggaaatggaggtctagggtttcgcctggacccgtttagtgagctagcgggtggcgcaggtgagaacgaaggacccggtaagagattgggctgaggagtacgtgggcatgacgttcggctgctaatttagcccatcagttgtacacgttgggctattctgttgaggaataagtccactttaagtccctaattatacttgcatctaatttgtatccctcaaaagtcaaaaccattaagggagtcaaaatgtaccggttttaatagttaagaattcaatatatatggtattgcaattgagggatacgaattaaattgcacgtatatttgtgggagtccaaatgtacttattcattccgtcattccgttgatgctttggttcgctcgaggatagtatttaaatggtcttgggccaagattaaatggaaaaattagtttgagcaaattgcaattttctgttgttgacagacaataggggcttacatattttgcaattttctgttcttgacagacaagagggcttacatattctatatgatcgttcaacaacatatttttttttccgaaaaaacattggttatattttcaattttgttttctcgttctctgtcgtttgttgatggcttaccttctatagttggaaaccctggaatgccaccatattggaaagtcaacttcaaatacacttatcaaaactttcgtggatatgctgttcattacacaatgacttgtgatgttttaattactatgaacgtaccgagtctgtacagtgagcacaaatagaaaatcaaacgtggcctcgctgtttggccccgggaaaacattctagcccccgtttagtttgacatattcgtcgcattatcatttggcaatctccgtagagaatccatatgagaacaaa

SEQ ID NO: 56084 - DNA, 855 bp, Oryza sativa
accttttccttttcctgctgtgtgatttcattcatcttttttgtggtggtataatagttccattgccattgtaagttaactatgcaaatgtcagttattgggtctacacggtaattggagaaatgggtaaaattgatctaaacatgcatggctcgtcttagtgcatgagcatttacacacttgaattgcggtatagcacaaaggattgggttacataaaacactttacacaaggagagatacaatatgcacgcacttgcagcatgcaataacaacttggcacattcagttaacattaaaaaaaaaaacttgacacattcatctggacttggcctgcatagctagaacccagaacgaaattgagtgaacttcagaagcctaggtttctggaaagctggttggtactttcgtgtacaacattataagtgcatctctaccaatctgtttcatcctttaaaatgaaataacaaattattcttccactattgcatatatagcttggtagtttcaaaagggggttttcaatttattctataagaaactgctcttgttgtttacggtgtacaaaactggcagaatcaacaatgtgatgtaggcatgtagcactagtaagatgcatggctgttggaactgtagtgagccgttgctttcaaggttttatccaacttatggtgatacttgtcctgaatcctcaatagttctttcaagagagttcgtgggaagggttcagctgattctcaaaacaaaaggcaagagatgttgcttcctggctcttctattgtctggtgagaaatattatgtatcatttatttaggaactttgcctaacgtgcaacacagggtactcacatctcagc

SEQ ID NO: 56085 - DNA, 174 bp, Oryza sativa
tagtatattttgtgagagagctccacccaactccactctcagttttggtgaagctgaaactgtttggctgagctccagctccagctccagcagaggtgaagttagagttggagctgtgccaaacagacccttagatgagccatatgattaattctgcatgggcgtttaattagg

SEQ ID NO: 56086 - DNA, 1501 bp, Oryza sativa
ccacaacacggagttttggtccggtccaggcacgacacgactcgactgttgtcgggcctgtgctagcctgactcaaccgttgggtgttggctgggcctcttccttggcacgacgtgccagcccgacacggccaacactcccgcatgccatagcccgtcgatggctggcccaaagagatgagggaggcaaaatagacttattttagccatataagacacaatccaaagatatgagggagacaaaatagacttatttcaaggatgagcacagtaagctagtcatgccttcgggccggcacggcacgtcctgagtcttattgggccgtgcctaggccataggtacagcccgtgggtggacaaggcacgacacggcgtatcagtcgggccgtgcttcggtcgtgtcagaccgaaccatgtctggtgatctatttgactatagttagctctaattaagcctcaaagtctcgaactttctttcttcacagaatcacaatgctcccctctctaacccgctatctaggtagaatcctaatatgtccaaatcggaatcgggcggtcgtcgaacgaacgcataggggccggcttggcgcattagcccatctttctcatgaaattgaccacagaggcaacacgtaggccagcgcacgtacacaagttccaaattatgtccctgccaccacttaatacgcagtggattattatatactccctccgtttcaaaatattttttttgttttctgtactttatcctttttttttacagtttttgtctcctctattcaatgaaattgacggcctcattgattcgttcaaaaaaaatgtttgacaccgttgactttttagtacatgtttgatcgtttatcttatttaaaaaaaattgtgaaatatgtaaaactatatgtgtacatgaaagtatatttaacaatgaatcaaatgatatgaaacgaataaataattacttaaattttttgaataaaatgaatggtcatacacgtactaaaaagtcaacggtgtcaaacattttaaaacggagggaatagtatgtaattgtaaatacagatggaagggtgggtgtgcatacatggcaagtagctagggaggcttgcacatggtgggcaagagatcgaaaagaaacactgacaattcataaggcccctagctagctatcaatgtgaagtactcactccatccgaaaaatacgaatctagaactgaatgttatgcatcttaataccatataaatctggatatattatatccggatttgtgtcacacatcagtactagattgattttttataagacgaagagagcagtagtatacgtttagctagtagcctctctagctcagcatacgtacatcgatccatccatccattatgtgctagctccaaacataagatcgcccatggtattaattaatatgttggttgctagtattagctaactcttgtccgatatattgtttctcgactcttgttgcggggacaataattagcaggca

SEQ ID NO: 56087 - DNA, 1501 bp, Oryza sativa
ctaacagtcaactaatgctgcagtgctgaggatggcataaaagggtagaaaaacttaaccagtgatatataagggagaagccaattttaattggcgtgtaagggaactggtcaatttctagtagcatataagagattctctcttattaatatgacagttctcagcttgtgtatggcctctcaaaggccatgcttttatatattttcaccctatcaaaactcttttcatattagactacctcagtttatggtcaattatatagatcctattcgaagccaaccctcaatccatttttttcgcaaatttgtgtgaagctggatttaaaatatataattcttgaattaaatataaacaactctcttatttctattagcctgttataatttatatacaactatatctattaatttataatctagaccaaccacaatctaggaatgtaaatctttctgtttttcttattaatgtagtaataatttctaggtttttgtgaacgcgcaataatttctaggtctctctagagtaacatgaccttattgcggagttgtttgtccagtcatcaatctggtggtggcacaggcgctggggtgttttgtagtttctacttgagtaaattgcataaacgtgaatttcacgttttaaaaatcaaacatgtgaagtggttgtctaaatctcgacatagcgtcatgtcgcagtacaacaacacttctgcaacgccagccaaagaaaaaaaaacttgcatttagataacccttgcatgtccaagataaaattggcccaagtgaaaaactcagaactacataaataattttcgcaaatggccaaaactcatttttggatgtggtattttgacgtgtgggcatcacaggtgcacgtgaaaacccattttcacatatggatctgttgaggaggctgcttgcaaaactgatttttgcaggcaggcaagtaaggactttcgactagaacgatttttttttttaaaaaaaagaataaacactacagatccaagaccctatagctagggtaagccgcatgtggccgcggccgtgtggtccgttggctgggtacaaagagcagagtgggctaagcaaataccgggttgtggcaccatccctttcacattcactcgctcttgatatctttctctctcatggaaaagaagagataagtaattttaattgatgccgggatagagagagagagagagttaagaaggtagctaggggagagagcgaggttgatgccgtgatcgatcgatcgatctgttggcgcagcgtgtatataagggcgggaaggggagtgagagagagcagcagctagctagccgcggtcggtcgatccagctgctggggatgagtacttagttagctcggagctagctactaatggatgatatacttatgctagttagttaaatacagttattagttagttgtaggttgcatctatcatatctccatcggttaattaattgattgatagctagattatcaacaattaa

SEQ ID NO: 56088 - DNA, 1501 bp, Oryza sativa
aagaacatgggaagggatgggcatcggcatggccggattagatatagtatcaccattttaagatgatcagtatacatgactagtcgtatatactacactatgcatatgccatgctacatgtatgctgctacctccgtcccaaaatgtaagcatttttagctatgaatcattttaggacggagggagtagctagctaggaaacgatcgatcggcatttcagctatactacagtacttacatcagatcgtttcctagctatcagatcagggtcgggtcgatcagagtgatgaaaatcaatcgatatatattgatcgaggccgcttgctgtcgcctatcgacctactagtataacaacgacattttctctaaaaaaaaaaagaaaaacaacaagtacctagaaacactccacttagacacaacggcttggctatttcttaggcaaatctcaatcatctgatcgcgttcgttggatttcaatccaatgcgcttctctccatgtatatattcaacctctgcatgctcttaatctctccactcaactaaactctcagttaattactaattatcctcttctccaccaacagagtacgtttaccacaatactcctcgaaacagactttcagccccatcgttttccttgtacttatacttatccattagtactacttgttaacaaccaaaaaaaaagtcacgagtaaaacttttatgtgtgtgtatccttagcgatttaaaagcaaatgcggtagaataaattatgatgaaaaaaactaaaaaagtaagttttgaaattaaattttggcatataggcattagcataagtgaaacgatagggttgtttgttcttttttttggggaaaaggatttcatcattcatgaaccttagagcataaccaacatatgcccagtagggctttctaatcttaaaattttggttttctttaaagctggttccaattgaaccacttgcattatatccatcagcattcattttggtgcatccttggttaggacagcttcatcttttgtccattttgtcatttatcatcacgtgaattattgcatatagctagacagttctagtatcacccggaaagattgaccattgaagacacacttccatcctcatttgtggccataagttcagcttctagagcatatgaacagacctctagtgatctataggcagctcatatgaccggccattactatcccaaataaccatttgcattacaacattcagttaatttgttccatcctatgttaggatagcttcgtcttttcatgccaagatccttcttcgatcagcttcccacttatcaaatgcaaatcttctccatgatagtagttgactactttcttaattagcgtgtttacatatccgtcactaagatgttttgcacaactagccaacatatacttacatgtgcataatgcacacacatgtactagtataatatcatagaagatagactcattttacgtccttcgttataagttatta

SEQ ID NO: 56089 - DNA, 1501 bp, Oryza sativa
atttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattgtaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtcaactcatagaatcacccattagctgtcacgaactgtcggagaggtgtagtaggaaggaagaattgattgaggaagacgtggagggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagctaatgtggaggagaatgtgccggtaagagaggaaggagatgttgaggatggtcgggaggtaggagatgatgtggagttacctgaggaagaagcgaatgctaagaatgtaagtatgggcctaagggagttggctaggctgaaattctataccccagaggagtgtgaggaggctatgatacgcagtggattgaacccagcctggttggagtatgatacagaggatgaattggatgagtccgctttcgactcctatgatgatcgtccagtgcgtaagatgtcagagcatgaaaggactgtgtttgcgaaactggtgggtagaaacccggaaataacacaattcgaggatcttaccagatctgggctagcaattgctgatggggatacacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcag

SEQ ID NO: 56090 - DNA, 1501 bp, Oryza sativa
actaatggtcatccgtactcattgaatatgatgaagttgtactgggctaaattggaaaatttaattataccaagccaattcaataatcataagaatgagtggtccatgaaactaaataagaaaagtagaacataaggtgcgtagtctcttagctatttatctgataaaagaaaaacaacacagagaggactagagcgtggaagtaccatagttcaaataggcttgagccaacatatgtccaagctggacttgcgcttgggtgctaaggtgcagatggccatcttctagtggcaaaccctttgcatcaacaaatctcacgtttcgaagtttgatccctttctgagcttcccttactacttcagtatattgcccaagccctgatgctagtcctacctgaaacaccaaacagaggaatggggattgcctactgtattatgtgatatagcagcgaagagtctaatttacaagcgatttgacgaataccacaaatagttttgtcttgcattgcctgggtggtttgaatgaggagaagaatatgcaatggtccatagtaagatgacagtagttgtgcatgtagaccttggacatatatatgcctattctatacagatatatatagggattgtgtgcatatcatgcatgattgagctgaggtggcggtgggttggcaacatataatgcataccatcatctcagactttgaaaaccaacaaatctaaagtaagatggaatgccttaaactacaatggaatttattttggcatgtctacctgacggaatgtgatggtatgttattacattaggagaagaccagaacagaccagaccagaggaaatagtagcttggaatataagtatgttggagtagtatagctgaaatcttgatgcagacgctattaacaactctctattccgtatggccaccctccaccttcctttattattacattttgttttctaattggaaaaaagagtagatgtagatgtagcaacaacagaagaagaggaaggaacagcaagcatgcccaagtgacaagtaaagctaacaaatctagggcaggcattgcatagaaggtcagcgtgtattggattggagagatatggattgataggagaaaaagaagagaataataataagggataatacctggatgaggagaaggtgtggcatggcgagatcggcgcgcaggttgcggacgagcatggccatccggcgggcgtactcgttggcgtcggcccagcgcacggtgtcgctctccccctggtaccagaggacagcgccgatgcggccgccggtctcgagggcgaccctggagcggcggacgagatcggagtagaggtcggtgcccttggcccagtcggccatcctggtgccgccgacggcgcaggggacgaggccgatgacagggaactggccggagcgaaggagggcgttagcgaaggacatcccgggaccgacgccgcaggtgcggttggagtcgatgccgttgtggagcggctcg

SEQ ID NO: 56091 - DNA, 315 bp, Oryza sativa
gatttttaaggacaatataattgtttcaccgggactcatgcttgttctgactgtgagcctaatgttacctttacatgcccttacattgtctattttttatcgttttatgagatcttccaaacaacttgatctgtcttaatgtttttttgctagctcctttcttggatatctggtaaatggttaggccgaagtatgaactttgccttattgtttcaaagaaaatgtaacaactcctggaaaagtctaattttggttgccctttattttgctgaccgtattggcacacatctaattctgctgttcctttctggcagg

SEQ ID NO: 56092 - DNA, 222 bp, Oryza sativa
tattgtttctgcagaggaggcgctcttcggttgctagagaacagagtgcatcagctggtgatgaagatgatattgctgatctgatggaaaaccatcaagaattcattcatgcagtgaagtctcggctaacaaaactagaggttataacgagtatggtcatctatagcatctgctattttgagatacctcgagtaacggtaatctcaatgtgttatgtgtagg

SEQ ID NO: 56093 - DNA, 1501 bp, Oryza sativa
ttaaaaatcgattgaaaattttattcgaatgtacttttttttctcaaggttcaataaaactgcactaattcttataaaactatgcaaaatttatattacctctgtatttaaaataatatcattttaaaaatcaacacatactccattgcatatgttttatcattgttttcccgaactatatgtctataaaaattaaaatacagctatataggagagttttcataaaaatctattaaaaagatatttacaatttaataatttaagatgtcaaaatttgaggaagtcatttttttaacaaacataatactttttttaataacacgaaaacaaatgcatgggctataaaataagcacgccaataagcgtgctcaattttctaccaagacttgaattccaagctctaataacaccggtttgaactgcttttgcatgaagcgagggtaaaaacgtaaaaatttacaataaaggtatgacccaataaattgatatgggcttaggtttataccctaggtgtttcaaatggtatcatagcatggttatatgcgtgtgactaatttatatcctaggcgttggtggcattaattgtatctagtatggtatggttacacgtgtgtgactattttaagccttagactttggtatgtcacaatggtaggtgttacaaatagtatcagacccacgattataagtgcatataagttagtatgtcacagtttgtatcgcttatagcctgctgggatgtcacaatcatgggtaactttggttacccaaaaatacgtatgaaaggaaaatcctctggctgagctgttcgggagaggaaacaaaaacttttccagcactgtgcagaagtgaaagctttctttctcataaaaaagttagcatgaacactgaataatacatggaaatttcagatccaaatctcaatctgaagctacaaaactggataaaccaatagtcaattcagattcagacatcatttttcaaaacaaattagagcagaatatcgaataggaacaggaaaattcagattgaggagaagatttatgagaataatctatatggcacctacaaaaataggaacctgtagttgcattagaagaagatttgcacccaaaaaaatggaaccaagtgatggagacacaatgcaactgcaagaggatgctagcaactcagaaggagatcggagaagagagaagtgtctctgatgagctccaagacgatgcggttcctcatcactgacgggttataaacaaaggccgtcacaggtgacctcatctgtgctacttcaacccgtcataggtgagttatctgtgacgggcatcaaggtagatacgtcatagaatgggtacacgggatgtcacctttagacccgtcacaggcgtctcacctctaatgggttgtaaccacccctaggcttgcggagaccctcacctctgatggccggaaaatactggcccgtcagatgtgactatcacctctgataggctgtccccgtcaaaga

SEQ ID NO: 56094 - DNA, 441 bp, Oryza sativa
tcactaaatagacaattgagatatgattcttattacctggaaaacacattcttatcatagtcacggaatacagttcatcttatcatcgaacatttattggagcagagagaaaataattctttctactcgattcagtggaacagaaagaggaaatttgaaaaaacgaagtgaaattaaaagatcacatcgaaatatattaattaaaataggaacacacaccgatcaccttctactggtgtcgtgtcacactgtcactttgctacatctctacctagtgcacattagcaccacatataccaagtcaaacatatatccgtcacttaagcaatcccgttgagagatatcatgtcagctcgaagtagttcagagattaacctttcacccagcggctcgaaattgtcaagtgaaccagttaataactatgcacccgtcaacaacagt

SEQ ID NO: 56095 - DNA, 1501 bp, Oryza sativa
aataacacgcaataagtattttttcttctaatagataagtccatttgatgtatatgagcaataagtatttgatgtatttgccccctccgatctcaagctgcataggcctcggccagcatacatgtatacgatcatggataagtccatttgatccctaaactctttgctttgtcgaaaacacatgaagacacatctcgactctaaaattgggtatttgacaccatctaactttcaatactggtaacacccaaacttatgggctttcctcgaagagggaaatgctacagtttctgtcttttatctctcgagttctaactactctatgattgagaacttcctcttctgcttccgtttctgccatagtagtgtcggtggcgactgatactgagtaagagaaagtaggaatagaaagaagaggtggatgccggagatacgggcccgggggtatgtgaggtaaagaggagtcaccttcctgtccagccacgtggcactgcaagctggccccactcacgcacctcgtgggtcgcgaaagcggcgggggaggggggggcgtcggggggccgcatccccccctcgggctgtcccgctgcttcgccccgaggccctcgcgcagctgccgcgtgggggggggagagagcgagagggggacccaggctggacaaccataaatgcgcggcgcgccaactgtccctcagtatgtgtagcgcggggagggcagacgtgcgggacgcctaactgacccctatgaatcggatgtgaccagtctgtgactggcctgttgccggtcacgtccgattgaacgggcggccgtgctcccacgtcacctttgtatccggcggagtgggggtaagtgtgacccgtcacatcggagcatcactcgaagaaaggctgccacaagtcttcacttatttatgagcgaatgacagggctgtcccccgtgtcaggcgggggacgacgccgggtcccactcaaggaccggttgctgcatagctttcgggagaaggcatggatcgagactcggtcaaagtggagtggggtccccctcccattggggggagtaggtagaggcggcgcatgtggtatccccttgagctataaaaggaggaccttgcccaccgagataaggggacgactcttagaaaacctgaactctaggagaaggaaggcgatagcgctctccggagtagaggaacccttgtaaaactcatacataatcccaaacgcaggagtagggtgttacgctccatagcagcccgaacctgtataatccgattgtgcgcaagctagccggcagtttcagggcgaacgcgtgattcccaagaggcgagcttctgcccccggccgaactcacgaaaggggggtctcacgactccccgctatcgagggtcttccctcgacagctggcgcgccaggtagggggcagttgcgcgtttcgagaagaagtcgttttcttccgccccaagtttctctgggccctagacgatcatggtcgaggtcctgg

SEQ ID NO: 56096 - DNA, 1501 bp, Oryza sativa
atcccattagacatacatggaaatcaacattgctacaaaatttaatggtgactcctgaaagaaactaataacacagggaagggatgatatgaacaagaggataccctaatggtcaataacaaattaatgattttcctaaagacttaatgaatgatttacagagtaggaaagtatgtgaaaatttacaaaatggtaacgtaaagcagttatgactgcataaaaatacattgcatactagaatccacactgatctagtgttgtagtttcacttatttcccatttccctttcttttaaaatgtgaaaatgcaacaacttcattgtccattctgagaaattaagatcagaaagagatttaaacttggccagaaagagttgcatatatgtacactattcacataacattcataaacagagtaggaatacctattgacctgaataagtcgggacaggataaacaagaaagagaacacaaaaaccatgaaaactatacatgaagaggacaacatatcatcattttgtaatgaaattctgacctagagttactccccatttttgatgctcgataagaaataatagcagacttaatggtcacaagcaagaatagatccaataaactctacaaccctgacagaaattgcctctgaattggctgtcggatcagttgtatccacaacaatccttggcacatccccaaattcataatctgtgcaaccttggtacccatcccgaagcctttccagctcggtccacgtcttcggcttatgccacccatcaccaccatcttctggcactgcagcccctcgcttctccagccttcggcgccattcctcttcattgcctggctggcattccacaacgataacaagggcacccgggaggcgggtgagcgcgtcaaggtgagcgcggcgtgacagcggggaatccacaacaacggacaagccgagctggacctgcctctctgccatccgccacaacacggcataggagagctcattgagcatgccgacagcaaggccgtcgacgcgctcaagtggcagcgtgcagtcccggacatcgtccttgtccaggagtgggcagcagagcgcggtggcgatggcgcgcgccaccgtggacttgccagaccccggatgacccttcatggccactaccaccgccggcttttttgcttcttcctcagccatcactgccctcttctcaaagcaataatcccgaaattcccaattcacaacaccctctctccggttgctaataatacaccggaaagaaatggtttcttggctggctaccaccactacactagccaccaatccaagcaacgttatcctactcccaaatttagacggcaacccaagaacacattaagctaaaatctacacggcccagaagcatccaggggggacggataccgacaggacgatgagcaaagggacaaaatgaaccgaagcaagattgcgacaggcttagataagctcgtgagggtgtgggatctggcataatccg

SEQ ID NO: 56097 - DNA, 1501 bp, Oryza sativa
taacaccctactcctgtgtttgggattatgtatgagttttacaagggttcctctactccggagagtgctatcgccttccttctcctagagttcaggttttctaagagtcgtccccttgtctcggtgggcaaggtcctccttttatagctcaaggggataccacatgcgccgcctctacctactccccccccatgggagggggaccccactccactttgactgggtctcgatccatgccttctcccagaagctaagcagcaatcggtccttgagtgggacctggcgtcgttccccgcctgacacgggagacatccctgtcatttgctcataaatgagtgaacacttgtggcaacccttcttcgagtgatgctccgatgtgacaggtcacacctacccccactccgccggatacagaggcgacgtgggagcacggccgcccgttcaatcggacgtgaccggcaacaggccggtcacagactggtcacatccgattgataggggtcagttaggcgcgttgcacatctgccctcaccgcattacacgcagtgagggacagttgggacgccgcgtatttatggttgtccagcctgggtccccctctcgctctctccccccaccacgcggcagctgggcgagggcctcggggcgaagcagtgggagagcccgagggggggatgccgcaccccgaggcccccccctggcgctttcgcgacccgcgaggtgcgtgagtggggccagcttgcagtgccacgtggctggacgggaaggtgactcccctttacttcacatacccccgggcccatatctctgacagaagcccccggcaccatatcagacattggcttcctgagatcagtctgacatggtgcctcacgacttctcaagctggggttgtgggcccggcggggaatcgaaaggaatattgccgagcggccaggttggcgtgccaaccatagcagcggtttgaccgccaccgaccacgctaatgatgaggatgcttgaggcgcgataaccggggggtcggtcagaccacgcctcgattccctcgcccgctactcctgcggcggttgtggtgactgttcgctcagcttgcgctcatagccgttgcgcactccacctcgagtgtgccactgacaggcgcactaaaggcgggacgcggatacaacgggtcacgtgatgagtgggcgtgggaaacgaagagacaactgcgggcgcgaggatcgtgggggcaattatgagggcgtgaaacgaggaggtgagcgcggatgaggcaaggataaaagggggacggaggcagggactttgcctccttcctttcgccaaccgcccgctcgtcctttcgctcctcgaaccctaacattctcgccacttcacactgttccgcgcgccacgctcttcgccactgctccgccggccaccatggctcaagacgctggcgacacagtgctccctttttcccgcattacggcagacaggcaccttagcctcccccgcaagatca

SEQ ID NO: 56098 - DNA, 1501 bp, Oryza sativa
gtagcggttgtggcggccttggcggtgagattagcggcaggaggcagtgcggtgcagcggggttagcggtgacagtgcggccggattagcggcgggaggcagcacaatagcaattgctaatcgagaccacattttctatacatgcaaggagaagaatgagagggaataacgatttgaggattttttttgggggattctggtgtcactatatagctacaaggagatatatgtgacgtgttgtgatgtggaaggggctgagagcaaaagtgttgcctatgtggtatgccacgttggcggtcaaacgcagtcaaaggacgtttgaactggagtggtacattaaactaagttcacggacctaaacgtataattttcaagttcacggacctaagtgacatcaccacacaagtttagggacaagtaatgtatttcactcaacataaaatctgcataaaagttagctaagctggttatcttaattcataaccaaacacatccttattctgctgtgcttatttagtcacatgtattttacatagcagttcgccgggtcagccgaaggaggccaaccaaatttcattaaggggagtatatacacatttacaggtttagaagaactgatcgaaagtgatcaattccaagggttgcgaccaagatcgcatcctggggggaactacttctaactgtcgaggcagcaaagcactgaaaagattatgctatatctcgcttatcgctaaacactcctgcttccctccagattgtgatctcttcacgattttacataacagtagtgttattgtgtattattgtcgtcagttagcgtaattattcaatgcagaggagtttagtttatgatggatagaattagttagatgctcttgcatgtagttctgcatattattattagagcgagtttaataaagcggacgactgcgggcggtaaaaaagaccacatcagcgatagagataactagaagatggtgtctgtatagctgctggctatatgcacaagcaccaatgaattgattattatttttttacgccttatcctactgttcccgcgcattgcctcacatgcaaccatgggataagttttttttccgctgtttcccttgtcttggagttcgtgtgtagtcagcgacaatttagtcgtccgctggcactctctcctagttttttccatccagctcatcacttttgctaggttggatgtgctatcgctggcttaaaccgtttattgtacccgctgctcttagctacaattctctccttggttgtggacatagctatggagctttgtggtttgagtgttcaggtcattcagtggctatcagcctcatgaaattttcaggtggacaacaaaaacagaaaaaaaaaacaaaaccaaaattaaaaaaaggggggaaaaatcgcaggaggaaaaaaaatggcatatgagccacacaaaatagtagaggcccataaagcccacagctttgtgcaggcgaagcgtccctgaactctg

SEQ ID NO: 56099 - DNA, 1501 bp, Oryza sativa
tcgattcattcctgtgaagaccagctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagactgatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtaacctggaattcgcagtggacgattttgtgtatcttcgggtcacgccattgcggggtgtacacaggtttcagacaaaagggaagctcgcacctcggtatgtgggtcctttccgtatcgttgcccgacacggagaagtcgcttaccaattggagctgcccgcctccttgggcaacgtgcatgatgtgttccatgtgtcgcaactcaagaaatgctttcgagtgccatccgagcaggccgactcagagcaaattgaagttcgcgaagacttgacctacgtggagaggccagtgaaaatcctggacaccatggagcgcaggaccaggaaccggataatccgtttttgcaaggtccagtggagcaaccacgccgaagaagaagctacctgggagcgtgaagacgagctgaaggcagcccatcctgatctcttcgccagttcttccgaatctcggggttgagattccgtttaagggggggtaggtttgtcgcgtcccaaaacgactctaaaatacatcatcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttagaaaggttttataaaaagaaaaaaaaaccctaaaaagtcctttttcccccttcccctcttgggccggctcggcccacctccctccctctctctcctctcccccgtggcccaatcggcctcctccccgcgcgcgtgccgctgacggacgggcccgcccgccaccctcgctgacgggtggggcccacccgtcatcccctacctcccgccgctcccgccgcctcgcccgtgccctagcgccgccgccgccgcgaatcccgccgcctcccgccgtccccgcgc

SEQ ID NO: 56100 - DNA, 1501 bp, Oryza sativa
tccctctctctctctcgcgttcaaacgggcggatttgcccccgcaaatctcgccggcgccattgatggagcccgagagcgccgcgccggtttccttctcccccggccgccctctctcactcccaacactatataaacgctccccgtgcctccctccaccgtttccgccactcgccgctctctctctccgccggaatcgagctcgcgccatcgctctctctctccgccgtcaccgccgagctccggtccgccgccgtcgtcgcctcggaccttctcccgcctcggcgtcgcctccttcggctccgccgcgtcctcgccgacctcgtccacccctccgtttcgcccgccgaccgccggaacgccgccgtccccgtcgacccgtgccgcgccgccgccttcttctgctccggtcgccgttcccgtcgtcgtcgtcgacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcctgcgccctcgggtgcggctgacgcgtgggacccacggcgccggccggcgtaagccgcgtgctcccggtccaccgtggaccgagaggctgccgcgtgggccccactcccatggacccggtccgtgcgctcctctctcccggctgacgcaataaatatgtttttaaattaaaatttaaatgaagaaattcgtaaatatccatttaaagagcatataaacttcaaatggccataacttggccatttaaactcggaattggaccgttaaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgttatcaccgttttatttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggtgggtttttttcaactctagactttgggaatattcatatcacctggacaccatggaatggtttggttattgtggaattggcttcacaccgctccttctattcaaaatccccaaaaatggttttaggctgggctcggggtgcatggttttgatagtagcac

SEQ ID NO: 56101 - DNA, 1501 bp, Oryza sativa
ataatgtggaagtgtggctctggcacagtacgtacatttccctgggatgggcacagtaggatgctctgggattttgtttgcttttgtgggaagtgtaagaaaagctgcctgctgcatgctgctatgtgtgcagccaagcgcacagtaataactagaaattaaagagagagataaaagatattgagatcgatatgtgtgtgtggagttgtggaccaatggatggaccagctagctgctgatcgatcaagatataatataagatagtatcatgcatgcattgtggtaagatatcgatctctatatatatatctctctccctatatataaagaaaaatataaaaaaaatacaaagaaaaatatttatcggctaataaattaatcaaattgaacgtacgtgcgtaccctctcctaccgtccaaagttgctttgtcgcttgatccatcacatcagctagctagctcgatggatcatgtcacagtgacttggtgtccatgcatgcgatccagatcgagccagcctgatatagtaacttaccactcgttgaccgcactattaattactacctccattccaaaatatttaatgccattgacttttttaaaaatgtttgaccgttcgtcttattcaaaaaatttaagtaattgttaattctttttctatcatttgatttattgttaaatatacttttatgtatacatatagtttcacacatatcacaaaagtttttgaataaaacgaatggtcaaacatatttaaaaaagttaacggtgtcaaacatttagggaaggagggagtagttcctccatccgttttcacaatgtaagattttataggattgtccatgtgtctagatttattaacatctatataaatgtggacaatgctagaaagtcttacgatatgaaacatatggagtaattaattaattccctaaatcacaaagaaaaaattaacttgctcgttgctactagtacatgatgttgtctgcatcaactaaacctacacataactattttagagctcatttgaaacgcaaactagattcttaaagtacaagaataggaaaacacggaattaaaatgtcacaactcacaccatgataaattctatagaaaacaatactaccgaaatgtttgaatgtaccacaagaaaaacacatcatatttaattaagttcacattttgatttggtagagaaataatgcagagagaaagagagagaatgcatcggaagtccgaaaggaatttgcaaacctaaagttagacttcatgctagaattccgccaaaatctggagtattaattactttaatgcagtcctacaaaccaaacgtgtgcacataggattttttttcctttggattgagttcctctgcttttcttccaaaattacttaattcagtacaaaggagctattagttttaattttaaataaaactaggatcaaaaccatggtatgtagaatcaagtagtcatatccttcagtaattttgacatacaatg

SEQ ID NO: 56102 - DNA, 1501 bp, Oryza sativa
gataataatctcccatatccgttgacggccgggttagcaaactggagtactaattaacaagctgcagctgctcattcagccaagcacatgcatgtggacgacatgattaattagagtagtagttcagaaggccccaatgcaatgcaacgcaatgcaaggacattcaggtttcggacagagagacccccgtgtaacatgggatcaaggatgatgcctgtatgtctgtctctctgtctgcttctccagagctaggttgatataaacctgcaggctgcagctagatacatagtctctcccctctgctatatatgtatcacatttcattttcgtggcccctatcatctgcagcatcagctcaggtccctctcttataatcttatccatccacgtacgcccgaccctacaaattaacttagcttaagcatatatatccacaaagtaattactcgcccgttccaaaatataaattaaataccgctgaagtttaacttttatctcaaaatataacgacttctgaagactcaacatacccaacctcacaagtagttaatttatcccgctggcctcaccttatctgttggtgataattaatctaggagcatttggttgcaacctgcgcaatcagataaaaattaaaccacttattcatatggcatgtgggttcgttagccaaataaccagccagcaattaagccttctaatgagaggacaaaattatgaacagattttatttttcccctcatttatatgtgtatgtatgtatgaaacaaactaatcatacacggattgtaatgcagctagctagctaagctagtgcttgtttatcattaagctgcatgtgcggttagttcagtctataaatattagtcacaactcttccttcatgtagttcttccttcggtatacatgtatgaattaatgctcatccaaggctcagattaactaacaaatatatgtttcagtttccttctcggcgagcgagcatataaattatttattccatgtcaatatgtatatccacttcaaatggctcggcagatgaagagatcatatgtatggcatcaatgtaaagaggatatataaattgaaggaggaagtagaagccagcataaatatatgactatggccctgtttagttccccacaaaaattttataccctatcaaatcgaatgtttgaacacctacataaagtattaaatataggctaaaaaataactaattacacagattgtgactaatttacgagttgaatcttttaagcctaattgctctatgatttgataatgtggtgctacagtaaacatttactaatgacggattaattatgcttaataaattcgtctcgctatttacttatagattctgcaattagtttttttattagtgtccgaacaacccatacgacactctatactatataatacccgatgtgacacgtctaaattttacaccctggatttaaacaccccctgtacagcagtacatgcatacacctataaa

SEQ ID NO: 56103 - DNA, 1501 bp, Oryza sativa
cttcccaaaaaccttattgccgccttctcccggtgcaggacgtcgaaggcagaggttcctgagacctgctctcccgatcgcaggtgcacgccagcgagcggggtggagtagtctacgagcgacggcgcagcacagaggaggaggcaaaccctagattgatttcgtgtgttttgcgtgaaggcggcggctcagtttatatagagataggtcgcttgatcagggcgcccgcacgatctccactccgcgtaaccgaaccggataagtcgcgcgtaacttatccggactccacgccgttttcacgcagcggatttttcggaatgtttccaaaacaaaacaaatccgaattttcctacagcaaaacaaaactgcaaaaggaggctgcatctgtgcaagggtgaggagccaattttgcggaccattcgacgcgtatgtcgtgcacgcgcgccgcctgccctgcccctgccctaccaggccaggtgaggcgaggcgaggcgagcgagcgcgtgttccccctcttctctccaccacacatgcttcaagaagctaggagggcatcctcccttttaaggaggtccccctctcctagaataagcaaggtggtactaaactccacatgcatgccatcccatgaggtgggcttttgtgatttttcaaagaattaatcttcgaatgggccttagcccatctattaattctaacaatcccccaccaaatctcaaaatcccactaagatttgccttttccaatgtacttttatataccagcggttcgatggagaccgatcaaggttgaacatccacctagaactccaagctacacttactcacaacttgaacaatggactacgtcttgaattacaagtcttatgcaagcaagtttcactcagagtcttatctggtactagaccgtctgtagactacccctcgggtggagcgtataagtcatactcctaggtctttaataagcttcctaaaagattcacccaaaatcttcatagactgcgaccaacagtcaagcttacaaaggtgagttctttcaagaatgctctgcaagacagcatcttcgctaattaaagccaacagaactcattaaggcatagccaacctgccttccagctcatgagagtacatgcatcttcacttagaggaccaacacatgtcttttctgcacactttgtcctcactcgtgtgcacccgggaaattcttcccggtcggtcacccatcccaaattgctccaggccaagcacgcttaaccctggagttctttggagattggcttccggaaaagaagttgcaacttgttgatatgagtattctattaatcctattaagccctaggaaaagaagttgcaacttgttgatatgagtattctattaatcctattaagccctaggccgggatgttacaccctcacccccttaagagagatcgacgcccccgtcgatcaaccctaggctaggaacgtcctctcttggccacgtccatgtgtccagtgccagc

SEQ ID NO: 56104 - DNA, 1501 bp, Oryza sativa
taataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtccctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcacacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgcca

SEQ ID NO: 56105 - DNA, 372 bp, Oryza sativa
attgtgcctagctagccaacaatcagccaaagcttttgaattgaagaagactggttttgaggtttaaaaaattatatgaaaaactaaaagatgaacacccgatatctatttgataactagctagcagatttttccgtacaatttgtatggacctagattttaaaaataaagtaagattttataaacatctcttgcttcttttttataaatattaattacaattgtatattattgtatacaactaatatcgataatatatttttctagaaagtcacgattaaacagtgtaaatttatatatttttctccaactaatatggtataatttctaggcatatagagaaggtgcattggcctctttagtgtaacactc

SEQ ID NO: 56106 - DNA, 1501 bp, Oryza sativa
ctttttctccattctgtcttgatctattgtatctgtttttttttatcaaaatctaagcgaatccataaagctcgatataaacggtgacttttaagtagagattagatcctataaattaaagcagaattgaaaggaaaaaaaacatgggaaaaatcatggagtagtagtgaggaatctatttttgcaatcaattgaaggagggaacacattaggaggcagatcgaacgtgacagccaaaaaacggagagaaaaaagaccgaagaaaaaaaagaaaaaatggcgaaaaaaaagaaaatacactcttccggggtttgaagacggcagtcagctagctatacgagttgagcctatagctcccattgtgcgctatgtcaaagagaggtaggctaagcacagagatgacgtactaggctgggattgaaaaggaaggaataaatgagtttttctgttcgatcctccaaaattggttgagggtttttgatacacttgatctactgtttcctttttatcaaaatttaagcaactccataaaactcgggatataaacggtgacttctaaatagagattagttcccataaattaaagcggaattgaaaagaaaaatcatggggaaaaatgatggagtagtagtggggaattgatttttgcaataaggacggaacacattagaggcagatcgaacgtgacggcgaaaaaaaaagagagagtgaaaagaccgacgagaaaaaaaaggaagaacgacaaaaaaaatagaaaagacactcttacggggattgaagattgaagacggcagtcagctagctatgcgagttgagcctatagctctcattgtgggctatgtcaaagaaaggtaggccaagcaaagagataaggcactgggctgggttagaaaaggaaggaataaatgaggttttgaccaaaaaccaaggagtataatgtatagttatccaaaaatatttttatccattgttgaagacagttgtgggctatgctagctgggtctacagcttcacctgtgggctagatcaaagagaggtagcgggctgggttaggactgaaatggaacgaataaatgagcttttggtctaaagcaaatagtataatgtatacgatccaaaaatatttttacctgttgcaacgcacgggtattttttttaagtatctaataaaataaataaaacactatctcggcatcggaaaactaagcccaggtatcgatcttccatgagtcaaaaggccaccttacctccctagctaggtactatactagtctacccttctcaaccaaaccaaacttaaccaaacctccctcgatagaccatgacaacaaccactcctacaaacaaaacccaccccacccacaaattaaacacaccaccctcaatatatatcatcatcatcatcccccaattcccaacaccgcgacgtgcttcctataaattaactccccccgatcctcctcccaaccattccacaccttggcaatcatggggaagaaga

SEQ ID NO: 56107 - DNA, 1501 bp, Oryza sativa
acggaggaagtagcgattaattttagtaatataaggcgtaactatctctaacgcaaaagtaaaaaaatattattatcacatctaatcattctaataaatacaatacatacatataataaaattagagatattaagaatgaaggttttaaaaaagaattaaaaggaaaggaagatgctaattaattgtatatatgcatatgtgtcttaggccacaaccaataggagttttattcccattaaataggatgccatgtcagtatttttaatgatgtgcagaaattaatgaagtggaagacaaaataagccacatctagatgaattcatgcatatgttgtctctaggcctctagggttaattggatccatgccaatgtaaatatattgattcagataaatattactataattcttttatgagtatccataccattcaaaatcacataaatcagaaccatactatcaccgtcacttttttcatcttctccccccatctgcacgtgggacctacccgtcaaattcatcttcttcctttcacgagcagctgcaaccagatctctggggcgagggcagcacgagctcagcggtcgcggacgccatggcagacctctcatcgccgttctcgagagcatggatggggaacatatgaggcttacccttgcagagcgcgagaacgggagtgagggagaagcaacgaccacgagcacctcatcttcgttgtcctcctgcgcgcggctgcatagcgagaacccctcgccatcatcatgagaggggtagcggagcggcacctctcacaatcgtcgtccgcatcctcggggccttgccgtacgtcgccgtcctcgagcgcacggctggggaggatgagcggcccatcttcgccgagtgcgagcagtccttccgctgcagaggagcgggccggtgggagcgctgttaggcacgcagccgtcgtggcaagggcggtgtcaccgagcacacggtgagcatgcggaggagcggagacgagggcgcattagcagcatcgccaagcacgcgaccggtgcggcgagggcagcactatggaggacaagagtgctggatggagcatgaggacgcaaccgagcatgcaaactggggcagagcaaagggcttgctactcggaggtctggcgttgtgccggtggacaagcacggcgtcgtcattgctggctcggccaacactcctgcttcattcccggcctcgttgacacccccaccgctcgcactactaccgctgccatctcaatgcaagaagatgggaagagagaaagaacatacgaagaaggaaggagatggatgcaaaacgtaacgacaatggcacggtccctattttgtaagatttcagtgatacggttacgaatagacgaattgtaatgatatttatctaagtcagcatattttgtttataatatagtttgtcttacatataatacgtatgaaacaacaaaaatgagaacaatggattatatgagttattttaatcatcaatta

SEQ ID NO: 56108 - DNA, 415 bp, Oryza sativa
actttgtcaaactttcgaaaaaaaagtttgacttaagacaaaagcaaaacactttacattctgatatggaaggagtaaattagttatattatgagatgaggagagtaaagtagttatattttgagacatatgtgagagtaaacaaaacacatctccacaacccgcaaactaagtccaggtatcgatcctccatgagtcaaaataccacctcaccctagctcccaaccgagacaataaacgaaattaaggcaatctagtttttttttacatctctccttaactccatgaaaaactagacatatatttatactagcagagtgcccatgtgttacaataatggcgaacaatttaggaaacttcattttatctaaaagagaaaactcattcactctttagagacgtcattcgttataga

SEQ ID NO: 56109 - DNA, 1501 bp, Oryza sativa
cccactgtctcacatgtctcggacttagcaactgcacacatgttccctaactgaatctaaaatggagttccactagttttcgttattagagcttgggctccgacagcaacgcataggaaatggtactccctctgtccaaaaatagctgcagggatgaaggaagtaattctatacctaataaaaaatacataaggattttgtatttcttttctttgtacatcgtccgtacgtcgctcgataggcacatgccttcagtctccgccgccgccaccatatcgatctgtctccgcatgtgttttctcttctaattgattgcaaaaattgatttcccactcctccgtcatcattttccccttttaatttgactttaattcaccggatttaatctctagccgccgcccaggccgaaccctagcgccgccgccacatcgatctacctacgcatgcgtttcctcctccaattgattgcaaaaattgatttccttatcctccctcgtcattttccccatgatttctcctttaaattcggctttaattcgccaaatttaatgtctgttgaacggtcaccaatgatggccggtcgacgagcttctcctggccctttttatctgagttttgtggattcgctccgattttggggaaaccagaaagaggagatcgagtggatcaaaagtcctcaatcaattttaggtgattgagaaagacttgccggatttgatgagggagaactggctccagcatcgtgcaggcacatgggattatcttccagaggttgaagacgctacagaagcgcgtgggcagccgactgtgctagctgggcccacggctccacttgtgggctaggccgaagaaaagagaggtaggtcgagtggagaaaggtaggagagaactgacagtgttagagctgaaaaggaaaaaaaaataatgagcttttgctcaaagctaagaaaagattttgattaactttttttaattatactgtacagcaatactaatgtttcaagttatttcccaactcccaataacacacggacatttttttttctgagtataatacaaaaaattacttgaaaaaagaaataaaaatcaataccaaaaagttaggaaagataccaaatatctcatactcccgggcatccctacgtaaattgtgccaaacaaggcagaggaaagcgtcgtgcggctggaggatacttccctttcccctcggccgcctgcgccgatccccatccctccgcggccgcgagcgaccaggggagggccgcagccgccgcccccggcgccgttctcccgcttcttccgccgcatcgcatactggtgagagcatccacccatcctctctctatccttcgaatttcacgggcgtaaaccctagcttcagttctagatctagaagctatgttctctcaatttaccttaaaccttgatactaatagcagttcgttcgttcacccagaaaaaaaaattgtgccatgttatagagactgctaaaaacatcaca

SEQ ID NO: 56110 - DNA, 373 bp, Oryza sativa
cggattattgaacctaaccttgtataagaacgtaacccatgcgcgagcctaagcagaatcaacttgtttgagtggttcagcaggtccgttaggaccaattccattagagtttacattggtttaccattttcttttgttcataaaaattgatgggtcatctgctttctttcattcctgttattttaccatttatttattttcttacttgatgttgttgtcctgcactaggttgtgattaaggccccttcggacccatagagctaattttggatttcattataaaaattaaaccgtgatcaaatcatatagcactctaatttatatcaccaccttttgttttttcaattgctatattggtaaacttggaaccagg

SEQ ID NO: 56111 - DNA, 1501 bp, Oryza sativa
aaaagttttagtttggaccaccctttgtccatttttttactttaggctaggtaactttatcttaatttgttgtacaatagactacctcaaaccacatctttagcacttcaatgactttgagcaaaacattaatgacatgccggcgaattttcatacttatatgcatgtcatacctttatcaaggagacgttagacatggtttgcgaagagagctagaatggtccattaattatgcaacaaatataaagttacataattcaaagtgaaaagattggatatagaatgatcatgagttaaacttcgacgataaaacatggtacgaagtgcaattcactcttaaacttgtcatcctctaaaatttacttaaaataaaataaatgccacacctatgagaactgatttggttttatttgataacataatatagatatgcgcatagaaatacggattcgaatcggaaagtcatgtacgcaagcaaatcaagaactgtttatgtgatccccagattcctattatatgataggacagtaggtccatctctatcccaagctagtgcaccacacatatcacaatatcagccaaaactcatgcaccccactcctctctgactccgtagtccagttgaaaagacaattaatcaagtgaaaattggaaccatgtcattataattttataaaatttaagatatgatatcctgacccacatgtcattgactcatatgggtcctcatatcattgaaataccgatggcatatctcaaacattgcaaaattataatggcatggttccaatttacccattaatcaacgggaaggacgccgagatgtgttcggcactgcctgctagtaactttcagaacggaaaagagttaactcattttcatataattaattatgtattagctaaaagagtaattttattggttcttgagaaggtatcagaggcaccatattttctacagtgaaatctggtacctccagggttaggaggtatggaaatttatggtaaaatttttcttacctctcagtataatttatctggctaaaaacttaaaaattagattaatatgaatttttaaaataacttttttctgattttctctaattctccacagcatcttcatgttagtacagtagtatatttgtgtagatcaaataaattatggaaagtcagcgcgcgtgcagcggcggctcaagaaatttcgctgtcacggctctctcacggcattgatcttcccaaacccataatgccaccactcgatcgatcaccacactgctgcaaataatcgactttctctctctctagtctctatatacaatatcgatcagtggagcttaatttgcaaattaaccacattcgaatttctctctctctctctctagtctctataaacaagattgatcagtggagcttaatttgcaaattaaccaacattgcattgcctacgcaagagcgagcatacatgatttccatggcgccggcggcgccatttccacgtcgtc

SEQ ID NO: 56112 - DNA, 1501 bp, Oryza sativa
agaaccatggtcattgctatcatcaaacatctccaggttcccatcatgccaattgccccaaaaatcatcagcaatgtcgtcccctccattgggatttctattgttgagagcagctgttcttttcttgtaaagaatataggctactatgactcccacaacgcagactgctccaacgatatagggtctcaattttacatcggacataatctctttgaccaagccaagaatgtgctgacttgagtacacagatagagatataggcatgatagtgttgcagtcatttggtgttgatgaagttctttgtaaaggagtggtgagcagggtactctctaaaagagtggtgatctctgaaggagtaataagctcaatgttctctgacatcggagtagtctggatggtttccttaagaacattagaaattcgctcaagcacctcgggaggcagctgaataacctcctcaggcagctgaagagcctcatcagcgcttggcagtggcaactttccctcatcagaaatttcttctcaaacacctctcgaacaatatcagggttgtttttgacttcctcttttacttccctaaagaaccctcgtaggaaagttcttattagggtgttaagagtcgacgacattatgctttagcctacggatcaaatatttgaaaatgtattagaaaaactgaaaaagaaacacaaatgcaacgaaatctcataaaagcgtaaaagaaatcattggatttggaaatttaattagaaaaactgaaaaaaaaatcacaaatgcaatgaaatctcacaaacaagagagtacaaacaaaaagagtaaaatatattgccggtccttaaacttgtgggctgtaaacttgttttaatgtaccacccccagttcaatcgttctttgaccacgtttgaccaccaacgtggcatgccacataggcaacatttttgtactcagtcccccgacccctccacatataccttcacacataactcgccctgacccgtgcatttcaacccaaatcccccaaaatatctctaaattaactagggtctctacggtgaggttagcagaagtaggccgagaggtagcggctgtggcggcctcggcggtgagattagcggcagaaggcagcgcagtgcagcggggttgggtgcagtgccccttgtgcaaggataagatcattttgaagtgcagagcaatgtcaattgctaatagggcgtgcattttctgtacacgcaaggagaagaatgagagggaagaatgatttaaggattttttttttgggattctggtgtcactatatagctacgaggagatatatgcgacgtgttgtgatgtggagggggttgagaacaaatgtgttgcctacgtggcatgccacgttggcggtcaaacacagtcaaatgacatttggacaaggggtggtacattaaaccaagttcacggtcctaaacatgcaatttcaagttcacggatttaagtgacactaacacacaagtttaggggc

SEQ ID NO: 56113 - DNA, 1501 bp, Oryza sativa
ctctacacgataaaatttgtcaagatacttaaattagtctaatttagaacatccattaagattttgagcatatcattggtcaccttggtgttatgcttattattgctatgtgtacccatcttatataggttggggataggacttaaaaaaaaacctaaccgaatacaacattagtgtcccgacattatgaactagtcctactctattacaaaattcatggatttgctccaccttctatatctagtcaaatatggaggttgtgtgagcacccgatttctatgttctccacggtgagtatattatttggttgttactgaaaatagaggtatctcatgataaattattttggttgtacatgagttgatgctatcgacattatcagatatggtatagacgcttttaaacctactatctttttcggacggaagaagtaagtcacactctaaaataaaacctagatattaatcgttagtggatatatgattattaggtgatgtcccaccgatgagcaaatacataaaccatgagatagtacaaagacaaactaactgtagcaggtaaggagtagacccaatataggccaagcctttgtgcggcccatggatgaaacactataacgaaattatattaagtatttccaaaattaaatataaagtgatatgggctttaacacacacactcctatccatgactctcgaggtaaatgtatgcataacgataaaattcgatggatctaggatatgtaagataaggtatgaaatcaaatcgtacatcagcattgtgctcatgtatacgtgcgcttttgtcatctccttagaaaaacatcttctatgactccataaatgattggtttaagtgttaacttcttatagattgtgtcatattatccatcataatattattttgctgccactttcagatcaacaatcaatcacgctaccccttcttcttcacaagtttaatcaacaactgcatggcacaaaatatacaaaaaaaaactagagagatgaaagagagaagaagcgacgagtctcccataacatacgttggaccgatgtgtacctttgacatgtgggcccatgacgatgggccaccacatgttagggactcacgcccctctaactttacaatagagtagttgcttctaagaaaaaatgcatgcgacatgatcaacacaacacaagtacaactaaagtcatagaaaaccatgaggcctaaatgtggtagtacaagaggcaaaggtgtagacccaacatgggccaagccttcgggcggcccatgctgcaatagcccatacgcgaaacattaggatgaaataaaataatgtaatatgggtcttaacacccatattccttaccatagcccacgtggtcgatagcaaaattcatttgatataaatgtatatgcaatagtgaggtcgattgcttcgataggtttgaagtatgtaacaaacgaaaacgccatgtatgaaatcatatatacacaacatagaaaaataact

SEQ ID NO: 56114 - DNA, 1501 bp, Oryza sativa
tcttgtgtccgtgctccgttcactcatgaatttcgttggagttgcagctctggtttaagcttgtgattcccgatgatccgtgtttacaacgtgattatcaaatgctttcacaagtcacagacatttgtaacgccacaattaaaaatcttacattagttcctccaaaataacaaatagtaaaagttgtcaatttggcatttgttatttagaaatatagagtagcaaattttaccaaaaaagtgcgttgggagccgtgctctctctcactttactaataaaatgataaaactttaccatgcatctaaacaccaactagcaaattttcaatgccaaaacttttgccacaacaaattgatcaaaacatgcccatactactacttgtttaaacggcttatttgcttcatgattaaaattatttttttcttaaaagaatctcttcaaccatattgcttgcacatcttaggtttatttattaaaacatttaatttaatttatatttatataattaaatagataatccgtagcaacaatcctctcagcaatctatttcaaacggagcctaaggcgttaaggattgttcaacttgtgcaagactttgtccattttttatccgattttggtagaacaacaaattaagcattctcttgccatgatcgctctttcaaattttggtatttttgaaagtttcttctcttataagctctaaagtttggtaaccaaacacatctaacactatcaaaatttagtacttcctccgtttcataatgtaagtcattctagcattttctacattcatattgatgttaataaatctagatagattcattaacattaatatgaatatggaaaatgctagaatgacttacattgtgaaacagatggagtaacatgtaagtgcctcgaaattgattgtagcaacacactgaacatccattaaatctatatcaagcgccaaggaacttaactgtggttcatggattttatgtagccttaatctattgcacattactccctccggcttcataactcttgacgttttgaaaaagtttagatcagacaataaaaactttaactattaataactatatagtttaaagatattagaacacaatgtatagattagtcttaaactattaccatgcctcacgtctaaacacgtgttgttgttcaaaacatcaaaaattatggaaccagaaccgtaggagtactcgtgtatttgctctttataacagtgccaaaaaggaaagaagtggcagacggggcctcattgactcgtatctacaagaaaagaggttcagaagataaagagaattccagtatgaatgatacttcaactcctgatacagactgaaaaccttgataaacagagagatggatcaaccacagccttttgaaccaaatcaggcgagaaccaacgcagaacttatgaagtggatgctgcgccacttccctacggagtctcgtcttcgtggtaaagatacagaccaaagccaaaccttgc

SEQ ID NO: 56115 - DNA, 618 bp, Oryza sativa
aacctgaaatgccagggacagatgcttcattagatactcctatttgattttttatgtttagaattatattggctttagtcgaatatctagaaagtttgtattgattaattaattctccctccaatttttaataaatgatcattcacttttactatcagttaatcattcttcttattcaatttatttatttaaatatactaaaatgtaaatcacatttaaagtatattcagataaaataaatcacaaccaaataaacaataattatatatttttataacattaatggttaaatgtactcaaagttaatggcgttatctattaaaagctaaaggtacttggtttaaaaagtgaatttattttgaggagtactgttatctttatcataaagtataagagataaaaaatagtactatcatagtatatttcgagacagagagaataccatgatactataaatcaaaactgaagtaccttctcatttcgaattacaaacattttagcatatccatcactcgtctagattcactgacatgtgaatatatataagtaacacataaatccatatatatgaatctattcaaaactcaaacgtctaataatgtgaaatactagtatata

SEQ ID NO: 56116 - DNA, 429 bp, Oryza sativa
atgcatataggccgtgtttagtttcaaatttttcttcaaacttacaactttttcatcacatcgtttcaatttcaactaaattttcaattttggcgtaaactaaacacaaccatgtgctactacgtggtatttcatcacatagaaattaaatgcaagcgactactccaaccgtatttttttttaaaaaaagtcaacctagtaatcctcctcctagatttttttttcgacggagtgtactaagctcagtatagttcaccttacctacactgattgggtgatttgatgtcaagcaccataaaaatataatattactttagtataataaaacataaaataatttgatcagatgaaatacattctaataccacgaatctaaataaccacgtgtcccatccaactcaaccaaagtctggcgatcctctcaacagg

SEQ ID NO: 56117 - DNA, 764 bp, Oryza sativa
cttagatggggcccagctgtcagtgtgacggtccgtgcgttggtggatcgatcattcatgccttcatggtgccctcgtgattcgggaagggggtagttacgccgctgactcgtgggcccgggttggtgtcgctttgttgttcttgctgggccccgctcgtctgtgtctgggagggctgtactccacctgtctgggcctcgcttcctctgtctctctctcgcacagtcgctggaatggatgcagctgaaacaccattgttttatccgatttactactttgcaatatctgaattttgacatagcgattagcctattattaattactactatgcgatcgtggcctgaattttgacatagctatgaattgtgttatgggatgtaaagaaaatgggagacaactgaaaaacaggagtagttgacactgatgtaatgtagagatgcttgctacttgtgccataatattctagaagtattatggaatagccaaatgtgatgtccattgcaagcaaagattacaagcaaagattacaagggtcactgttgatagatatagattattgtcatcagggggtgatgtgacttagtaccaataatttgatggaaccaatttaacaccgacacaacaatataaagacacagtactgattctgcaactaattagtatttactaatatacaattgctgtcatctatctccatggctttacggtttgttattttaaaattcctttcagatctcctaaaaatcattttgcttcatgttgca

SEQ ID NO: 56118 - DNA, 595 bp, Oryza sativa
aggacagcgattgcgaggtctggtggcgagggtggtgatccggtgactgcaacgacggcagcggcccccttggccctcccccgtgcagatccggcgacagactcgagcaggaggccggtggcggctctcccccgccctcccccgcgcggatccagagttgggcggcacggtggtggcatgtgcgggctccggcggcaggcgcggatccactgtcggcgacaacgggagctacggatccgccggcggtggagatgggagaggcggatccgccagcgatggcagcggtggcgattagctagggttagggttaggtttttgtgttttggatttttttttttgcgatttttcatttttcgcttgcacacggcttaagcgcttgcattccgcatgcggtgcaccacccgcatggaaatattatcatttttatatgccctattgggcaggcagttggtacaaccgcacgcaaaaaactatttcgacagtttgaaaaaaatatgtttttgtagtagtggcccgctcgatttgattcgtggccggttgctttgcttacatgtcttgcaattgagttgtgtgtgtgtgtgtatatatgcaggcc

SEQ ID NO: 56119 - DNA, 156 bp, Oryza sativa
agtaattattaattcttttcctatcatttaattcattgttaaatatacttttatgtaggcatataattttacatatttcacaaaagtttttgaataggatgaacggtcaaacatgtgctaaaaagtcaacggtgtcaaacatttcgaaacggaggg

SEQ ID NO: 56120 - DNA, 1501 bp, Oryza sativa
aagctatcccagccatccacgtatactcagtctaagagcaccctatcctactacgtccagcctccgccgccgccgaccacgtcgccagcggcgttgccacggccggcggtgcgccgccgccggcctccagcacggcgcaggcgatgtgcctgttggccgcctcggtgaagtgcacgccgtcccacgacacgtacgccgacgggtccgcgcacgccgtcgaccccgccgcgccgcagaatgccgccatgtcgaagttgtacgcgccggcgccggcgccgcagcacgcggcgagcggcgcgcccccgaacccgtgcctccccggcgaggcgacgatgtcggcgacggcgcggtagaggtcggcgtaggccacgacgacggacgcgcctgggtgcgcgccgcggagctcggcgacggcgcggcgcagctcgcggttgtggtgctcggcgaggccgttcagccgcgtcatgcagccggactccgggtcgtagtcgtcgccggcgacgccgccgccgccctggtagagcgcgagcagctgcggctcgcagccgagaggtatcatccccggcaccaccaccgtcgtcgctccggcggcgatcacctcctgcaacacacacacacacacacatgagatcgatcgaaaacctacgtgtcgtgacactggtcgatgtgtcattactgatcaagatgatctgctcttttttgtgaacgcgcaaaaagattacacgtcagagagttgatgttcacaacgcaacgatcgtaccaattaaacttacgtacgttcacggtggagcggatggcagcgacgatgtgcggcacgacggaggtctcgacctcgccgacggtgaggttgccgacgagggagacgaggtagtcgttcacgccgatctccccgacgatgaacagcgagctcgccatgatcttcctcctccctatcaaaagtgaaccaacacgcatttttccggcacgtgcgtttattaatgatgtcagagaaaaataaaaaagcactcgatgatacactgatcgaacatttcggccggtagatggcacgtcgcgatccacgttaattatttctaatgttttttttttgatttttttaccgtgatctgaagatccaagaatctgcaagactttgtagaaccaggcggtctggttcgcgagagagaccggcacgaacggcttgagaccacggccctcgtagaactccggcggcagcgccgtcgacccgccgacggcgaagttcacgccgtgccggaactccgccgccgtctcgccgccggcggcgaggtacggcgccgggtgccgcagccgcagcgcctccactgcacgtcgtcacgtcgtgatcagaagtttgccattttggttttgagaatgaatgtgtggtggtggtggttggctaccgatgaagtcgacggcgaggcggccgtcggaggcgcggccggtggggcggcggaagaaggtctcgccgtagggagggcggctggccgggccgccgccgccgccg

SEQ ID NO: 56121 - DNA, 199 bp, Oryza sativa
cgccgactggatccacatagccgactgccgcccggttgaccggttccccctcccatcccgcccgagcctaccgccggcgtcacgggcgccgcgtcacccccatgaggtaaggaaggcagtcgtgtcggaggcgctcccactcgagtgtccgccactctcgcttccgcgtccctcaccgccgtccgtcgttcgccccagc

SEQ ID NO: 56122 - DNA, 521 bp, Oryza sativa
ccaccatgtggcactcctacaaacgctctcaagccgccacatggcactgtaaaatcaaaggtgtttttgattattattatgtgatgaacaattggcattggagattattggttttgttatttggaatttattcacgaagtggttttggagatgattgaatttacaggtgaatcgcaggtacttttatttcatgtgaccggtcagaccgggcaggtgttgccggtcagaccggcagtatgcgtgcggtcagaccggccagcctgcggtctgaccggccgactctgtgtcggtttcagtttcgggttgtttgtttggatatccgtatgtaatactgttgtttgctactaatgagtcaagttggagataacttagtctcggaatatggtttctttgtttatttcatgtgtaggtgactcgatgcctcaggagagtatttgcggtgatggaccaagagtcggcttggggataagacgacgtccgtggtggtcagagatcatgcgggatacttaggctagagttga

SEQ ID NO: 56123 - DNA, 227 bp, Oryza sativa
cctccgagtcgagaaccaatcacctgtcccaaggacgtaagatcccgagacgaaaacccctccatgatgttaaacaaggcaggcgaaaaccctgcaaacgacgtaaccggatcggagaagaactccatcctaagccatcccacaatgtgggatatcgccggcgtctcccggtcgcccgggaatcgccaaaaccctaatcccaatatgttgatttcactaattgtagt

SEQ ID NO: 56124 - DNA, 478 bp, Oryza sativa
aactaggttttaagttttaaattttagcatgcatatatatcggctgattttgtacagagggaacgatgcatggagacgttaatgcacggcagacggcagatgcatcggcgcatcagcgatggacggtgctggttgattgtgatatatgccgatcgatgccgccgtccccttttctctcgtgtagtcgtctggtagcaccgcacaagactatacacgccgagaattaaaggcaacgcatgcgtggccggggcggctggaaagtttgtgctgctttgctagggcggaaaagcaaattaaacagccggccggtgcacacatacaacgcacgcggcaacggcggcgaggcgagacgcgcggacgcttgccgactggcgactgatgacgactcgattggttaatttggccgccggctcgatcgcccgctgctgcgcctgcgtggtgcgcgcgggtgagcaacccacaaccataccacgcttgc

SEQ ID NO: 56125 - DNA, 1172 bp, Oryza sativa
caaagtgtattcatttgtcaaatgtatctctgttgaatttttgtgctgtatgctagagatgaaataatgctaccgatgcttcacaaggtctgtttgtttgaatgctacaagtctgggtgtgctatggccaccataaaggaaatagcacatgttttctacagatgtatgagaatgctatgaatatacaattaatcagttatacatgccttccccagttaattacactgctttaataattcctgccatgtctggactcttgagttagacttgacgagggccatgagaaattcctcatggggaaatttgtatgctggtatagacaagcaccaccaatttgttgagataagcttctgaccttcagcttccttgcgtgcaagtactcaatggcagttttctacagtctacagaagctagcatgggtatttctttctggatgttctgtcagaaaataactgtagcacaattacttatcaaaatgttatacggttcaggaggtttagtggtctaaaacttttaacataatctaaaatctgtgatttgattcaatcaagtacaagcatactcttatgtgcagcagacatactcttgagtacttgaggttttagcatgtcttcactgcgctttaagatatgccattcacaattatatcctaacataataatcccttatttcttttacttaaataataatcccttaattggtagaacaaacaatcaaatttaatgaagcttcagttaaaaatttatacatacaaattagtgaatatggtaaaacatgtacgcttagattatttttatttggaaggttatgaatgcttatattattgagtgaagtgatttatctatatctttcaaactgttcatgatctccaaatacaagattgatggctatgcaattttgttcaaacaacagttagtgaatacagtttccttaataaaataaaacgaatgtacataccatggaggaaggcagatcaattcccatttgtgtatacaagtcatctgtccctctagtacttccactcctgtatgtccatccaaaattgtccagtacagtagctttccagaaaaagaatttttcctatacatgcctgcacatctatgattttccaatgaacagcaagtcatcaatatgtatgaagaaattacattggtggtttactgataacaaaa

SEQ ID NO: 56126 - DNA, 448 bp, Oryza sativa
tttcctcccaaatagtttggaaatgaacttacaaacaattagtttctacttccttcgtttcaggttataagacattttgactttggtcaaagtcaaaatgctttaagtttgactaaatttgaagaaaaacaaataataacatttttaacccaagacaaatttattataaaaatatatttaattattgatttaatgaaactaatttgatattataaatattactatatttgtctataagcttaattaaagttgaagtagttcgacttttgacaaagtcaaaacgtcttgtaacctgaaatggagagagtattttttttctaaagatgattcccaatgcaaatagaaaaatgaactgatgtagcacgtataaacatggacaataaactagtttttatctataccggaacaagtgttcggcgagcacgtatatatagcataccggcgacga

SEQ ID NO: 56127 - DNA, 1501 bp, Oryza sativa
tgttcggctgttggttgagaatttctgtgtacctcgaaaaaaaaattcggctcgcttggttgagcattttggaatttgctgctactcatttgattgtttcctgtccgatgatgctatggttttgttcgtgctactctctccgttgttgttttttttttttgtgtgtgtgtgtgtgtttcttcgtggttttccccttcgttgatgctagggtcgttcgtggtactcatctccgtcgattttgcgtttttttggtgctccgatgaggcgatgatgctagctagatattgtcgtgtgacgactgcgagtgcgagctgtcagtttttcgatcgcggtgttcttcttcttttcgcaaatggacttggtgcttttactgagctatcttgctcgaacatatttaatttcggaagtctttggatcgtttcgtggcaagattttggatgattgctgatcttgttgttagttttacgttcctgtctccaccacctctccaaggcgcttcatgcgcgtacatcgtcttctggcttctcttccgttcgtgctccgcctccgcccaaaaaccgccgtggccttggttcacagtttgcaagccgcggcgagtgccgacgctgacgcatcttctgcactgcgaccagctacccatttgattttgttgtttggttggttttttcgatgagttctcttcggttttgcgctatgcacgctcgcgatagaattccgccgaaaagacaccattcttggctacttgtggttttctgcgtctctcccgtgctccatcgaactcttgggttgtttttctttttttaacctattcgtattaaaggagagggaaacactatacaacagccgtgaggctaggagcttataaaattgaaaaaaagagagaaacagtacgtggttggggagggggcgaccactagaggagtagagggtgcgaaaagataaatttcttgattacggattattgattgtgctaccacgggtatctggcagtagggactggattaccttcgctccacttgcgcgccatagccatgtttcgtcaattgcccggttaatgattccttgcggtggctcttgggttggttttttgagctctcgtgacccaattccgtcgagaagacgctcaagatgccatgctcggcaactagtgattttctgagttgtattgcgctcgatcgagatgccatcctcggcaacttttctgtcgctcttgcgcttgatcaaactccgcaagacaacgccggagacgccatcatcggcaatagttaagctagcctattgtttgttgggctttgggttttttttagtgaaatatatggccggcccctaaacttgtgtgttagtgtcacttaaatccgtgaacttgaaattgcatgtttaggaccgtgaacttggtttaatgtaccaccccttgtccaaatgtcatttgactgtgtttgaccgccaacgtggcatgccacgtaggcaacacatttgttctcaaccccctccacatcacaac

SEQ ID NO: 56128 - DNA, 1501 bp, Oryza sativa
agagacctgtagaagcattctttgtcagagaatgaataattcgattcagttcaatgttcaagcaattcattcatgcaatccgcatccaacgaaaaatgaaaaaggccactaaattggtgctcattcttgttggaataaatgggctaggcccaatttaattcaattaaaatctcaagagcccacaagtaatgttagagagaataatactgccttgaaaatttaggtggaagaacctcaacttaaatagggtgatattagagattccctgttgaccggttgaagtgatggttggactgccacacgcatgcgcgcatgccgagtcggcctcggccgtgggcgtagcgaggcgaggcggccgaccgagccgagcctgcctgctgctcttacgttttgtaacagacgagaataaaatcaccattaacaaatgaaattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgagatttatttgtgtggtaatggagatctctctctacatataacgcaaggcagaggctctcaaagtgtgtgtcttcctcctactattgttccttggcgatactctccttctgttcctgcgctgtctctctgtttctccggttctgttcatcccgcgcacacgggtgatcggaacgagcaagtgcctccgaaactccgtccgcttgagaacctgcacgggtaggcaggcgatcaagtttttgggtagcgcttcaagcgcgactgctttgcatcatcttcaccaacatgtcgacaaccgatgacaacaacaacaccggagacaaggagaaggagcctctcgtcaacaccaacgaaggcaatactgcctcaaactccagcggagggtcattttcggggtataacgtttcactattaccgttcgttcttcgtttcctacaactgtctgtcgcaatattattgcgatctcttatctatgttgatgcttattctatattaagcatgctcatgttatacacatctagcactgccactagatctactcaaattacaaatgtcatgtttattgtcttaaaattttagattaaaatatgccgaattatgaccaaatttccaacaattctaacactgaacacacacaagcactcagctagggaacaaatcagcagcgacaatgaactgaaattctccgattaaatctgttcagtataaacactagaactccttaattgtcgtaccaatttggtagtaataagcaatgtgtaattgcacggtaccttccttgaagacgaggcctgtgagcgccgcaaacgtagggccgacgaaccacagcgcagccgggtggtcgagaacgtagccgacgaggctctcgtcgagcggctgcgcgccggcgacgtacgtcccgatgga

SEQ ID NO: 56129 - DNA, 1501 bp, Oryza sativa
ccacgaaggacgcggcggcggtgaccagcccggaccgatacagcaagacctcgcgcacgtcggagtcctcgacggtccatgggccgtagacgccgttgtagacgttccggtcggcgacggcggcgagctgcctcgcggcggcggcgcggcggccgaggtaggcgaggggaagaggccgtccgactgcggtgggggtcagccccagcctggggtgcggccgtagaggcgcgacggcgaggcgcggcgagaggaggaggacggtagcggccatggcgtcgcggcgggatgataattttttgggggagattttttggtgggtggtggtttccggcgaggtgtcgagagctccggcctgtgacgaccgcaggctcgacggacggtgcagattcagtttcggcgtcgatccaacggcctctgatccggtagagtgccgccacgtggccgtcccggcccaactcattgggccgcacggagattgcaacccctttccggcccaataagtacaggccggcaggcctgccgtcagtcaaatccatggcgctcccatgttaatttccttctttcacgtaaaaaactaatctagtatcggagattcatagtgttataatatgttgtatcgggttttagattcgtcttttataggacggagagagtacaaaggagtaatgacaacttggaacgcatgaaacacttgcgacggttcgccgccggcagcaggtcaaccacggcaagtccggcgagcggggcatttaactatttgccacttttagatttgacgattaactatttgctacatctatctcaataacatgtggatctacatgtgtctataatatatgagtctaatggcaaatagttaattgccacgtctaaaagtggtatatagttcaatatctcccggcgagcaactagatcgaccactctcttcagtgtcagtttcatcacagtgattccggtcgaaaaatattaacggctgctggtggtaatgtttgcccaattccgtgggctgcctgtgtttccctgcatctgcatctgccgccgcgagcagtaactaattaaaagttactgtctgttctgatgccaggaccaccgtacctcgtctatgagacgtactatgactgtaattcatactgtttcaacatttggatgcattgcatgcatgcttaatttcaacatactattatataattaagtactccctccgtttaatataaggggattttaaatttttcttacaacgtttgaccattcatcttattcaaaatttttttgcaaatataaaaaacgaaaagttatatttaaagtgccgtagataataaagtaagtcacaaataaaataaataataatttcaaaaaaaaattgaataaaacgagtggttaaacgttgcaagtaaaaacttaaaatctcttatattatgggacggagggagtatatgttttgattgccaacaagatgcatgctttgatgcagacgaacttgcatttctcatcaacagtgatc

SEQ ID NO: 56130 - DNA, 1501 bp, Oryza sativa
gcggatgacgtggaggttgcggccccccggccagtcgtaccacaggtccgccagcgacaggttgccgtggaactccatcaggagcttcgcgtggaactgggccggccatggcgtcggcgtcggcgtcggctccgatccgtcgccggcgacgacgaggaacaaggccgccgcgaggaggagaggggccgccgtcttctccatcttgtgcaagtggctgcgctgctgcgtgggagtgagatggcgtagtacggtttcgagggcttgagtgaaattgtgtgattttccaagggtgattatgcaaaaattcgtccatttttagtacggtttgggcccattaacaaatggactttgctttgtccaattgctacaaattgagcctactttcttttcgtttttgctgctttaacaagtagaaataggcccaagtggcagagttacctacctttgctaattttggactccaagcacacaattagtactcatccgcattgtgctaattcaggttattgagaggggaagaaagtggttatacgagatcgatggaggacgcagcagctaacggtcgctatacgatggaaatgagattgtaccggacatattgtgcatatatacaaaaagtataggagtatgttccagacgatggcaacttgacctctttaattcaaagctagcctcaaacgtacttaactattcatgctttgacgtcaaggcaagggtcgagtagtaagtaacacaggctcaaaaggcaggctatcttaagctacctatacgttttgagtgtagtatacgagccgatcgatcgatcgatcgaccactgtaccgcactgcacgcgccaaattgaaaatcggattagtggctcaaatcaaaaactaaagttagtctgaactttgtctagtgtgcaaaatcttttgacattaattaatcaattggtaggttttgtgcgttgtgtcttgtgtgatttccacacttggttgacgccgacgtcgttgtaaagtttgcacgcggcaactgggcgtggtctctgaacgaaccgtcaattcattcatggaatgaatttgatggaaacatatcccgactttgtgcagtctgtaattgtgctatgttagtgccacaaagtcgatatagcacaactacaaattgcacaaaatcgacatgggacgactgcagattgcacaaagttagaggagtttctttcgaatttgatatatggtccgtccaaaaaaaatcatgggattggcgcctgcctgaatccatggtgggtcgttggccaactcctccatttctcacggcgccggtcgccgccccggccctacttcccttcacgcctccactgacctcgccggccggccaccaccaccgcccgcgcgccacacctataaaacctcacctcctccacctccatggctcaccaccacgtacagcaaacaccaactcagctagctatactctactcatcttctctgccagctgctactacaccaaccagagctaatcaagtaa

SEQ ID NO: 56131 - DNA, 1501 bp, Oryza sativa
atgaaatgatatactaaaattcgcactgaatgtgaaaaagataaagaattgtcagtgattcaaaacctgtcgggccagaagaatatgctctttcgtttgtggcatggggccatcaggagctgatacgacaagaataccaccatccatttgagcagctccagtgatcatattctgaaaatgtgcacattgaaacagagatgtcattggtcattgctcaatattaaggattctagcagttccgggacagtaactcagtaagcctgagtatcagaagagcctactggatttaataattaatattgacagcgcatactacaaatgtgctcagcaatttcataatatccaatgaattagtattacataatatccatggttattgttcgtgaagattgtcaatatataatcttgataacttccactttagtaaaatagaactacttaccttgacataatcagcatgccctgggcagtccacatgagcataatgccttttagcagtctcgtactccacatgagcctacacaaccacaaccacataactcagacttgatctacacatgatgacatacaaggacaccatctggtccaaatgaagaaaaaactagtgctaaggctcaccgttgcaatggtgattcctcttgctttctcctccggggccttgtcgatctcgtcaaaagcaacagctttagccttccctgcctcagctaacacctgcaaagagcataaaaaaggcatttcacgcgttgaaattgtttggactccaaagaaaacaactgaacttgcactatatgtgacaaatcagaccttggtaatcgcagcagtgagtgtggttttgccatgatcgacgtgcccaatggtgccaacattcacatgaggcttcctgagacagattcatacaacaaattcaaaacacaagtcacacacggatcgatcgctagatgctaaccacaggaagagagaaaaccaggcgcggagagcaacggatctgatccaagaaggactcacgtgcgggtgaaggtggccatggacctcgcccacagggttccagccagaggcggtggctgctggggcgccgccgccgcagccgccgacgcatccggtagcgccgtggggcccgagatcacggcggcgcggagggtggggtaggagaggatgcggcgggcgccatggctccggagcactgcggctgcggccatcgcgttcgcgttcgcggcggcggcggcggcggcgctaggtgagaggaggagagagacgggtttagggctttaggagtcgaatggggaggagaggcggccacctcgtagctgtaacttgtaaccaacccgtggaggcgcaaatgggccgtacggcccactagggcccataggcccactagggcccataggcccactcccagtttctcctctgccacaagaaagaaacactgcggaaattacaggtttgccctcgtatcaccacagccaccaactctccctctccctcgccgccggcgcgcgagctt

SEQ ID NO: 56132 - DNA, 1501 bp, Oryza sativa
cgactacaattgtgaaaaaaatggtggcatgattaattattaactcgagagtggtagcatgatgatattacgatggataatatgacacagttatattatataagaagttagcattcaaattagttgtctataagttatttttctatgttgtgtatatatgatttcatacatggcgttttcgtttgttacatacttcaaacctatcgaagcaatcgacctcactattgcatatacatttatatcaaatgaattttgctatcgaccacgtgggctatggtaaggaatatgggtgttaagacccatattacattattttatttcatcctaatgtttcgcgtatgggctattgcagcatgggccgcccgaaggcttggcccatgttgggtctacacctttgcctcttgtactaccacatttaggcctcatggttttctatgactttagttgtacttgtgttgtgttgatcatgtcgcatgcattttttcttagaagcaactactctattgtaaagttagaggggcgtgagtccctaacatgtggtggcccatcgtcatgggcccacatgtcaaaggtacacatcggtccaacgtatgttatgggagactcgtcgcttcttctctctttcatctctctagtttttttttgtatattttgtgccatgcagttgttgattaaacttgtgaagaagaaggggtagcgtgattgattgttgatctgaaagtggcagcaaaataatattatgatggataatatgacacaatctataagaagttaacacttaaaccaatcatttatggagtcatagaagatgtttttctaaggagatgacaaaagcgcacgtatacatgagcacaatgctgatgtacgatttgatttcataccttatcttacatatcctagatccatcgaattttatcgttatgcatacatttacctcgagagtcatggataggagtgtgtgtgttaaagcccatatcactttatatttaattttggaaatacttaatataatttcgttatagtgtttcatccatgggccgcacaaaggcttggcctatattgggtctactccttacctgctacagttagtttgtctttgtactatctcatggtttatgtatttgctcatcggtgggacatcacctaataatcatatatccactaacgattaatatctaggttttattttagagtgtgacttacttcttccgtccgaaaaagatagtaggtttaaaagcgtctataccatatctgataatgtcgatagcatcaactcatgtacaaccaaaataatttatcatgagatacctctattttcagtaacaaccaaataatatactcaccgtggagaacatagaaatcgggtgctcacacaacctccatatttgactagatatagaaggtggagcaaatccatgaattttgtaatagagtaggactagttcataatgtcgggacactaatgttgtattcggttaggtttttttttaagtcctatccc

SEQ ID NO: 56133 - DNA, 425 bp, Oryza sativa
gcagatgaccactttttctgatcgagaactgctgcaagagtgggaggttctagtgaccaactatggtcacgcgaagccggtgaaggagcggtccccactcccctctctcctacacgcaagcaatttgtctatgtgaaccaacattgtcacacgttacgtatgtgccctgtgaatgacctaacaaggtccacaagtaccagaggattatttttgtttgggtcactgcctagtttgctatagcatccacaagcatggaatatatcattccacaaagatgcaagttcaaaaacattttctacaagttttaacaaaattacaaattttctgcaaatatatgtaaactcgttacattttatttattgcctatatattatgcattaatctatcttgtcaaattttttaaatttttttcaaaaccatttagt

SEQ ID NO: 56134 - DNA, 1501 bp, Oryza sativa
catttgttttttcggtcttgaactattagattgttcctctgattcttgatgctagtatatttatttatagctgtatagtttcaacttaatgtgcactgcatatttatgatggataatgcaatgttcatggcttgatgcaaccacagagttattaagacctttgttgatgttcttctcccaaacagcatgtatacaagggggtttgattttcatttcactgttacctttggtaaccaacaattgcagtggtaagtttattaagggttaaaattttccagtttatcccaagcaggccagttatttagtagttttaatccagtgcaattaaaagaagttaccctactactacattttccttcttccactgtgtgattgtttttttggtcgtgtgtgctttggtgtagaagccggatgctttccttttctaaatgaaatccccataatctagtatcagtgtactaaaggaaaataatactacagatacaactttctactatggtataacccgtttacagacgagaaaccgatgtgtgatcgcacgaagataagcacaataacccttttccaccttttccctttgattagtgaatctttatgttattcttgtttttgatgcttttcacacgaagataaccttttctttttgtacagaataaccaaagcaaaagaagagtggttgagtgcatgtcggagagagtgtgtgcctatattcctgaggattgatgttgtggcaaggtagctgggcaggacaggcatcggttccatgctctagtttcaaggaagacatcgctccaagtgcacggtggctgcttttgctgcgataatcccataacatacatcaacggagctgaccgatgtaagaagccaacattaaacactgctagttaccagcagagccaccctgaaaagctgaaagcaagaaaaatctgagagaagagcaagctgacatacatcatggagatgatcctggatgcccttgcatcctacctcggcgagcagttcgccaagatggtgaaagacgaggcagggatgctgcttggcgcttctggcgaggtcgagaagctgacaggcatgctgagcaggctcaagaagttcctggccaacgcggagaggcggcacatcaccgatgccaaggaaggagaatatgtgcatgagtgggtgaggaagctcaaggatgccatgtacgacgccaccgacatcgtcgatgacgttcatctcaagtcggagcagcggcgcgagcggtatgcgtctccgtatccaggcagctgctccaactcctccttgctctggtgcttgcaggatcccctcttcgcccacaggatcggaagccgagtgaaggagctcaatgagaggatggatggcctcttcaagcaggctgaagctgaccagcaggctgacactgaccgactcaaatccagctcaacccctggcaaccctcatagtggcaaccctaggaggacagcccccgggatcatccacgaagacatcgtcggtgacaaga

SEQ ID NO: 56135 - DNA, 1501 bp, Oryza sativa
aataataaatagataatgctgatgattttgatacataatatttgactattcatcatactagtttcgtttattttgttatgacttattttattattatactttaaacattacttatatctttgtatattttacactgaatgtttgaaagatcaaacattatgtaaaaaaaaagtcaacaacatcatctactaaaaacagaagaaatatgctagtagatatattgaaaatcttatacatatatttacttctaatccctctatttccgaatataagtactacgtatgtaccaaaatatattactccccccggttccataattcttgatattttagataatgactcaatctccaaaatatatctttgatcctgtttttctattataatatatacaatcaataaatacatgtttacttttactatagtattttaaaagataaatctatatatgtcattctagttctttagacatttaaataattttaaagatattgatattcaaagttacaaaaaaattgacctcaaacttatccagaacgtcaaaaattatgaaatgaaaccagagagagtaactttttttgggggatggaggtagtatttctaagatttaaattttgtagacaatataagcatttataggacacttcaatgtacatgaatctaagcaagccaaattttcaaatttgaccaataagataactgaaaaaaaatgccttttactctctttgtactcgagatttattttttacttaaacaacctaaaaatgcttatttctatgaacggagggagtaataatttgagaagtgaaagcatgtagttctattttgcatagctctagctctaactctatctcttctggagctgaagtccagccaaataatttttagtccactcacctaaagcactatcataaaataaactagaaatgtgtaactgggtttaggttgtgaaaacttcactacagatccaactactaaacctaaatttagaagttcgaccttaactaattaccaaacagatcgtaccccaccataagaatccctctacagtcaaaagtgcttttatcctccgctgtcaccgtgtcaccgccagtccgccagtcgagagtcgaccaccctctccccctttttccgctcaccgcacgcgccatgcgaatgcatgcatcgatcagcgtcgatccgtcaatccatccaccgctggttaacagtgcgcatgaacatgcgcgggacgggagactccttttgtttgtcactttccgccctcctcgcctatttaagccgtctccctcttccccgcctgaagtttcttcccttcgtcctcgtctcctcgacctcaccacccgtccatccctacctacctccctacggattggtcgccatgctagagaaccagaggcaagcggaggtatgtacctagctagcttagctagcttgacgaggtcggtgtgagatttggtagctcacgtttgatagctgattcgtgtgtttgtgtgtggctaggttc

SEQ ID NO: 56136 - DNA, 1501 bp, Oryza sativa
caacttaatgtgcactgcatatttatgatggataatgcaatgttcatggcttgatgcaaccacagagttattaagacctttgttgatgttcttctcccaaacagcatgtatacaagggggtttgattttcatttcactgttacctttggtaaccaacaattgcagtggtaagtttattaagggttaaaattttccagtttatcccaagcaggccagttatttagtagttttaatccagtgcaattaaaagaagttaccctactactacattttccttcttccactgtgtgattgtttttttggtcgtgtgtgctttggtgtagaagccggatgctttccttttctaaatgaaatccccataatctagtatcagtgtactaaaggaaaataatactacagatacaactttctactatggtataacccgtttacagacgagaaaccgatgtgtgatcgcacgaagataagcacaataacccttttccaccttttccctttgattagtgaatctttatgttattcttgtttttgatgcttttcacacgaagataaccttttctttttgtacagaataaccaaagcaaaagaagagtggttgagtgcatgtcggagagagtgtgtgcctatattcctgaggattgatgttgtggcaaggtagctgggcaggacaggcatcggttccatgctctagtttcaaggaagacatcgctccaagtgcacggtggctgcttttgctgcgataatcccataacatacatcaacggagctgaccgatgtaagaagccaacattaaacactgctagttaccagcagagccaccctgaaaagctgaaagcaagaaaaatctgagagaagagcaagctgacatacatcatggagatgatcctggatgcccttgcatcctacctcggcgagcagttcgccaagatggtgaaagacgaggcagggatgctgcttggcgcttctggcgaggtcgagaagctgacaggcatgctgagcaggctcaagaagttcctggccaacgcggagaggcggcacatcaccgatgccaaggaaggagaatatgtgcatgagtgggtgaggaagctcaaggatgccatgtacgacgccaccgacatcgtcgatgacgttcatctcaagtcggagcagcggcgcgagcggtatgcgtctccgtatccaggcagctgctccaactcctccttgctctggtgcttgcaggatcccctcttcgcccacaggatcggaagccgagtgaaggagctcaatgagaggatggatggcctcttcaagcaggctgaagctgaccagcaggctgacactgaccgactcaaatccagctcaacccctggcaaccctcatagtggcaaccctaggaggacagcccccgggatcatccacgaagacatcgtcggtgacaagattgaagaagataagaggatgctggtggactggctcatcaaccatgacaagaagtatctggtggttgccatccaaggcgtcg

SEQ ID NO: 56137 - DNA, 227 bp, Oryza sativa
agccatctcacgaaattaataggatataatacgtcatcatcctaaatggagcaaccacgtcatctcacgggtgaatccattcatcgatagtgtgtttttgtgaaactaaactaccaaaatatatgtacttaagtgtcaagtgtcaaaatgtgtgtggttttctccaacttaaaccataaaacatatagttttgtgaaatttactcttttttttttgccatacacaga

SEQ ID NO: 56138 - DNA, 1501 bp, Oryza sativa
ggatccgcccctggacggatggatggttaggatggatcatgacgactcgactagtgctggagcacacagagagatacggcaccaacgaatatcccaaggatcatgccaagtgaactatggtgaaagtgatcgaccaaaaatcaagtaatcaacccctcggaacatgcacctcgaatattcgcaccgggacagcaacttcaccgcttgattacaaacttatatacggacacgacgattgcttcggcaaaatgctaccaaaaggtccaaagtaccaccggttcaggcactcgtatactcgtattctacaagcaacgaaaaagttgtaatagcacagaaaaagatggtgataccggctgtatccagaaacggcgatcagatgcaacgcgcacggtatttctacaacccgtataaggagaaaaacactagtatgcgttaacgttatggcagcaacaacttgccaaacctaacatgatccaccggagctccaacttgcgtgcacatctcgcctcggtttcgttcgtaaaatatataaaaagcgccgtctccaacgtgcaggatggcgagccaattggctcctcggctagttcttacctgtccgagctgtgttctccttctaccgttctctcctctccctgaccggcccaagtaaaggccgcgataccatgcgatgcagtaggactcaactgagaccgggtaaaaaatacttttctctacaaaaaaataaaaggactcaactgagcaagtaaaaccacaggcagcgtcgtttgtccccgacagcgatgctaacatggctcgagccgcacatggtggtggtcacccaagacccattttttttaggagtactattattgcgaaactacaaaaagacagccgctacgcacacacacgttttgtttattgcagggaatgtccaaaacgtgactggcttcgctggaagataacccaatttttcccatcggcgcaacgcaagttgaggagcccggcggcccatacatacgctgataataattagtagcctccaataatgcgcgcttatgcgcgcgcgcgcgcgccacacgcgtgttgggaaagggaaagcaaaaccataattaccgtggcaatagacagcgatcgtggctgttcgtgacacgaaagtgaaaacgacgttgacgtcgccggccggccggccagacaaacggcatgagaatactctgtgagcctgtgttgtgagttgtgacgaggcaagcaagcagggaaaggcccaaacacaaacacaaacagaaaggggagggagaggccacgtcgtcagccagccagccatttcaatcaccagttgctttaatttcttttcctcctaacaactacgcttgcaaaggcacctaacctaaccaggtgataacttgtccttgcaaatcactatcatctacatactccagtacaaatagcctcctaacccggagcctctcgttaccgagagagagagagagagagagagagagggcagtgcaggtgtcgctggcca

SEQ ID NO: 56139 - DNA, 1501 bp, Oryza sativa
cgtcgccctagtcttccgctgtttctcgtttatctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagaacccccttgaccctaggacgagccgtagatcccaagccttagcagtattttcgaaataaaaatcctctgttatttgtgaaaaccctctagtctttctctgtcttgctgcttcatttatcgccaaaatctgacctttttaaatgttgcttttctttttgtttttgttggtagatggccggcagcgtcacccgtcgtggtttggacatgattggtttcgtcttggagctgcggggcatgtgcgttgtcctggggtatccacatggagtggactaccagggcaggccgcttccggagcaggagggtgacgatgcagagccccacgctgcttgggaggtcactgcagtgatcctcgctggctctcccgagcggacttcgctggcagtcaccgcgggtggagattctttccccgccgcttgccagagcgccgctctcctcgccatcggcactcttcaccagcgctacccggacgagttgcagcactcgccctaccgctaccaccctcgccgtggaggagcccgcgactacgccaccttccgggatgctagctcggaggatgacgctaccatcatgcacctggcgcgcatggtggaggcgtacgacgcggctcgtatcgacttccatcagatggtgcaccctgggatggtcgagaacaacatgaagatcctggagctgtgtcaagagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctctaggcccgagctttttcgtcagtccctggcgtggacttgcttcgtcgagacccctcgtgccgagcccgcgcccatggttccccaggaggaggaagcctccggcgttggtagcacggaggatgcgctattgctcaccttccgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtagtcgtggatggttagctttaattgtcagctctctctgtttgctggttctgtgtggggttttcagatggtgacgaccaggagaagtgctgccaccggtgatggcaaccaacctgaaggcagcaacc

SEQ ID NO: 56140 - DNA, 373 bp, Oryza sativa
atgttgtcaatcattcagtttctgatattgttgtcgaacaaggtaagctgaaaataatgcagaacaaacttgttcgtgacgattcatttaaaaagactgtttgtgacttgttactaaactattaaagcgcttttgctaggacttggttatgagagatatatatatattttcattttccatctttttgttgagttagtgcaaatccagttctttccttggttgtgaaaagctatgttaacttgttaagaagtttgttcttgttttttttaaataaatgagtgacactcttggtgcaatatgcttagttatctactgtactcatgtgatatctgtaggttatctccaatcactttttggtatatattcaatcaga

SEQ ID NO: 56141 - DNA, 1501 bp, Oryza sativa
catcagtagagttccaaatggagagacttagcctactagccgcttggcttccaacattgcttcttttacttgcaacatgtgcaatttttgagctactgtgcatgcttagccatgagctttccaatcagccattgttgccttgttggagtgatactccgaggagtccccatctgaatgttttgctcctgttattacttgtgcaaactagatgggggaatcccatcccatatatgttgaaagaaagctactgtttcatgatgtctgtgttggctgtaagttggaaatgatgatatcaagtgaaaggaaccaaactgttctgtggtctgaatatctttgtgtgtactgacttgtccaaagcttggcagttggcacttgcccacttgcccaactacgttggcaaagtctagtagttcctatgtgatgtgctgactaggctgacacgtcgtccgttgtttagtttgatgtggcacatcatatgcctcttgacattcattttctttcagtcagtcgccaaatgctaccttacagatatacagtactgggcatccaagtatgacatgttggctgaagatgtagaaaatattttgagttaattttcacaaagaaaacacacccattgaaagctctttcaaattgactgaatttaagtgaaatcacaataatctgatttgggacatgcaagatgtacttgtcactggacagaaaccaaatcttgtcgcattagcaaccaatgcatttgtaagagaagcaattccatccacacatttgttatcgacatccctatctgacacctatctctcctggattctccatgctttctttcgaccttgcatggcatgcaagcatggcacctctctcccccaccaatctactaacaaagttgctctcaagatactatgcaccacaccctacggaatgaatgaaaattctagaacaacttaaccatcaactacctactgtcttacacataatcactatcaactaaacacttaaatacatctcatcaatgcaatacttagactgatttttgccgggtcaatacttgggactgattaacaagataactgaaactatgtatttatgcaacaacatttttttctttaaaagaaaaactagagcaatactgtatttgccactgctgtttgtagtcacaagaaacactaatttgcaggagagagtaatcgatgtgtacaaattgcagtcacccaattaagttaagcgtttgatcgatgtgcggtgtctgtgtccctggctatataaaccggcaggcgaaaaatacaccgggaaaccaagcctctggttggtcgcactcactcactcgcatcctctcctctcaaatactcctccaccttatcatcatcaccaccactaacaacaacgccactgcctgaaccaagaacactgccctcctccacacgacatggcttctcaaggtcaaaagaactgatttgctgtttatttcttcaattctttctttcttgtttgatttgctccggctcaa

SEQ ID NO: 56142 - DNA, 1501 bp, Oryza sativa
ggcgaaactcaacaaccaggaggaagtcctcaagctgctcgagaagcacgccttcgtatagaatgaaacaatcgaggccaggccaggccaggccagccacactcctctctctcaattcagagacaaatgctgcatttctgctctgcatatgctcctgttcatccgcaaatgagtacctgtatgcttctgtatgtatcgaagagtgcactagattattttttatttcacttgggagcaaggttaaggtgagattggattgctattctattcatccttccagagttttgtttaatgaataaggaagaaaagtaaatttcatttcagtgtttaactgtttatgtctgaatttgacatctctcattggatttggatccgtcaaaatgttggacttttaggccttgtttagatgccttggtaactgtcacatcgaatatttggacatatatatatatatgtagtattaaatataaacgaaaaaaataactaattatatagattacgtgtaaattacgagacgaatcttttaagcataattgttccatgatctggcaatatggtgctacagtaaacatttgctaatggcggattaattaggcttaataaattcgtgtcgcaatttacatgcggattctgtaattagttttgttattaatctatatttaatacttcaaacgtgtctccgtatatccgatgtgacacgtcaaaactttacacctctgaatctaaacacagccttaattccaaaaaacagattcaaattgagtagggatgcttccaactgaaatagtatagctatcctatttggggattgagatcctatgacgttactgttcaccgtaactgacatatgggtcctactactttcgggctcacatggtcctactattttcgggctcacatgttagccaccaagtcagagggaagttacgtcggaggatctcaatcccttattcgggggcgtttttaattgtatccttcaactctactactctacggccattaccgggatgccgtcgacacgccaccgccaataccatcgccggcttccatggcgatggcggtgggggtagcgcggctggctccgggtgcgtggaggcgctgttccctgtgatcccccagttgttttgggggggcgcgcctcttcacggatccagcggtgcatggtgtgattgtgggaaggctggccgcgtcgggcatgcacgcaggttgttcgacggaatgagtggcgtgattgcaatttgcagtttgtcccttttgacatatgaactcttctccatgatttcattgataaaagaatttgatcttgcgagtatttaaaaatcttcttgcgtacgagatggcatcttctccgttggctctgatttttaaaaggttccatcttttccctcccatgtagtagtacatcgtattagactaaagctgtcaaagtctcaatttgtcccagtttctccctgtccacttctgtccgattcctcctcacctcttatcgattggacgacca

SEQ ID NO: 56143 - DNA, 1501 bp, Oryza sativa
gatgctggcgacggcgaagaaggcggcgccgaagctggagacggcgttcagctgcccgttctgcgaccccggcggcgcggtggagtgcagcatcgacatcaagcacatgatcgccgaggcctcctgtttcgtctgccaggcgcgctactccaccaccgcccacgcgctcaccgagcccatcgacgtctacagcgagtggatcgaccagtgcgagctcgccaaagccgccgccgccgccggcgacgacgaagacgacgaccaccaccaccaccaccgcaagaccaagcgccgcagttaagctaacttagctgacggcggcagaagagctagcagagatgtaaccgtgctgcaattgatttgtcggacaattttctctggctcgaatacagtaattattgtgttgtaacttggttttaccattgtaatcgctgtggatttgaataaaattcagtttgttgggatttgttgttcatctccggttccctgaacgtgtattaggagaagcacttgagtacgcatttgatgtaaacggaaaaaaagaagataatagttgtatgtgtgcaactagaaaaaataattatatactcccttcgttcctatcccaagccaaatttattcaagttattaaaccaaagattttcaaaaaaaaatatattaacatatagaacaccagattactttcattaaatctacgaccgaataatatatatatttataacttgaaaagatgcccgtgtgttgtaacgggtgaatgctattataatttttttattattgttatacggtttggctagggtgaaatccactgtgggaattcgcttagatattttttttctagaaaatcatgagctgcaattaggagttcaacattcatctcaagttagcatgcaagttttttaaaagggatttcttatatgacttcttttgtattttcaaaaggaaacgaacttaaaatccgactaaaatacgaatttgtattttcaaaagcgaacgaatttaaaatcagctcaaatacgaacgacgtaccaaaataccgcaaaaacaactttaatttttataatagtagagatatatctgttttgtactacaagagttgctacatttttttttgaacttgttgctacattgattaaacttgattgagaacaaaacgaaaacgttttataatacgcaacagaaggatcacgtacaattccagtttcaaataaaattcgaacgaaattctaggcccatttcgaattacagccctccaaaatttgccggtgaaatcatcttgggctgaatcttagtgggctaccagttgggctcaacacagcccctctctctctctctaccaactcaaaacaaaaaggaggagaagcagcaaacgcggccgcacccagcgtccaccaccaccccttccccctcctcgtctcccccgggttcgatccggcgcgcctcgccgtcaacccacgcggcggcgcggcggcaagttcgccgaagccatgccgagctcgcagaa

SEQ ID NO: 56144 - DNA, 195 bp, Oryza sativa
attttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataa

SEQ ID NO: 56145 - DNA, 1501 bp, Oryza sativa
tactccctccattttataatgtaagacttcctagcattacccatattcatatagatattaatgaatctagacacatgtatatacctagattcattaacatttatatgaatatggataatactagaaagtcttacattatgaaacggaggaagtagaaaaaaagaaagctaagatgcaaggagaatgccggtccatcacgtttgccatctaggcagcacactctaccagaagcctgaatgcaaagtatgcaggcaacctacccatgcagagacaaatcaaacaccaaaaaggtggcaagagatttcaaagggagagacaaatccttcttggcacgggactgatcatggttagtggcggcagcagcatcagcagccagtgattggtactccggatggagtactaattaattagctggctaacaccaatatattgcttctttctcaatcatttttcttcggtttaagtctctctttttctctctctctctggtgctgattgcaaagccactcacacgcaccacccataatgtaatgcccacccgaaagtccccacaaaatcacatggaagtcgcctcttcccaatcacaaagcatgaacaaaaaaaggagattgttccacagctcacaaaatcagctaaccccccttattcctgcctccctccctccagtaaccaaccacctgtaccgggcgcgaaaggacgaatggtctctcgcgctcggttagttcgttcgatggtgtacaatggactgtccagatcatcttaagacggcatttgtattgtcctaagtcgaacaaatggtatactcccttggtctatcttgaccacaactccataccatatgcatacatgccttgaaactgtggttcgctatcctgatatcagataaaaatcgctcacgagcagtatcttcggattttgtagaaaccattgataaaccaaaagaaaaccgatgaaatccgaacaaatctggaaaaaaattaataatccatttttattttaattttttaacttcacacaaaaacccgagcggtttatgttttagacatggtccgaaaaaaccagatttcacgaaatcagaaccggttttctcccgggataataaacccctgctgggaacaaatatccatatcgtcgcaaaccgaccgacgtatcggacgatctcgaccgtccgataccgatcgggcggtgcatggtagaggacccggatccgggaggaacagtgcttgccgaataccgacggcacgaaaaggtaaagtgcacacatgatagtgcattacattgctactactacatgatatgcattacattacacctgtccccagatgcgccaggcagacgggcctcacgcctcctcacgggctcacgcggtcacgcctataaaacgcgccacccctgccctttccacgcatcatcacatcatccactgctctgcttctcctcttcttttcttggcttgtgctctgttttaatttctttgcaatgatggggaggcagagctcgt

SEQ ID NO: 56146 - DNA, 382 bp, Oryza sativa
tgattattgatgttttcttgaaaaatctttaatacttgtggtttggtatacacacacacacacgtatgtatgtgtgatgaatattttagatgtcaacactttcatttttatttacttactacataatcgtgtggattagtcccctataagaatatcataatgaccatgtttacccctcttatgtagcaatatgcccatataataaggatataagcatggtggttcccctttgtattactcaaaattttacaccccgttagtatttaaatgtgtaagatgctttcatttttcactaaaagcactgtaattcaatactgtatttaagatgcattacaatatggagtatcatttttcactaaaagcaccgtataattttcatgct

SEQ ID NO: 56147 - DNA, 583 bp, Oryza sativa
tcaatagttctctagaatcttgtagaacatagggcagacctttagttgggaaaagaattgtctaaaaaagacagcaataaattgcaacccacaatgcttggatttctaccctgtcagcaaaaattcgaatttattttactattgtgtgttattttttttgaaaaatgatggtgaagcaatctcaatctgaagatgactttcattagttttcttaagtggctatctccacctcaaatttagtccaactatgtcaatgacttggtcacatttggaatattttgaaattgttcataaaattgttagaccacattacttacaaccttaattttatagcgtgaggatgcaatactggtaaaataggatcaggaattttggcccttttctttttttctagactgacaaaagctaggaaactgtttccactttccagcttgttgatacattgtcgaatatttatacaggcagaatagtacatttattgctggctgctatactttttgttcttgcttctgatagtttccatatagtgatgcaataattttttatcatttcttaacatcttattgtccttgcatcatgtaga

SEQ ID NO: 56148 - DNA, 1501 bp, Oryza sativa
tccacaaccgattacatctcgtgtgttgagtcttacttggaaatttctaggcggttgctgtatctcgcagaaatataacttttttgttcagattttaaaaagttgtaattcataaaatgaattaaaagctataaacctatttttaaattttttttaaattgactacgaaccaattactcctctaaacatgctcttggaatagtctctcccatcagaaagataagcatcgtgacatcatatcactaaatcagttagtgcgcacgattggttggtgcagtgcatgcatgtacgacgacagtaaagaacaccacaagtcggctagcctccactaggccaggcccgcatagacgaacggcccatgtaaggtctgggtaaggctgaactgtaaacagttttgggcttttgatgggtaagagttgtcctggacgtcaggtcgaatgggctaggtcggttcaggcctgatgcactaccaggccctcccaatcccggcccgttttcgctgtgaaatttattgattaccaagtttttgtaaaatttgtatcaagttttaagttggactttaaaaagtacagcaacgctagctcatgcgtttaaagcttacactgcaagtgttagccttctagattgccaaaatatttctcaatccatacatgtaagaaaaaattacgttacgaagtactccctctacctcaatttgatcgtcatctaaatttttgatattttttaaatgatcatctaacaaaatacttatttgttatttgtgcaaagagtaaatttgcatcgcgaaatgccctaaatgcattcaactaatcaatattattttctattggtttaacccatgcaatatttaaagtgttaattaatttttgttgaacacgacgggacaccttgattgatgaggattaatatcagaatgatggatgttttggtgccttttgcttatgggataatcaaattgggatggagagagtacaaaccaaatcgatcacataagcacaaaacaaatactgcaaatgcggaagacacatatttcacatttgtgtggttaatattgcaacaatcaaaatatctatgttgaaatcatttttttcacaaatattagggtgccttctaacctggttaagatgaaaattaagtgtagacacacaaaacaagaaaaccattagcgcataatttattgagttttaattatttcaaactaaaaaaatcatttgaattttaaatcaacatcaacttctatatataatttttttacacgaaatatatcgtttagcggtttaaaaaacgagctaacgaaaaccgaggtaaattatgtcaatcataatattggaactaaaactatgagtctatgacaactctcttaaaaaaaaaactagaactaaacagcttctttaatttgaaagcaagcaaggagagaattggagaatgacacttctgcaagttaggagtaaaattataatggtatggttccaaattactttttttttcctgtcctctcctc

SEQ ID NO: 56149 - DNA, 229 bp, Oryza sativa
tagctgccagcctacactgcctaatgcttggtcaaaaaattattatcacttggttatctcatttaattgctaccatgaacatctaatctgccaattgcataatgttacttgatgggattgacaacttttttttttcatagtttgggctgcaaatgcttccagccattccattcagacacaattgtcaacttttctcacacataaaatatcattgtttatttttgtcagg

SEQ ID NO: 56150 - DNA, 166 bp, Oryza sativa
tcggtgtggcatgcatagcagtttacgtggattatgcatgatttagcatttgtcagatcaaaaactagtttctgcaccaatttgttactccctccgtttcaaaatatagttatgtttggctacgaatcaatccaagactgatctgaactcttctgaacctgaacag

SEQ ID NO: 56151 - DNA, 417 bp, Oryza sativa
ttccctataaaaggcagacattataacaaaaagaagatgtggataaagagaatatcataaatcatatgtcacctcacatcacataaataaaagaaaaggagaagaagaaaaaaaatattaatttaattcttttttgctctcttttaactcctctgaccagtgacccaccctcaccttcttcaagctccctcctctgaagcctcttcttcttcctctgattcctctctccttccatcagcttaaacctctctctctctctctctctgttgtgtcagtgtgtgtgcgtggcttcgaagagcaagaagctagagcttggcgagcgttgacaatggcggagcataaggcggcgaagagcaagtccaagtcaaagagcggcggccatggccatgacgcggcggcggcgtccaagaagtcgaa

SEQ ID NO: 56152 - DNA, 334 bp, Oryza sativa
ttaaatgtaagctacaattatactacatttacatttgacaaaatttttagaagaaaatttgtcaacaaatatatactagaatcgttttttttatctgcaagaattcattcgagttgtacacaaacttgtgggattccatcccaaatgggcctcacacttctcatactgggcttaatttcgaagcccatgtggcccggcccaattaaaacaagcccattacatcaataaaaagaaaataaaaaggaatttcccgaggttttagatctcgcttcctctcctctcttcctccaaaaccctagccttcctcctcctctcccggcggcggcggcggcga

SEQ ID NO: 56153 - DNA, 389 bp, Oryza sativa
gatgttcaaaggtggcttgccttgctcgagatctggagcttgatcctcgaaattctcgcactgcgggtcttcgggttccggaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaa

SEQ ID NO: 56154 - DNA, 243 bp, Oryza sativa
agaaatttgaattcaactcatacaagaaacgtattcaatttcaagctgtgcaataatgcatctatcttaagcaaagggtctgcatcatagtactgatgcatgattgaaacagctaagaacttgatcaaattcaacggtttttcgtgatgaaagtttaaatccagttcatacaagaaacttattcagattgtttgatttaaatatgagcaacaaggcgtcgaccttaagcaaaggttgacatca

SEQ ID NO: 56155 - DNA, 323 bp, Oryza sativa
tcagacagcggccattgcagatctcctcccattaatgaagaaatgacagggtgatcccctgtgtccgacgagtgacggcgctgggcatcactcaaggacaagcggtgatttagcttccaggcggaggcgcgagtgaatatttggtcaagatagggtgggtccccacccaaaagaagagtagatagaagtagtgcatgtggtatccccttgagatataaaaggaggactttgcccacctaagaagagaaaaaaagaggggggagagagaaaaagaactagaggagaaggaagagggggagatcgagggagaaaaagaaccagag

SEQ ID NO: 56156 - DNA, 837 bp, Oryza sativa
tatacatatgtttttttatacatatctatacatatatacatatatacatatatacatatatatacatatatacatatatatatatgaatgtgggcaatgctagaaagtcttatgatatgaaacggaggaagtatttatctggttagatacaaatcatgcttgcctgatgacttgcatttccaacatgtggttcattgaaccttaagcatccagtcatcatgtaaccacgggaagttggaaaaataaaaggattggcaacaacaggagagcatggctaaaaggcagtatctacttccagtcaaggctgactgcttaacctttctcccctttttctcatcctatgttcacacttcccacttcccagtagttagtagtatttaatcacctggctgaagattgtagtgtacctgcaaacaatttgtttgggtgtccttgtccctgatttattgggggaatggatccatcataacttagtttattgattaggtggttatggctgcatcgctttatgtctcatctattgtagtttaagcgcatagtgggcatgaattatgttgccttttgtttattgtccattattatcacgatcgattaatgttgagtgggaacctaaataatccatgattaagtgccactcagagcagcctctagtgctgtcgggcatgactttatggtagtgtgattgatctaagcctgtcttgcccaatcaaactactattacagcctgacacgattgctgttactggttgtctgcctacctgtgtagcctggactatcttggagcgtatggtgacaaagttcttatttttggggatattttaagattgaaacaatata

SEQ ID NO: 56157 - DNA, 340 bp, Oryza sativa
  unsure (1)..(340): unsure at all n locations
gcgatctaaagtatctaactgctcgatacatccatgtcttcacgcgataatgtcgacggcgtctgagataagatactgctatattacgctggctcgccgcaatcatcgcgggcattgcgggcgatctctgccgctatatatntgcaagaaatatttgcattcctccgncgatatatatttccattccgcgatctccggtgatatacattgcaagaaatatttgcactcccccaacgatctcacggtgacacaagaaatatttgcaatcgctaataataaacgaataaatcaaacacacactacacactaccatcatcgtcgcgtcgtcggtcgtcacagc

SEQ ID NO: 56158 - DNA, 443 bp, Oryza sativa
gcaccttcttagattatgattcctttatcaatcagtaaggtggcttgtatatagtggcagtggaaatgtgaattggatcgtctggattatcataaattgctatggagaatagaataaacaaatagaagtcatgatgccatgtcaatatgtttgttcatcattcgggtcatcaccttatgaacctgaagtctccttttcattgccttgtcatcagctaacactgcaatcaacatatttccctttgtacaatttattatgctggagtccaaatgtagcctattgagaactggaaatgactaggaaactattgcctgcaacgctcttatcctgctatcactttcaaatttagtctattggataccttatatatatgtgcgtgtgtggcctagggaacacaactgcattagcagcagcatctgcatttccatgctcatagttagaca

SEQ ID NO: 56159 - DNA, 1501 bp, Oryza sativa
gactcccctaggttatggatgaactcatcaatacaatcctcagagtcgtaggctatctccctcacctgcttcatccagatcctaacttggtcgtcatgaatctgtgatatggtcagattgcgtaggaatgcattcatgcactcgagctcatccttgatgtactgtatctcaccatggacaccctgcaccagccaagtatcctcagttagaaggcagccaagcttgcacagcaggctcctgactgcaccctccgtcaaactgaagacagcaccctccatatcttactatggagcatggaaatggaaacactgctgctgttgaagttaggatgctcaggttatatttgtaagacatttggttagctaatggtggaagaataagaacattccagaattcagaccatggttttcctggtcaaggagacatgcaatgacaaggagacctgcggttcgccgctgatggcaaacagaaccctgaaacatgctgacaaggcaacttgacttcatgtcttacaagcctgataagcaaataatagtattcctgtggtgcataagaatatcataaaaagttacaactcatagaaaaagtcaatcagtacggaaaactcattgctgtatgtatatgtaagaggccaaaggcagcttaaaaattggtaaaagatccagtaatacttagagaaggtataaaagcagtggggaagagtatgaacaagtgataccctaaggtttgttacattcatagctggatgaaagggtgatccaaacaagtacccagacaaggacaagcagcactgaaaagaggacagaaaacagctaggtaactctgacattttgacaacacaactcatacgtgaaatggaaagaaggcggtataggacaacagtcgtatttttgtgatgaatagcttggtaagattggtaaagtatttcgcccgccttcttacatctgacctatgagattagagtgctacttgttttaacaatgtgaacattgtacaacaccatatataaagcagagtgagaaaactatggtagcaataagcagatgaacactaacataatcacagataggacgtggcgacagcaaagcaaggtttagttaataaagatgaaatgcaagtcaaagtattgaagcatattatatataaataatcaaaactgttagctagtgtgacacaatgaactgtaaaggcatatatgcaagtgaagcgaagttaacatataagagaatagtgcaggaaggcaacaagctactcgaggtggttccatatactttacagcttaatatgcaccgatcgcaattgcacaaataagataacaatggttaaagcattgcgtgttccccttgtaattttgtataataacctagtactagtcaccttgaaagaaatggcgatgtcgacataaatgcagaaaggcaatcaagcaaccattggaaaaacaggcacagttaccagcatcatcttgactgtagtgtttgactctcttctttttccccttaaa

SEQ ID NO: 56160 - DNA, 1501 bp, Oryza sativa
ctaaagattagttttgaagactgtgccaactttgaccacgttttatattaccggatagagagagtacaattattccttactttcacaaattccgatgcaatgattactctaaaaatgaacttatcttgggacaaataaaatgagctaaaagataaacttaatatgggacagaggtagtataacatttgggctatcctctcatattaatattttttatacaaatatgtaaaaatatgatgcttaaattacttttaaccacaaaataagtcatgacaaatatcaaatgaatggtcggacaccgtggtgaaaagtcaacgacttcctatatttaaaaacgataatagtaccagtagtgaccatcaccctatatcattgcaatactgtgtggagagagagttgcgcaaaaatatgccatccgaagacaacctaaccatgtaaacaatttcacaaagaaacgaatggaatcgagaggattccccgctcttacaagcaaggtaaatacaatacagagttgtactttcaactactcttgacaaaccaactcagcttgtcttcttaggaacacaccctgaaaaactatcaatacatactgtccagctggttacactacactttctgcattgcttgaaataagcaatgcaaactacttcccaaaatgcaagcatttctggctttaagcctagacaagcttgactagattcaaagctagaaatacttatatttcgagatgaaggtacaagcattgcccaactagctagctgaacctgaacaccaaaaccaaacaggcctctagaagcaatgttgtttagagcttgctccttaagcgtactccgtcacattgttccatttgtcacctatcactctcgggcgatttggatgtgccttcatgcaggatgccactttagtcaccatggataatatgatgtcgccaaagaactctatctccttcagcttcagcagattctccagacctgtaatcccatccttgggttcttgcaggaatgctattgtcagccactcaaggttagggactgagcccttctcgaagtgcacattgcgaatgttctccatattatcaataaccaacattctgagcttcaaaaaattaccatgagcaaaaaatatatggtcatcagcgtaggacctttggtagagcttgagacagagcagattgggcaggtctccaagaactccaatggcctcagcgtggagtccagtgtcacgaaaagtaatcctggacacatttcgaagtgatggtatccaaggaggaagcctctgcaacttgcctttcaggctaaaatttctgatgaatagaggaggcgactctgcgataagagctagatattccagtgatgagctgtgctctttctcatccagaatgtgaatggagagcgagcgaagagatccagtcaattttaccagagactgaaggaatgcgttccagttctcttccacaccgcgaaacaagacattaagtttctgtaacttttggagctggcca

SEQ ID NO: 56161 - DNA, 422 bp, Oryza sativa
ttattacctgagcagacatagagaagtactgcccgagtaaattatttgaccacacgtgttgtgccatttttacgatgtttgcattggcacccagttaatgtaggcggccttcacgacaatctgcccatattaactatttacatgggataaagaaaatgttcacttttatgttccatgtcgtcgaatttcaaaatcacccataaatcaaaatatcggatataacacatccataaccttataaaatcatatcacattaggtctcagtgttgagtatagttttggatggcgtgacataaaaaaataaaactcacatagaacctactcctcgggctcttgatcagagagccttagaaatttgtggtggtccagcgaacccgtcgtcatgggtgtcagcctccgcctcctgcctgccgctatgtagc

SEQ ID NO: 56162 - DNA, 1501 bp, Oryza sativa; identical to SEQ ID NO: 53407

SEQ ID NO: 56163 - DNA, 1352 bp, Oryza sativa
cctcgcgcccacgccgtcgcggtgcccatagtgcagccgcagcatcccctggcgcccacgcatggccggtcgttccccgccgccccgagggcggtggtggcaggtgtgtcgtcgcgccccgagcagcctccccgaggagtccctatagctcagcaagcacagcccaaggttagtgactaattttagtctgcgagctttgcaaggaaggggaactagacgagaacttgaagtcttgaacgttctactctctagagctttttaattaaacgctacttgtagatttcggtggcgatttatggtagattttggaacttattacctgttgggcatgctacgtttcatgtgcatgttgaattgcttagtgaacttatatttggtaatagcacaatgctacttctgaggtaaattaggcccatgtgaatggttccgtactggatttagatcttgtaaaagcgaagacacgaattcatgggtttttttattgttattttgattataaatggtgctggtctattttgggtgctgtgttaattaggctattccttattgataaattctggacttaaatattgtgaattttgaagttcccttaaattatgcttttctggcatctttcttaggtcattccactaccagctgtaactccatctcctcaagagatcaacaactcaaaagataggtaagaaaactacaaactgtagtgtgttatctttttcttttgaggggatatagttacaaactatagtgttttatcttttggacttagacttcccaactgtcaattttgattgtttatttgtagtgaaaggagcaaggaggactctacaacagtggttattaatgaccgtaaagtaagtttatgtttcttaaacttttttctagaacatttgcgctgtgttaatgcaaatacattggctagatgaggagaatacctgtacctttggatagttggaacatgcccaatcacttttgcccattatcatgaatctttgggataccagttatggctcaccttagacgttttatatgatacaaattctttttctttgctctgattagtgacactatttcagctcctatgataaacatgattttgtttggtttaacatttaccaaagaaatttaaaacgtacggctcttcacaccttattttttctgttcatgcaaatgcaaattgcttctatttcacaattcattttcttaattatccaaatggttttgtagatacttgggctacgaggctgaaattctaatttctaaatataattggcccacatatgaggaacctcacaatataatctataccttgttttatcccgacagatcaagtggacagcacaaactgacatttc

SEQ ID NO: 56164 - DNA, 400 bp, Oryza sativa
gcctatttgctttgttcattcttgttatttttggttattgattatcggtgtgtgaatttggttttctttatttgtttgtatggacagttggtccttttttaattggcaggaatgatgaatcaattagatgtacgaggttaccttatgagctaaaattttgaggcatacaattgtctgacttgccaatctactgttgtatttcagtgtttcgttacatgtctgtggtccatgttctcttattttcaattgcctatgtatgtgcatgcttttatttgacatgctatttgcaacttttcatgctgtacataactcccaaggggtcatgttttatatttctgtatgtatcttggactgtaaaaaaacaaattttaactttgaccgaccttgttatttatctaca

SEQ ID NO: 56165 - DNA, 459 bp, Oryza sativa
cattttgcaaaggcatacttgtgttaaaatttatgtgctccatggttgtgccttggactgccaagttgccatctgtgacataacttacagcacttattaaaaaccttttacatagtatcggggcaagacaatgtcaagtatggtagaaatactaagctgctgcttggtttggtcagttttggcaacaataattacacattgtaaaatcttgaaaccacattgtgggcatacaattttttttaatcttctgactgtttttgtattgatctcacccaatttattgtattgtgatcctttaatgactttatattgtgcttgttgcaatggaatttgtgtatttcctgctttcctaataacagctcatgcacaattggcattaggatgtgcatgctttatatatatttagccttatttaatttgactttggagaaaaatattttttccctcattccttgctct

SEQ ID NO: 56166 - DNA, 1501 bp, Oryza sativa
acggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaaagagatacatatgagagatggcgaccaattttaattgggtcctatcatgttggaggaaaggccccttcataaaactcaaatgataagcctgtttctttaacgtctcaagctctcgcgttctggcctctgggattattcctactaacttcatattttaatgtatgatgctgttgactttttatccaacgtttgaccatccatcttattcaaaaactttatgtaattatcatttatttttattgtgacttgattcatcatcaaatattctttaagtatgatataaatatttttatatttgtataaaaattttgaataaaacgaatgattaaatgttggttaaaaagtcaacgacgttatgcattaaaatatggagggagtccttttgcagcaggagttgccaaagaagcagttcaaagctgaacacctttcttcgtggagggtgcagcaacccttccgagctgcaaaaggtgcattcatggggtcgtcgctggaggcggagcagcagagcttgatagtgcggacgacagagccggaggtactcccacaatatccacacgaaaaagaataaacttcttttttcccctctttgttccaccaagattcgaggattcgtagggtttcccaatcctctttagtttcttgttttggttatgttccgatcgattgaaaatgcttaaattggcccggatcgtgagaaaaggcctagcaaagaaatcgtgagaaaagggagggggaaaatgatggacagctcgattgctcagttcttggattcttgggatcgcgtagagcttggtcagattggcgtgtgacacttcgattagtcggttgcaaaacgatggccgtgagtagagaaaggggaacggggaaggtgaaggtctagactctagaggcgcagtgatgactgacaggtgaggcccacaggccacagggtcccgctcataaagacaatcattttttgatgtactgcttagagccttgatgcaccttgggtattatgctggaacacgcaacaattttgaggatttattggattgacacgtacaaattacttgtggaagttattttctctgtgaaatttgattgattgtctgcactctgatgtcatttccttgaaaaatctgatggttactttgacctgtaacttttaagttttgatttctttttggatgggtttgaagattgattgaaactgatggagtgaaatgcgttaaacatgtttgacaaaaaca

SEQ ID NO: 56167 - DNA, 178 bp, Oryza sativa
tatatgtatactacatatagttttacatatttcacaaaaatttttaataaaacaaatatttaaacatataattaaaaagttaacggcgttaaatgggggatttcttcatctcattcgtcttctttgacccactatcatcgattggatctcctcttttatgtgtcgtcgcttgactcgc

SEQ ID NO: 56168 - DNA, 379 bp, Oryza sativa
gtgagcatgccctccaattgcccgtttcatgcttcaaaataggttgaccactgaagcctacagatccatcgcctgtgtagtcatcaacatcctacggagagaagcaaagtactagttgattctaaattattcatgtttttgtcaaacatgtttaacgcatttcactccatcagtttcaatcaatcttcaaacccatccaaaaagaaatcaaaacttaaaagttacaggtcaaagtaaccatcagatttttcaaggaaatgacatcagagtgcagacaatcaatcaaatttcacagagaaaataacttccacaagtaatttgtacgtgtcaatccaataaatcctcaaaattgttgcgtgttccagcataatacccaagg

SEQ ID NO: 56169 - DNA, 687 bp, Oryza sativa
gagaaatcagatcatgtacaaaaaatttacgtatttttagttcaatgtagagcacttatcttacagatttcaagtgtagtaagtgtgtaagcatgaactttgcaaacagaaaagatcaaatcttcagttcagaagaaagaaacgacacactgcagatcaggaatggcttggcatggtttctagttgtgctaatctagtcaaacaaccagtcaaccacaaccagtttaaatgcaaatgttgatacagagtaaagtgattaccgtctggagggagcaagaaactggccagaacagaagctagggctgtgatagtgtaaagttagttgctttattcattgcagcatttatatgtttcagtttggggtgtcaaaagcaggggagttaatttatttgttcagtgatccataactgtgacctgcacactctacacatcctacttactaccacagtaccacagataaagcttatacatgctcctctacaacaacattggtactaaatttgtgcaagattattcctttgacattatacagttaactactcgttcagataacagttaaagcacagaaaatgacagagagagaaaaaaaaaagagaaggctgaattgctccaattggttctttggaggttgcaagggccaaccgaccataaacactattggtaagtaagagcattgttaagcaccca

SEQ ID NO: 56170 - DNA, 210 bp, Oryza sativa
tggtatgcatactgatgagttaccattaataccatgtaagctgagcttttgagtcattttcatgccctgcccaatttcagaaactgatttttctccaattatggtccatgcaagaatgcttaaaatgtgctatgcttaaggtaaagtttttagtgctacaactgtatatacaccagaagactttcttctgactgacctttctactgtagg

SEQ ID NO: 56171 - DNA, 151 bp, Oryza sativa
aagaaaatgtagttttctcaatatttgctacttcagttctgattcagcagttcaaatcacctaattaaaatgttagagagatttctttgaatagttctgttaacatcacactttgctgtgacttttggttcttttctttttattctgcagc

SEQ ID NO: 56172 - DNA, 1501 bp, Oryza sativa
actgaaaatctttcagagactaaccacaaagttactaataatactgacaagaatgggttgaagaaagggcactttgcagtgtggtactaacagatctatctattttgatgattttaagatatagtgatcagatttgcactagatttcagttttgttgctcattgattatattttttttcttttttacaatagagttgaagttgatatactgtttggaacttggaatcaataaaatgctggtccggaatgtgacttttactgaagttattttgtatatgtttcccacataatgcagatccaaagctccctagccttctaaagatgttaatttggactcaaaaccaactggacgaaaaggcagcatatccacgaatcaacaatttctccactgccgcacttgaagatccagcgatttgaggccgctcgggaggggatggctaaagaatgtaggcaccataccatgactgttttcacacattgtacttcctggatctgttgtgctcttcacctgcaaggctgcaacagtgaatccagtgctttcttcggtctttgatctcaaatgcaaaaaacgtggaatcagaaaaaaaaatcgctcgtgttgtacatgatgtagaagatgttcatcacattttaatctgtgaaaaatgttcgatttgatttgagttcattcaacatcttttgtcgaacctttcacttctattacacgaaatgttcttcccagataatactttggctgtttggcaagatgacgctcatcatgttgtccttgcgatttcagaattgcttacgaatttgaaagaaaccaaagtttcactcaaatcgcccagcgaaaaattgtttcactcattggggtattctcccatgagggtcctctgcggtactgctcactgacatgtgagcccctagaccctcgggtccacatgtcagtgacatcagtactgcagaggatcagaattgcttataaaggtacatacctccttatgattgaaatatacttttttttaatggagttatcaaaactaatttttaaggttggaataaggttaaaaactcatctttgttaatattgttgaatttttattttactttaagtacatgtattagtcagctgatatatacctcataattagcaatatgtagtatatatacctccgtatactttctcagaatcagaaaagcttcgtcattatcgatctaaatttattttctaatcaatctagtttctttagcactaaaacaattggaaggatgggagaatacctcttcactcaaatgacttgcttttcgcgcttctggatcaatccctttataggagtttcctgctgtgaccatgcgtagcaatggcgtcgcgctcgcgcgccgtctcctccggcttcacgaaggcgccgaccttctccgtcaccaccgcgtcgcagctccacgacgccatcgaccgcctcctcccgcggctacgcggcgacccgtccctcgcccccgccgcgcgcgcgctcgccgcggcagc

SEQ ID NO: 56173 - DNA, 231 bp, Oryza sativa
tctgtttgtagggaaccgtagctcacatccaaaaaaaagtgtgacgaataaggaaagctgcaaagagttcctggaagattttggtgattatgacagtgatgatttaaatgaaaggtatgtccggtgcatactgcatgatttatattagatcttccattcttttgcatactagaacctttgcttctcatcctacgtttcaaactaatatatttattttgataatgtggcagc

SEQ ID NO: 56174 - DNA, 249 bp, Oryza sativa
catctaaaatttgcagaccttttcttttattttttatggatctcacgaaatgtactagattcaatcaaattttatattcaaatattctaaaattttacaaaattcagtcctatcggttttctccgatagaaatagcctaaccaatactacattaaaccttggtctacaccgatcataatcaagtagcctttccctcgaggacgcaaatcacacggttataggttttttttccctcaacccacacctagg

SEQ ID NO: 56175 - DNA, 1501 bp, Oryza sativa
gttcgcgcgctgcccagcgcgcgccacccgcctcgccgcgccgcgccgcgacgcgacgcgacgcgcgccacctataataaacaccacccgcgcgcgcgcgcgcccagcgcgtcgtctcgtcgtctccgctgttcgctcgcctcaacacacgagtgcgacggcggcgaggaagaagggggccacgattgggaaggtgtttggttggcgcaggaaggaggggaaaaaaagaaaaagaaaagaaaagaaaagaagctgtttttggggagtcgtgctttggagagctgaaaaagaaggtgagtaaaaaggttttttgatctttggttggttactgcttctcccgtgatctcctcctccttcttctccagtgcggctgctctgggctcgagggcatcgtgaatctacaacgtcaatcgcattgtcttgattaattcctatgggagttcttggggatttgtcgaggggacgagattttttacccctaggcgatgcgattttggttgcgatttgttcttctcgtttggatcactggtccctgaatattttctttcctttcctcggtgaatgaatggtgttgactgttgaggtagctggttgatgaacactcatgcatacagtttttttttttttttttggtctctctcttcttctgctgacttattaagaagaaacattgcaatcttagactttattaccattttctctcttcttctgctgacttatttaagtttcttgattttttctttcggtgatatagtgatgtttgtgctgggtatagtgaaatttctgtggttatcttgagcttctatagccacccgaaacactagtactaatcttgtgcagtacaagtccctatctagtccatgttcttcacttatttgctctgactagtttgctttgctgcaggtttaagctgtctgattcaacggacggtgcaacagagattggacagatgggttccctcataagttagttgttttctcacaattctctcgtgcttgacagttgcatcattgattcatcattgagcccttttcacttttggactgtcacatttttttttgagctttcctattaagggtgtgtttagatcccaaaaattttggccaaaaatatcacatcaaatgtgtcgtttggacacatgtatagagcattaaaggtggacgaaaaaaaaactaattgcacaatttgcatgtaaattgcgagacgaatattttaagcttaattgtgccatggtttgacaatgtgattctacagtaaatatttgctaatgacgaattaattaggcttaataaattcgtctcacagtttacatgcggaatctgtaatttgttttgtttaatacttcaaatgtgtgtccgtatgcttcaaaaataatttggccaaagaactaaacaccgcctaacattgatttttttggggggtaatgatttttcaggttcttgggcgatgagcttgtgtgggagcccaatttgctccgagcaagatgtggtctcatgtgcta

SEQ ID NO: 56176 - DNA, 1501 bp, Oryza sativa
catttatagttttgtactataattagccatattagagttgtaaaccatcaatattttctctagcaacaatctattaacattagcgttcaaagttcaaaggtaagtaaaaaaattatacagccacattacataatcaagagatcaagtaataatttcatataactagaatggaacaatgcttaagatgtgaaaagagtttcatactatgatttagtagtcgttgaaacttatattgcttatagttttaggctcaatcaacggttttttttcacccacgggttggtgggtatgggtgggtaaagaacggacccatacccacgtacccaacaggtaagagttttgcccattagtatacccatgggtacaagagttagaacacaattagcttctaatagagtaaaaacctgtcgggtcacgggttatgggtccccgttgccatctctaggagggactattcagcgaagttcgtatgaatgaacttgtgggatgtcaaactttatgtccttaattttgtcccatgtttttttctactgcgtattttgttacacttttattttcttttacgaaattagcacactgttagaatagtggatatggtggactttgaattccaagtggtagactattgagcaggcaagacacatgggtctcacgggcccacaagggtgttttgttcctttttaaaaaaaaaagtttgtccaatatgtttcaaatttattttttacaggaagtttttcaatggaatgtttatgcgcacgtacaaagtatgtataaagtttctacatataaaattatcatggatgcaattttcatgtataagcttttttttttaaggaaagcactgtaggggaagcccccacagtaaaataactttattgatgaacaaaaattacaaacgatgtataagctttattttggaaacacattgtttgttgtgcttggaaaaggcttgagaagaaaaataacgctacatcgtacgttagttttgatgcgaaaaggcagataacacatgagcatgagctattcccgagccctactccgttaattgggcccaagcggagaagggaaagagatgagactggaggcataagtcagcattttagcaatgatggacatatgcatcatattcatacctcctacttgaaaggcatgtaagctgacacacgtatggttaggtgtggttttcgacggctaaaaatcgtaagtcgacatagaggtgttttttaaaatttaattaggaatgcatggctgcaatctcacgtaataaataagttatcggcgacataagggcacccataatagttatgtcacactccaatccggcaccgccgtacaacggcacctgataggagcgtgtcgtaggaataacggcgcgaaccgcttcctacgaaactgcgatctcggtaccagtcccaggacgtagtgctggtacccacggtgacaaatatgaatcattgcaaatccttaaaataaatagaggacttatttaccttaacttagg

SEQ ID NO: 56177 - DNA, 1501 bp, Oryza sativa
cacccaggcagcgggcgactgagggggagctcgcccgggaggcccgcggcgaaggcagagatcgctcgggcggtgagcggctgaggtgaagctcacccgggcgcccggtgaaggaggcagaggcggaccgagcagccctccccaacgcgcctgccacttgccctcccccgctgcgaccttctccgttcggaccaccgccgcggccttctccgcccggaccaccatcgccgccgcactacaggaaaggagagggggtgtgctgggagacggcggcgggcttgtcgcctccttcatgagagctacgactccgccaccacagatcccgaccgacggcgccgcgatggtaggtcaggcggtgccatccacgcagaggctcgaggcggagccgttgaccctcgaggaccgctgttgcctagccttctcgctcatcgagatcgatgtgcgagacacggccgagggagaggatgtggcgaggacgctgccttccgccggggatgttgccgccgccgccgccacctaatgcacgtcatcttcctccgctgtctcatggtggccatcgtcgccttcctctgcctcctcactgctcctgttgttgggggacagagaaacagagatagagagagtgcgatggaaaggagaagaggtggaagaagatgctgacatgtggagcccaccgattttttttctgactagattgccacgtgtgtgccacgtagaatcaaaactgcttcgggctgattcagggggtgattcatccaatttgttaagttcgaggtgtaaaatgtctggttttgtagttaaggggggtaaattgtacgaccgtgatagttcagagggtaattcgtactttttcttttctatttttaaccttttttaatttacttcaaacagtgtcaagtcattttgggcgtgtttacttggctgcttcggttgcgacttttagggactcttgtttagaagctgtttggtttatatgatttataagtcaataaattttaagtcctaaatttaatgatggagtcatatctctacctcacataatgagaaaagcttttccaacctagcttttggcttaatagtgctatagtagtttgcgaaaaaaactgcttgtttatttagtcctagattttttgactcataagctaacttataagcctaaacaaagagttttgacgaattttggttagtatgttttggggttgatcatatggaatgtgttgggctttggggtgaagccttatcaatttttttagagcttttaagagtggaagctacgggaattaccaaaatttgtagggtatcaatgataaaatatatttagtttgttgttctagggttgaaaataattacaaggtaaataggctcttcgtgcgtagcttgtggacaatgatttcacttgcagttgcacttggttgtcaagtcattttttccctgccttgttagttgttagaagtattaagtacttcccctcttataattatttgacgtgtagctcaatatt

SEQ ID NO: 56178 - DNA, 1501 bp, Oryza sativa
tgaaaagcatctcttaagtcgatttgagacgcaagtctcttttcgacccaaacttaaaaagaaataaatcacttagtgatttcaaaatgttttcaaacaaaagatttgcaaaactgccttgcctctcttctaagcttgcattaaacacctaaattcccgtggcttgctgagtacgaaagtactcacccttactctatataaatatatatagtttcccccgccttgaagtgaagatgaagtgaagtgaagattagggtttcgtcctggttcccagccgtcgcctgtggtgttgggtgttagtccattggttccgctgctgctgctgttgttggtgtttcctcgtccgtgtcgtcggttgcattctcgggctgttctgagctgcaacctaagttaaggtaaataagtcctctatttattttaaggatttgcaatgattcatatttgtcaccgtgggtaccagcactacgtcctgggactggtaccgagatcgcagtttcgtaggaagcggttcgcgccgttattcctacgacacgctcctatcaggtgccgttgtacggcggtgccggattggagtgtgacataactattatgggtgcccttatgtcgccgataacttatttattacgtgagattgcagccatgcattcctaattaaattttaaaaaacacctctatgtcgacttacgatttttagccgtcgaaaaccacacctaaccatacgtgtgtcagcttacatgcctttcaagtaggaggtatgaatatgatgcatatgtccatcattgctaaaatgctgacttatgcctccagtctcatctctttcccttctccgcttgggcccaattaacggagtagggctcgggaatagctcatgctcatgtgttatctgccttttcgcatcaaaactaacgtacgatgtagcgttatttttcttctcaagccttttccaagcacaacaaacaatgtgtttccaaaataaagcttatacatcgtttgtaatttttgttcatcaataaagttattttactgtgggggcttcccctacagtgctttccttaaaaaaaaaagcttatacatgaaaattgcatccatgataattttatatgtagaaactttatacatactttgtacgtgcgcataaacattccattgaaaaacttcctgtaaaaaataaatttgaaacatattggacaaacttttttttttaaaaaggaacaaaacacccttgtgggcccgtgagacccatgtgtcttgcctgctcaatagtctaccacttggaattcaaagtccaccatatccactattctaacagtgtgctaatttcgtaaaagaaaataaaagtgtaacaaaatacgcagtagaaaaaaacatgggacaaaattaaggacataaagtttgacatcccacaagttcattcatacgaacttcgctgaatagtccctcctagagatggcaacggggacccataacccgtgacccgacaggtttttactctattagaagc

SEQ ID NO: 56179 - DNA, 1501 bp, Oryza sativa
ggcctccatgcgccttctcgttgacgtggcatccatatcctccgtccttgcgccggcctcgaacacctctgccctgcatggatttggccagcggtgcaaactcagcggggcaatcgccgtcttctcccggctctgatttctgtcgttgcggcctccgccggtatggaggaagcccatggtggcgatggggttgggggtgaatgggggagggtggcgagctcgagcaccaccacgcatgtcgacggccttcttttcaccagcgtcgaccatccctgcctcgcatagagagagagagggacggggaggaactcggggatgtttgagtgtgtcaccctagggacaagaggaagtgggggagaaagaggaggaagaattaggggtagtagaggccgacatatgtactctagtttcatgaactcataatagagaggttagatggagatgctgttagattagtgagaaataaatttggcttgccaaattaattggatagctgactatataaatatttggaggatcaaatttagatagtccgttggtagtcttgcattgtatcaacttaaagcatgagccatgcctggtactcacctaattgagcttatgatattctaccttaatttattctcgctggagtatgagagaagacatggtcaagttggccgctatcacagtccaaataaatagtagtccatgtctccatgatgcgctgtggcgtaaggctcgattgcgtcatccgtgtgccgtcaccagtatagcgcgagcgatttgccttttctgcgtggcctcgtgacgatgtggggatgcatcatcagcatgcaccgtcacgattagcagcttaattatgcaccacgggcaatttcgtcctgggccacttgcctattaataaatgttgacctcccaacgaccgggtctttcacaatactattatattgcagtgtcttaagcatccgaggggtttttaaaacgttgtgcagatgcagattgttcgtcaaaatgaatcttaactaaagaataagaagattgtatattgtgaataagaccatataagatggcttgtgggtctctagtgttcttactgttggttgatcaacagaggcgaccaaactatcctctggtttttgcttaatgttatttatgtctactttggtgtaaagggtaataaacttgaatgaaattcatttttggtgagcacttcagttcagttggattgcaattgttgcttataattaccatgactagatactccctccgttcacaattttgagacatgttacgtctgggtgccaagacgaaggagaatttaatcattcctgtaaattatgcatgcatgctgatttattaatggggacttgataaccctagacatcaagactgtgcatgcatacatgtgcatcgaatccgcatggctaggaacgtaattgtgattattggacaggacttaatcccccctgatttccaaggttgtgaaggcagatatgcggacatgggtactaaaattggc

SEQ ID NO: 56180 - DNA, 1501 bp, Oryza sativa
cataaatgatgggcttaaaataaaaaaaaacttaattttgcctatcttcgtgaaagatgtcccggattacacgcgcgagcgtgagcgggctaagagctgtggcggcgcggcccatgaaatctgtgacgacccgatgcagggacgatctgatggacagctcggattcgtcccacaccgatgaaattaccgcccatgtgcaaccctagccctcattctctccccttctattccccgatccccttctcccagcgagcgtgagactgtatggcggcgatgacagagatggcggttcggtgaggtgtagcacgcgtgtgacgatgagcgccgagtagagtggcacatctgtgctagctggagggtgcgcccgtgggcagtgccaaaccatggcgtggcgtctgcggtccagcgaggtggacgcgcaagcggcgccgagcgtcacgtggcccggaccttgtcggcgggggagcgaaggccaaaggcggcgccaagctgatgcttcccatcccggttagtcggcgacggtgggggatctccaaggttgcgtgcgcacagcaaccgcgaggaggagaaggcaagggcacaccgaggagacgcatgggcaagcccgtatggcgccgacggcggcgataccgcttctcgacgagaccaacaccgcagtgaggtttcccggtagaattagggctccaagtccggtaagaatctgaactcaagcttaatttttattttttgggtttcttgattttttggggattttgttacttagggttcttcatccgaatcagggttcttctcaatttggggattttgggaaaattgaaaccgattgatctcattcttcccttcccttaatttcttaattctactgctaagcaattaacaaaagattaaatcttgaatttaaaacatgcaaagaaacagtatatatgaagggctaaaccgagctaattaacttagattgaaaaacaattctcacttattttcatcatgccgaattgattaggatttaattggcataatggcttcattagggatgatggaacatcaaggctaagattaggctctgatacacaatgttggagtttaatccacttaactacttaagttcttagcctaaacatgatcacctctgcttaatgcggaaattgatctaactgacctgagatgaagccattgaaccagatgttaggttttgtttttgttccttcgatccttctttcttcttctctgttaaggaaaagaacacacaagagatgcctcacgaaccatcaaacattcattgtacgtaaaataaattctaatgactaatatgtctcaccatttattattagctttctcactagagtactcattttttgatagcctactgactgactaatgccccaaaaaaggcagcctactagctagtatattaccataaccatcttcctccatggcaaccacaattgactcgctgcttatttgctgtgtagaaaagtgtgtattgagtactagtactaagagg

SEQ ID NO: 56181 - DNA, 1501 bp, Oryza sativa
atatatatatatatatatatatatatatatatataaatatttaataaggtcaaaagattacacggagaagaacattaaaaaccgaaaaatgatgcgaaggacgctgaaatcatgttcatctcgtgtgtgcacatcacatcctaatcaacatctaacttgttaaaaaatggttgtgacatccttttagccttgttttgcatgtatcagataacttcatacaccaaaacgaatattttataagttcgtgtactaaagtgaactcacttgacaagtttgtgtaatatcaatacaatttactctttaaaagataaactatataggttgagaaggcaaaggcacatggaaataatcctacgagaccgcagttcaatgttgctttgacaaggacaatagcagatttcctattgtgcgacaatagcgatttaatatgccacgcaccaccatgattattgacatcgcgaatccctgaattaccacggaatttaaccgtgggtgcaaccttttctttgccacctcaatttccaccgcatgggataagagtttttaaaaaattaatatttataaaagttagattaaaaggttgacaaaaaaaattctattaagtattaaaacaaataaaattatatttttgttgcgaagctttatttttaaaatgaaaaatacattttttttcttaacaaagcctcaattggctttttttttaaaccaatccattcatattcaagttctaaacttacgggtactcgtgttaatttacaactcactattctttatatacgacgagacgtttatgatgatttcgtcaatctcaaaatataccggctaagtctttcgaagatactatattttttataaagaaaaatgcatgcataactcttgccgttctctaaacacatgtagcctagtggttacaagagcctcagtagcacttgagttcctgggtttgactcctcatgggagcaaatttttcaggatttaacggtgttgtgctttcagtggtaggcgacgtacccgtcgacagcaatgcgcctgtggtgacttcgttaatcccgaaggatttgccggtccaatcttagaagatgctcataggtgtagggtttgcgtgcgtgcgtttataggggtgactgcgtgtgtgtaatgagtgtctccattgtactgtgtaatttttttaagaaaagaaacaaaaagacagcgaagtaaaaaaagaaaagaaagagactataagcggcatgtatgagtggcgcgcgcgtgacgacgagaggaaggcaggcagcagctaagcagtacttgcgcgcgtcgttacccgttttgccctgacgcgtgcaccgctggctacggtagcttcgtccccgtccggcccacgctacatatggtacaaactgagggcgccgggtgctgacaaccatctccgtctaacgcgcgtatggccccctataatggccgaaaacagctgagctatccattatactacgtctacgccacaggcccacacagcgagcac

SEQ ID NO: 56182 - DNA, 796 bp, Oryza sativa
gcagccctcaaacgttgcaagcaaaaacttaaaatcccttatattatgggacggagggagtactatacaagttagagatttatcttaagtaaaaaaattgaagattcatgaccaattgccaagacaatctgaagacagctctagctaattgtatatatttctgcgagtccacattattaatgtccaataagctagatgatataatttcagtaaactccaagaaacatttaccagctatatagatcaccaggacaaagcctcatgtttggcaaggaaggttaaagaacaagccaaatacagttcgatacataattactaagttttttcaagaagaaactgtatgcactcaacaagtaacatcctatacccatccgatgcaactttaatcactttaagtaggcccatgttgtgataaccactggataatgcaatcaatagctcatacaagacaaaatacctagaacacatcaatttcacaggaattgcataaaaattattatacaccacagcctgaagcaaatcacgtcaatgattctatcataatataggtgttgcagtaaagaggttggggagttcagaaataatcattaaatcgtggtcccggtagtcacagtggcggtggccagtcgctgcgttcatgctctcgcttgagagccctcaccatcgttcctctctcagactgagggagactgcgatcttcagtctgcaactgtttctttgttcctctctccctgcaactgtatcacctgggcagtggcgaaggtgaggaggacggcgggcaggctgagggagacca

SEQ ID NO: 56183 - DNA, 1501 bp, Oryza sativa; identical to SEQ ID NO: 55901

SEQ ID NO: 56184 - DNA, 1501 bp, Oryza sativa
tgatgtgaaaactgtgaaacgtgaaaacggatgaacatgcaagaagcttctaaacgatttttgaacgggtttttatatatgaattttgaatttcctataatattgatttaaatacatttacaactttataatagttaattcacatgcttgtgctctcaatagttattagtataaattatttatctatttagccattcagcataaaattaacacacacgattaattgatgtgagaaattaatctaataatggccggccaaaggtctaaaaggaatcagcagagttcttcgctatgacgagatcaagacataacaggacgagcaaaccaatcaatcactccctatatatgtatgtctattgacataatcacaaaagcagcagaatgattagccgcctaatggacgcccaaatttgtttctttttcccctctcaaacgcaacgtgccaaaatcgccaacgtacagcgacatgtttgaaggagcacggacaaattaaacgcatcatgttttagtttagatacgcttgggaacagaaggtatacgccaaatatctactttttggcatctctttaaagaaataaaacagaagaaaactgttggcattttgctttcaacttgtatcgagatatagagccgacacacttcatggaaaaaagatgaacgaataaatttcgcacagtttttttttttacaaaaaactagaaatcgtaaacatgttagtaacgtaacagagccaaaaattaaaatttgaaattcaaatatagagttgattgcgagatatcttttaccgtataagtggtgtattttccgacatgagttttttttaaccataactacaaattaatgaaacatgcatgcaagtttacctacaaactatttgtatggtcatttatttatatttctatgtcttattagctataactgaatcaattaaacaggaacgttccaaacgatctactccatctacttatttcatcctataaaaaataaatctagtacaggatatgacaatcacaatactactaatatggatggtaataaaaacaaactagatgtgatgcatcctagtaataagattatcacatctcgaactacactccctacttagatttttttttatgggatgaaaactgcaaaggcttgcatccaagaagaactcatagaaagggctgaacaagttataaaaaactataactcattattctaataatctaatatatgtatgataaaaatttttagtggaaacttaatgaaaactctcatggttgtaacatcggtagtgagtactcgaggctctatcgcccccatgacagatccgccaccctcatgtaggggagtatgtaacaactgtgatctaactatctgcgtatctgggagagaaagggagtgaaacccgggcaatctgaagcctgcatgcgcgatcgatatatagctaggcctagcgcgcctgaccggacaacgcaaaacgccagcgcgcgcacggtgacatgcaacgatccagaga

SEQ ID NO: 56185 - DNA, 1501 bp, Oryza sativa
cagctgctggacgtctttaagcttttttacataaaaattgttattgacattaattacttaaataactctgaataggcactggaattaattggaattaatttgatagcagctgtgacattgaagaagttgattggggaattttttttagaaaaataattattttagtgaaaaatacaaaaataaaagctgatcggctaaattgcaagtttaatactctgtcgaacaaccacagttcaacagatacttgtcgaactagagcatagcagggggcctatggaacaatgtttgatagcatgcagagttcgataggtccttcatgcacagtgctgcacaatagtgtacagtgtgcatagtgattgttctcttttttttattatgttttatcccatatcgaacaaccacagttcgacagggtatcgacaggggataaaaaataccatgtcaaactacagttgttcgatatgtaccctgttgaattttggctgttatatggttatatggtgtactaaacttgcaattttagtctatcaacctctatttttacaattctctattaaaataatattatttttaaaaaattcgttgattgggtggattttgcaatccctaagggtgctgtgcgtggccctttcctttcctttgtccatttgcagctttgtctctttgctattccctccgtcccaaaaaaaaaaagacaaatcctggtttccatgcccaatgtttgaccgtccgtcttgtttgaaaaaattatgaaaaaaaataaaaagacaagtcacgcataaaatattaatcatgttttatcatctaacaacaatgaaaatacgaattataaaaaaatttcatataagacagacagttaaaattggacacggaaaccagggtttgcctttttttttttgggacggagggagtacctcctactctcctattaacacctctattcaagacaatgcgtttgattgatgcagtccatatttttcaaagcgataggtaaatactaattatttatatgtagtaccaaggggtgagtggtgacaagaaagagttaaaatttcagaagagaataaatgctaatcttaactatatttggttggtgtaacgccccgatttctgcgtggcgttaaaagctaatttacaaaaaaccctaattgcgaaaattttgattccttgagtgctgagtctaagttgtgccaaagatctcaatttgaatccctcctttagtccatcttcctgctatcaaaaatcgtctccttaaatttccatcccaatgtaatctcgaagctcgattccttctattcagaattccctcctaaaaccccatccgtgaacttcgtcgaatgctcaaaccctaactcagtccaatgattcacctctgcatcctaaactctcccttgggttccttcaaaaaacaattctcaaattcgaattcaacctcgattcatctacctcctcctccttatatgtctgtctacctaccctaagtttctttccgattaatcaa

SEQ ID NO: 56186 - DNA, 1501 bp, Oryza sativa
gcataataaagccactagcaaggctatgtttagattttaacttttttttcttcaaactttcaacttttccaccacatcaaatatttagacatatgcatggagcattaaatgtagaagaaaaaaaaccaaatgtacagtttgcatgtaaattgcgagacgaatcttttgagtctaattacgtcatgattaatcataagtgctacagtaacccatatttgctaataacagattaattaggttcaaaagattcgtctcgtagtttacggtccaaatctataatttattttgctattagtctacgtttaatactttaaatgtgtgtccgtatacgttaaaaaaatttttagctctgaactaaacacggcctaacacgacaacctatgtgaatcccattaagatggatcatggatgcaagaagacttcgccgagtcataaagaataccctatccgtttccatattaattgacgttttagataaggttgaggttaaacttttataactttaaccatcaataactttaaaaatatttagtttaaaggaactagaacaacatgcatttatttattatatatatattataataaaaaaaaagatcacagatgcatcttgtataccgtgtcattgtccaaaacgtcaattaaaatggaaccggagggaatatggtcattgtatctagtgcgcataccacttgtttgtctttttcttttttttttttgaaagaaattaaaggcaagaagataccacttgttagtcataatgaggacctctacttgattgataatgaggacttcactgcgtcataaacaatgataatcaatgtacgtatgaatctgatttagtcccttcgattgcatagaggaattcaccacatgcacaaatcaaattaaatcaatgcatacggtttaaagaaacactgccacaaaatgaaatcaatataggaaatacttttaagactgcggtgtagcgtagatggcatggtgcagcactgcagccatacgttgtgctcttcgcgacctgcgttcaaatctggctgaacgtactcaccctctttcttaataaattcaacattgggtcttttccagtataatttttttttgttattttacgcacagaaaataaaaacaaaaagaagcgggcacacgcatttgtactttgtagagcatttggttagcacactgacactcctgtttgctctcctctagctacttcctcaatgccttactcaacggaaaggacaactcaattatcttagctaagtcatgggtggtatctgtgcacagatgtagctgtgcagtagcaatagccagtgcaaggatctgagaccttgggtccctttgcttgtactaataatgaagaggacttcacttggtcataaaaaatgatgggcgaggacagcctcaacctgtaaatcatactatatactccaacctgtatatcacctacagagggtgaagcgagtcagtgtgagcaagcagagaagagttttctaaaggaaggaga

SEQ ID NO: 56187 - DNA, 1501 bp, Oryza sativa
atctagtttgtttttattaccatccatattagtagtattgtgattgtcatatcctgtactagatttattttttataggatgaaataagtagatggagtagatcgtttggaacgttcctgtttaattgattcagttatagctaataagacatagaaatataaataaatgaccatacaaatagtttgtaggtaaacttgcatgcatgtttcattaatttgtagttatggttaaaaaaaactcatgtcggaaaatacaccacttatacggtaaaagatatctcgcaatcaactctatatttgaatttcaaattttaatttttggctctgttacgttactaacatgtttacgatttctagttttttgtaaaaaaaaaaactgtgcgaaatttattcgttcatcttttttccatgaagtgtgtcggctctatatctcgatacaagttgaaagcaaaatgccaacagttttcttctgttttatttctttaaagagatgccaaaaagtagatatttggcgtataccttctgttcccaagcgtatctaaactaaaacatgatgcgtttaatttgtccgtgctccttcaaacatgtcgctgtacgttggcgattttggcacgttgcgtttgagaggggaaaaagaaacaaatttgggcgtccattaggcggctaatcattctgctgcttttgtgattatgtcaatagacatacatatatagggagtgattgattggtttgctcgtcctgttatgtcttgatctcgtcatagcgaagaactctgctgattccttttagacctttggccggccattattagattaatttctcacatcaattaatcgtgtgtgttaattttatgctgaatggctaaatagataaataatttatactaataactattgagagcacaagcatgtgaattaactattataaagttgtaaatgtatttaaatcaatattataggaaattcaaaattcatatataaaaacccgttcaaaaatcgtttagaagcttcttgcatgttcatccgttttcacgtttcacagttttcacatcattaccttctctttcttcaagtcttatgaagctgctatatagagttatatataaggcaagtttgcatagctctgatctaaatccaatatatttagaactagatattcatagctccagaaatacatttttatggatatgtcattaaattgataatgtttgaaaaaaaccattttattcctatttcagattaaattccttaaaaaatataaaaaacaaaatattgtaacttaacttacaaactctacatcagcgtgatctaaagctgtgacaaacaaaatatctaacttgttttcggaatcaatttgttcttcaaacctctattcagggtcaatatagcagaagaaaagggtagattcttttatgattaggagtggttgaggagcgcgccgtttttacggatttgcttataaactgatgatttaacagctgtaaaatgtactcaactgttgca

SEQ ID NO: 56188 - DNA, 1501 bp, Oryza sativa
cgatcttatcggctagccggaagacatcaatggcgctgatgagacctccccgactggcttctccccctttccctcttcctcaaaccggtgtcggcgaggtgcccctgctccatcgtcttcccagtccaccaccctcttccatctttgcggctccgagtgagccacctgggtccactgtccaccaccgagctaccgcctcccattagcatccccctaggctcgacgatctcctccctcctcctcctcctcttcctcctctccaacccatttatcacccctatcctaacccgggaccctaactcgtaactccattcccttcgtcaaggttgcccgtgatggaggagaaggggtcacaggatcttatggagaaggagagttggtcaccggagcatgaaccacgaatcaaacactaaggtcgaaatttgcaagattttgaccctacaattatgccaaatgatatttagcaattccgttctttttatatatcattgactatgtattttgaccttctttatgcctactccgtgagttggtagtttgttgaccattaattttttcttaaaatatatatattacccatatcttttacttgctcttcaatggaaaaaaatacggcccttaatgtaaaaaattgatttattttaaaaaataaacaggacataattacttatcataaatttgaaactaaaatttattttttagaaaatgtttcaaatcaaattgatataattttttcagaatttttgctgaaatttaaacccaattaaaaatcagttttgtttttttttaaatttttttagtgaaacctatgtatggatttcatcatttttcaaaaatatttgtaaatttaaattttggttttagaatccgatgccaattaattatgttcattttggttttattatagagtaagaattctttcatattaagtatgtttttaaagtatgtagcgtaaagtatcagagtacaatatagttatttttgaaaaaaaaatctaatgatcaactcacagttaataagcggcatgggctgataggtatagggggataaaaaataaaaactcatggacataaggaagatgaggcaaaattcaaggttacagaagccatcgaacgaaaactcatgggtatatagggaattttgaatttggtataaaatgggataggaaaaatgaatggttggaatgaaatgttaccttttggtggatggatctcacgagatcatgcactgcaatcatacttctacaagataggaagcagggtgtgaaaaaccgccggtaaccgcgcggttaccgcccgtaccgcgggggtacggttacccgtaccgcgcggtacggtttaataaaattcgtccaaattcaaaaaaatttttaaaaaaaagaaaaaaatcaaaaaaaaatagtgaaggtagtgcttgatttatagtgttttatggtgaagaaatttcttaaaaaagagtaatatttattcaaatttgagagcaaaacggagaataaatttga

SEQ ID NO: 56189 - DNA, 963 bp, Oryza sativa
tatccatttaagttgtatggatgaaccatatagaaaaaaaataatccagaacaattttgtaagcatatggatcccttaatataatacaaaccattagtacaatctcaaatgatagccatgaataattgcataagtgtgatttaacttgaatagaaacatgtatctttaacggcacagtacctatcgtcggaggctggaatgaaatgaaaaattgaccgacgcttagatcttactggaaatcagtaagatatcgtccaaacgtagacaacaaatctatcccatccagttactggaaccaaaacacatttttattcaatggtcgctaccatttcccatgtatagagtctaaatcaatgatcttaagaatatatattggtcccgaatacatatatgcacgaatgatccaaatatatttaccctttcaagggacaataacaatgtgcatttcagtgctctaaacttcagacaacccaatttttattaaaaacaaatgtgccatttatctatttccagttcagcacagaaatataaaggcttttcccttcaatttgactatagagcaattatattgcacacagtactatgtgatcatagaagcataggcatatagacttgaatatagcaatacatagtactaatttatgaatatacatagttagatatggcagggactaatcagcgattgtccgatacacatgtagacaaatcacccttagaatagtgaacatatagtccttttggaagaaacacagggtgtgagaatgttttttcttattccagccacatcaattccccaccatactgaaatcagcagtatggtacatattcaagagtttgaaagtgcttatcagaggaaaatacaactgttcacagttggctttggatgtagatatacagaaaatgtcatccatgattcccaatttccagcacaaattacattgaatatatattgagcataaatca

SEQ ID NO: 56190 - DNA, 1501 bp, Oryza sativa
tcatactaagagtcctaaacaccttaagaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccaccaagccgactcccggtccatcaccgcaaatactctctcgaggcatcgagtcagctacacatgaaacaaacaaagaaaccatattctgagaccaagctatcaccaacttgactcattgttagcaaacaacagtattatatacgtatggtatccatctagaagccataaccatgaaacaatcacggatatccaaagaaacaacccgaaaccgaaaccgacacagcgtcggccggtcagaccgtgggccggccggtctgaccgctcgatcaccaccgatctgaccggcatacaccacccggtcggaccggtcacataaaataacagtgaatccgatcatcacctgaaaattgattatctccaaaaccacttcgacgataatctccaaatatcaaaaccaataatcacagatgccaattgttcatcacagaataagaatcaaaacacactttgatcttacatatgcgactaaccatgagaatgataaaacaagtgttataacaaggcaaatctaggattaggagtcatcagcaatgatgctagcgttgcatcttctatcaatggatgataggaatgtactggaagagctaaagacgataacatagggatgaacctccacgctcatagttgtgatgcacttttctgcagtaccacagtcctttgggatggcacgagaccctgacttggtgttgtttaaatagctaggctttgcactgaaacttttactctttcttctaccttgctttatacgcacttctgaattccagaaaataatggaggagaaatttgccccacaactctcagcctttccactgaaactctactctgtttcctctgctttgcaatatctgaacttcctggatttgctacggctcagttttcaggttcaccacctacatcttggaccagtctatctaaattctagcggcttgggtttgtaggcacctttttggtggaaaataactcacaatttattccttgctttcacttgtttcaggttgtgaactaggaagaaattgggaagaagaagaagcaactgttgggagttgtaactttcgcaaccattctttcttggatgtgtggctcagatatgaacaaaaaaatgcacaagaggaatcctctgcaatagtaatgtctaaagcacgatatcctatacacaatacagctaattcctcaccttcttcaattgatagctagcctcctgtaatatcccaggctttattcatagttttcgaaaaaataatcaaaagaggggctaaaaaatcgactctttaccattgc

SEQ ID NO: 56191 - DNA, 1501 bp, Oryza sativa
gttattttttattctgacattgtatacatcgatagtagtcgtcaatacacacatgttttatcattatatttcaaaacaatatattttacaaaaatatttaaaatactatagatctatagtctatatgcaagaaagagtttttcataagaaagtgtctactcataattttcacattttaaataaatcctgatacttttgcatttatatattaattacttaatattttcagattttttttatttgactacacgtgttctacgcctcatctttttgacaatggaggtagtatagctacaattggcatctttgagcaattactgctcaaacttctttaagtttaactaaatttataaaaaaatatagtaatattttcaacataaaacaaacatattatcaaactatattcaatattagattaataaaaataattttatattttagatgttgtcaaacttgacaaagtttgacttaaaaaagtcattcttcttttcatattataagtcgtttgacttttttcttagttaaatatttttaagtttgaccaagtttatagaaaaatataataataattttaacacaaaataaatatattattaaaatatattcaatgatatacttaataaaactagtttgacagtttaggtgttgctaaatttttctttataatatgaaacggatttgtaatatgaaacggaggtagtactttgtacctgataatcaatgcaaatgtgtagtggtaactgatcgcaatgtgtgaccactgcaactaattaatagatggcctcaaccttatttagttaattaagcatggctgaggttgatctattaattatgtcataaatacgaaactacgttttgatttttttttctagttaaattttttaaaattttgatcaaatttatagaaaaatgtagtagcatttttcacacaaaacaaaaatattataaaaatatattcaatgttatatctaataaaattaatttgatgtgatggatgttgctaattttttcgatcaaattagtcaaacttattaatatttaactagaaaaaagtcgaaacaaacttataatatagaatagatatagaatagagggagtagtaatttttagatcaatatgtaatcatcactttaattagtaactagctaggtagctaggggcatcagaatcagacaaacggctgaattgaaggtccatcaatcgttcgattgtacgcaggtcgatcgtcatgaggtcatcgccatacatatctaacacaatatgaacaccaaaacactactgattatgatgatttagtctagctagagacaaaacgaagaaccggcgccattagccctagctgctaggccattatggcagaatcagatcatcgatcgatctcattgcttttgttatccttttgagatcgatcgatcgatgtgatcgagtgctgttgccgaagcacgagaaaaacaacaccgagaaagaaatattgtatctactacgatccatgctagaccct

SEQ ID NO: 56192 - DNA, 1501 bp, Oryza sativa
ccgacacgtgtcagtgacaggaggcatcagatcatgcatctggcccgttcatttttttactttctttttgtcggcccacaagctttaaaaaactgagaatgttaattttgacccaattttaagaaatgaatttgccacgataaatcgattgggctcggactaggcctcccaatcaaaagcttttatcgtttgttaaccacaaccaaaatataaaaattgaaacttaactttattttttaaaaaaatatcatgttttatcagtaattcatcattaacttttaaatcattaaatatacttatataaaagttgtacccataaattatttttgactgcttcgattttttttaagcttatcaaccgtagagtcagccatgaggctgtaaaatgattcgatttttgtgtttggaactatgggggcttcaaataatggtgaattttgtagggtttttttttgtggggaatgaattttgtaggtttaactccctcccgtcaagaaacaagctgttttgggtatttacagtcttcaaaattgatctttcaccactagttttattcaaaataataataatcctgacaaaattattataatatttttttaacctacaatatgttttcatgcatccaatctaaatatttagaaatatacttatgtttaaaattaccaaggtttaaattaaaacatgtataaaatgatatgttgagctaaccttgggaatttggcaccgaggatgtccttctgaccatacttcctccaactgaatccatcatctggtgtagcctccaaacttgcatctggcactctgaatttttctgtccatcttggcaggcccttcctgtatgatgatttagagccaagaaaattataccaaatggtcagtcaatgatatttgactcctttttttcctttggttgactcaggcaaattctaataattcagtacagctgtatgcttatgattatgactgtttccacttatgattatgactgtttccatgcttttgaccaaagaactatgacatggatttctacattgcccgtccttggggttaggtccttttcaaatatatttttgacggttgcatatgattggtttgaaaacggaatttgttctttttatatttaagcaaataaccacaaattaaatagccttttttttaggaaattaaatatcctctgtttagagtcacaatgatatttcgaatgggttttccccctgacattgattaaccggagacatcgatattttggaactaccaaaaacatgtggaactggaagctaaaaaattcacattgcaccatgatacaacacagagacgacatacatactcatctacatccataacgcattaggtagatcatttgccctttttgctaaaaagaaaaaaaacagtgacttgattttaaacctagtttttttagcaaattaaattttagagttggttttgagtttttttaccacggtttatttttttagccttgacttgtaaaattttacctaga

SEQ ID NO: 56193 - DNA, 1501 bp, Oryza sativa
aggggagcacggcggcagcctcgattcgttccgactccctccaatagccccttttcctttgcctccaaatccaaccccccgtctccctcttctccggcgcggcggcgacgatgacgacaccagaggtgccgacgctccctcgtctcaccaaaaggtaacccccagccatccctctcttcctccctcctgctttcgttttgaatgaaaaaacacgatcggtctgcaagccatggcgaacctgggcagcggcgccgaagcgcacgcgcgtcttctcgctcaccgactacgtccttgtttaaggtggaaaataacgtctacgaggtcggtgccgcgccgcacaccgcgtgtccgccgttgcgatacgctggagcgacctcctccgattttcctgcagataagaagcaatagatagagataaacttgatttgttagttcgttttgttgctgtgccatagtccggtgacaataatttaacttgttcctatgttgccgggtttggaactgccttttcctccgcacgcatgaccagcagaagtcgttcagataaatcaaaaccccagcttatctctttaatttgatcgataagcaagcttatttagctgataaatcaaaaccgtggatatgcataatacgtcgtgatcgtgtcattcacggatatgggctaagtctaggagcatgcgccttcgcgcttgcggcctcagcaacggcaggcgagagcagtggcggcagagcgtcgccagtcgctagtcaccaccgtcgtgtcgcctgtcgccggccaccgacgccctcgtcctctcccacctctccccgccgaaggcagtagccgccgccgaaggcagtagccgccgccgtcctccctagttgactagtgcctacccagacgagaagagtgagagagagaggagaaaaggagaggaggggagagggtatgacgtggccagctgacatgtggggcccatgtgggtcccatgctgactcagctatcacgtcggacaaaaccgggttgaaaaccaccaagggacctcgggtgaccggttttatatagttgagggatcccgcatatctagttttacggttcgtatcccgatgacaagttgagggaccttaggggatagagttgtctcatttctcactgcactgtactccctccatactcataaaggaagtcgtttaggacagcgacacgatctccaaaacacaactttgacttcttatttctataaaaatatttattgaaaagtgatatatgtatacttttatgaaagtatttttcaatacaaatctatacatataatttttatatttttaaactcaacaacaacttgatagttattaacgtttgacttaaacattgtcacttttatgagtatggagtagtacaagtcttgcgagccgctggcatctgggccccatcttctcgtccccaatctgttccttctccaaacccctgcgcaggataacacacactagcaggcagcagcagcagaagcagccgcgagcc

SEQ ID NO: 56194 - DNA, 1501 bp, Oryza sativa
tggctcatgttctcttcctcctcatcctcttcctttctcctcctctcttttctctcttcccccgacaacaaacaaacaccattgttcaatcttgagtaaaaatattacacataattgatgaattggtaaaattacatacaattgatgaatttggagtaaaaaatgcattaaaaggaaaaaaacagcataagggtagcaatgagcaatgtgccgtccacgacaatggcgcgagcaaatgtgacgatggtggcaacggatgagagcaactgatctggagtcggggacggcccatgcgagcagatttcttcggattgggcgttgggcacagccattgcgattcgctggcgttagatcgggtgcacattcgtcgacgttgggtcgggcatgttgtgaacatatctgattacggcgtcgcatgggaccatccgagtcggtgatgtcgatggcgagccgagtggatcggggtgatggtgacttggggagggccatctagtggagagacacacgatgccgtcctaagaccttgtcatcacagtgcgccacctctatcatcaccgtgcactctgcctgctggtcacgccaccgctcacggctcgcacgcctcgccggagaagagagaaaagagaaaggaaggagagagagagataaggaagtgaaagctgaagatgtagtctaatgagggagtgaataggttttccttaaaaacactaaaaataatcgcaacggttaaatttaaacagggcccaaaactttctggtgatgaacaccgaaactttctggtagctcaaggtagcccggaacttttaaagttcaaagggtaactatgaaaacatagaaacaactccaaatcaaaaagaactttaggccctattcaaccaatatgattcacagtagactagaggagtatatagaacataagggcaagcacagagcattcacaaaagagacagaattttttttccccaagttcgaatcacacggatcctactcgccgttgagattaacaccttgcctcacttgtgcaaagatcaaagaagaggaccacaaccttcaatctaacactcctaggtccttctctataagtcgagtgaccaccaagatccaacagaaccttctagagataactaaaagtgaggattgctctactagggctacctctgagacctcagcacaactttttttactcacttacctcgttcccttgtggaggtgaggaatactttcacaaacttgcccgggtcaattcacaaccttgacggaaacttgtgggtgacaccaaccgtctatgagatcactctccatgagtaacaagcttcaaatgacaacccacaattataataatttgtttaatgataaatatataataacatcaattttacatgatagatcatttttatttttttctattaatagtcaaagttaaaaatgtttgacttgacactattctaaaaatgtttgagcaattaaaacgagtctgtatataaattaaaaaatttacatt

SEQ ID NO: 56195 - DNA, 1501 bp, Oryza sativa
agaagaaaagaccaagcatttaattccgacactcaaatagggacggcaagaatttgaaagaaagaaaaaaaaatgccaatcgactgtgtgcttttccacggccaaaacaaatatctaaactcccctaaaacgacaccaaaaaaaattatgaaattaaacaatgagcaacaataattcagctagctagtgcatggaccgaccggcctatgaatgatggcgcatgggccatccagggattcacatcctctgcttttgaagccaaaggcaatgtatgccgttgctgccatccacaccctccatccctcgatcaaccgtcaggtccttccgtgacttactaccagctaatttggtagaatttactctacagaaatgtaaagaaaacaatcgccagaggcaaagcaggaaaaaaaaactagcgacacactcttcactttttgaaccattggtatcgattcattcaggggaacaatgaaaatttcattgtacaagactatatttttgttgttttgacaaaagaaaagtaataggcacagctattccttagaaaaggctataggaaaaagcgctcttataaaacttttataaacacatatttgacatggtgtgagcaaatatagatttctagaaatagttaaattaaaaggtagccggaagttttgtgaggattttttaagtacgtgtagcaataccaacaatcaatcaattgtcttttaaattggtccagcacaactgatttcattaattaattggctgttaatcaattttgaagttgggaaaaacatgcagagccgtagaataaggagtaaattggaaccatgccattataattttgtaaagtttgagatatgtcatcggtatctcaatgacatgtaggacccacatgagttaatgacatgtgggttaagatgacatatctcaaattttacaaatttataatggcatggttctaattttctcttagaataagagatggatgacagcaacggcaaactttgcctttggccttaatggcagaggatgtgaacccgccatccaggcaccagcaggaaggatatcatgtttttcccaactcagccatttaatttgaaggctcagtggttctcccaatcgtttagtgtaaccttcaagcatcaatacgaggcgaccataccaacaaaataagaagaaaaacctggcatccatcctaaccatacaaaatcagccagccagtgagtgccagccacactgtacgtataaatgatccatcctctcctcttcttcttattcctttttccttttttttaaatttttttttgcttacaaagggtgaaactttctctctctatataaatggtccttcccggcttcccccacaattctgcacccacgagctataccaagtactctctttctcactcgattgattcaagcagcaaataattagcctagcttactctttccatagctagctagcttgttgcgagcaagatcaggttgccggtgcagtaacagagagcaacca

SEQ ID NO: 56196 - DNA, 721 bp, Oryza sativa
gaataagacgagtggtcaagcagtataagcaaaaagtcaaaatcccttatattatgggatggagggagtatctcacattatgttttggatgttatgtagaaaccatgtctcatgcaagacatgttttcttctctttcctcatttattcatttgccacatcatttttcatactaggtagcagcttatttaatgctatggacaccatcctaatcattgggttggaaatgacctaataccactggtgtttcctgacaaatgaatttttttcttcgttaaatatttgggattttgcacatcctgcatgatttccaagaccatcaagttcacatggatccaaatcatgaatatgttaataataagtagcattaaatttaagtatggaatagcggggcttgatttgaaagattagtgtttagtactagtttcttgatgatgtagagtttatggaaatttctagtgtcttgggttgggaatggccttacgtgaagtcatggatgcacacaaaggaataaatcctagtgcccaccaagaactacactcaggtttttaatattgatgcccacgaatattactcgttctaaaaagagacggagactaacgtcaatttcctgccaaacaatttattatacgaaaagaagcaatctgcagttgctacgtttgaaattgcttccaacacaaagtaaccacggtgaaagctgaaacaaccaccatatcgatttgt

SEQ ID NO: 56197 - DNA, 1501 bp, Oryza sativa
catacctgctgttatggagcctccaggtgagttaataaacaatttgatgtccttagttttatcctcagcatccagcagcaagagttggctgatgataagatcagcactcatatcatccacctagtcagcacaaggcattgaaaacaatagatacattattttgcacagtcagttatggcataataaaagtgctatttattacacagaacaaatattttcatttgtgtacacaatacagtgacatgaaatttgttcagagaacagtaccatgaaggtgaagcatagtgcttgatcagtgggcaaatcattaataaaccgtcagattgtaatgtcaagaaaacatgatataacaagaatgtgttagttcaaacagaaaaaagtgttccctgaagtcacttctgctaattattcctaccaaaataatatggcccatacaacaaggaaaagaaagtaaaacgacatacgactcaggaaagagtttgattctgaccctaaccatctcaagcatttaggctgtgttcggagctccaagttcccaaccactctccctcgttttccgcgcacacgcttttcaaaatgctaaacggtgcgttttttgcaaaaaaatttctatacgaaagttgcttaaaaaaattcaaattaatccatttaaaaaaaaatagctaatacttaattaatcacgcgctaatgaaccgctccgttttccgtgcggggagatgggtttccaaccccagtatccaaacacagccttagtttgttcaagaagatgcaacattaccaaggtgacatctaatcattcaacaaacagcactcatgtaaatgtaattctcagcatgaaagattcttgattcacaaggttggcaaaaaggaaacaaaatatatcccatttacatatcttatgcacattctgagctagaaaaagtattaagaaaaaaaaaatcaagatgggaacaactagaacaatttggacaacagcaacaacagaatatcacataatgtatactagagggtgatcatagcatgccatataaaatcttggatgcccattaagtgttactaaaatgcttctagttctttgcaaactacataagtttgagacaacataagtttatataagtcaatacacttttaccacacgcatataagaagccataatcctcaaggaaacaaatatgtgacaatgggcataccaaagaacatattgggctacattttggttgacataattgaattgcaaatctttcttattcctaaactagtgcatttcgttttttttaaaaaaaaatggcgaggaaattacacttaacttttttcacaccataaaattcgcaaacatttcgatattaataattgaacaagaactgcttaatgggtaataacaacacacacagtgcgatttgggggggggaagaagaaaaggctaaccggggagccgaggaagacgatgcgctggcgaaggagcatgttggtggtgtccagctcctcgaggcgcggcttcctt

SEQ ID NO: 56198 - DNA, 1501 bp, Oryza sativa; identical to SEQ ID NO: 20773

SEQ ID NO: 56199 - DNA, 1501 bp, Oryza sativa; identical to SEQ ID NO: 20771

SEQ ID NO: 56200 - DNA, 1501 bp, Oryza sativa
tactattgcagaggattcctcttgtgcatttttttgttcatatctgagccacacatccaagaaagaatggttgcgaaagttacaactcccaacagttgcttcttcttcttcccaatttcttcctagttcacaacctgaaacaagtgaaagcaaggaataaattgtgagttattttccaccaaaaaggtgcctacaaacccaagccgctagaatttagatagactggtccaagatgtaggtggtgaacctgaaaactgagccgtagcaaatccaggaagttcagatattgcaaagcagaggaaacagagtagagtttcagtggaaaggctgagagttgtggggcaaatttctcctccattattttctggaattcagaagtgcgtataaagcaaggtagaagaaagagtaaaagtttcagtgcaaagcctagctatttaaacaacaccaagtcagggtctcgtgccatcccaaaggactgtggtactgcagaaaagtgcatcacaactatgagcgtggaggttcatccctatgttatcgtctttagctcttccagtacattcctatcatccattgatagaagatgcaacgctagcatcattgctgatgactcctaatcctagatttgccttgttataacacttgttttatcattctcatggttagtcgcatatgtaagatcaaagtgtgttttgattcttattctgtgatgaacaattggcatctgtgattattggttttgatatttggagattatcgtcgaagtggttttggagataatcaattttcaggtgatgatcggattcactgttattttatgtgaccggtccgaccgggtggtgtatgccggtcagatcggtggtgatcgagcggtcagaccggccggcccacggtctgaccggccgacgctgtgtcggtttcggtttcgggttgtttctttggatatccgtgattgtttcatggttatggcttctagatggataccatacgtatataatactgttgtttgctaacaatgagtcaagttggtgatagcttggtctcagaatatggtttctttgtttgtttcatgtgtagctgactcgatgcctcgagagagtatttgcggtgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatgcggagtcgaatttggaaggagtccaaatttggtacaattggttatgtaaagtttgtgtcttgtactagagggtttcttaaggtgtttaggactcttagtatgagtttggttcgtggctttaggctgcctacctcatgtataaatagagggggagcgtgaggcttcccggtatcgtttttgtatcgcttttgagagcaactgagttgctagtttcgttagggtttcgagtttagtcgagatttttgtaaggagt

SEQ ID NO: 56201 - DNA, 1501 bp, Oryza sativa
gtttaacctacgagcgctgctgttcgtaaccatcaacgattggcctatacttagcaacgtatccgggcagtctaataaggggtacaagacttgcactcactgtatggatgaaacagaaagtacgtatcttaagcactgtaggaaggttgcgtacatgggtcatcgtcgattccttgctgcaaaccaccctgtacggaagaaaggcaatcactttgaacataaggcggaccaccgtacgaagcctaaacatcgcagtgggaaaacagtgtttgctatggtgaaagatcttaaagtagtgtttggaaaggggcctggcagccagcctattgatagcgaagatggtcacgcggcgatgtggaaaaagaagctctcgtttcgcgaaactgtgcagtaacgcgacggtcaccgtgtagtaacactgtgttttacatgcagtaacaacgctcaaatatagttaaaatatagtcatgatggatctacttttgataagcatttttttttctagcatcatggtgcaaacaattttaaaaaaccatacatgacatcagagatattgttcttaaaagcttttctttttgggatttgactcttcacaagtagtaatacaatagcatgacttgttattactgtacgttactacagttctatcacaaggttaccataagagtctagtaaacacaataagctttgcagtaacaaagtgtcttgcatttcttgaatagtattactacttaaactaggaattgaaactaaaatatatggggttaaagcctcacatgctacccgtatacttgttactacacaaaagtagaagcgttactacataataggtgcatgttaccacttccaagtagatatgttactgtatgataaatgcagtgttactatgtcatttttacgagaagaagttcgaataggtgggccataggtaagtttgtaggtggctttgagcaaggtctgattgatgtaggagtgttttgaataattttatacatttggtaaaaccatgttactgcatgtataaacccctgttactgtaaattacacattctattactgcatgtggagggctaaagttcaaaatgtcaatctttgaaaagcaatagtcataagatatgtattattttttaaaaccgtttccaccatgatgttatcgtgttactgcatgtggaggattaaacttcaaaatgcatctacgtactcccctcctcaagaaccgtttttccttgtcgtaggctttccggaactttcattatatttgagggatgaagtgaataattcaagtcatcaaacaaacataatgaaacatccgacgcctcgagagaagaatattggagacattgctaggcctttagcttgccagtcaacttcaacctgagatgtgcccgtcaaaccactcgtaggcggcgaccagatgtgttacacattcaggagacttgacaaaaatagctaaagatctacaacatctcaaatattctcaactcatactcatgtgaatcta

SEQ ID NO: 56202 - DNA, 1501 bp, Oryza sativa
ctttctctgcttgcttgcttgctttggtaagcttgctggaaagaatggagaaattcagaagcagaattggaggagatagcttagcaaggacattattgatctaagctagggttggattcatggagagagatcagagatgtggttatgggcacagatgaatttaaggccggtggccatggctgtctgaggtctgaactctgaacttagttgggtttggggagatatgatatgctggtaagaggaagagaagtttgaccaaacagaaaccatgcaaagtttaattcttattttttccctttgtatttctctccttttattttcctgggtgcttgctccccgttgaccagtctttggtcatactcatcatcgtactagtgctattactgggagatcaggaggaatttgctaagtacacccggtatcggtaccggccgaaaaacttgacatcgtatactatggtagttcgtagtttgcgaaagaagaaagcattacttggagtagtatggatctactttatgtttttaatgtcaattaatctcatctggttccatttatcttgggaatattacagtgcataattgcataagctttactactttgtagactatttgattccattttgtaagtcaacttgttgtttttccccctgattcagttggttgtgtagaaattaaacacaagagtttccaagaaaggagctccaatctccattgcaaaggagaaaataaaggaggaagaaaagggaacacgcataggcttttctttttcttttgtttaattaatgtcatattcaccataagcattaagctaccatgccaaaagctcagaacttttgacttgtgaaaataaaagataacaagtgtgatgatctaattagctccagccttttccaaagctcacggatattacatcgaaattgcaggtattaatgcgatgccttccagaacaatcacatatttggagcctgatgtggtatgcttattctcactgggataatgacatgctctgttgcattttaagcttgataccaactagtagcatcttttgtgttggcattcactcaccatagaactgctttttggcaaagtttggtggacttaggaaagttcaaaagctcatatagacagtgttgaccgctgaccagtcaaccctccactccaaattgctactggtcaaacggatcaaagaagaggagaatagcacaatactattggcaaaagagaggtcaacttagaaggttggaagaactgaccaggaatcttcaaacctgtttccgtgtgtagagcaggagatggatgacagtgacgcagaggcttcagagcttgtgcttacgactgcgtgctgacccaagaaaagggagtttgtgggtcacagccgcacaaggaatagttccccccccccctttttttttcttatcattatttgctaagcaatcagaaatagtagtagtacatgcacagaatgagattctagcctaagggaatagtagtaataattaagt

SEQ ID NO: 56203 - DNA, 1501 bp, Oryza sativa
gataatatttttttcttggtctttgagttaagggtagttatactttatattttggaatggagggagtagctgtcaacaagttaattagggcatgttcactttgatgccattttcaaccatatcattttttgccaaagttaccaaaaaatatctacgtttagttgttggcaaatctggttaatacataagaaatcctgccaaaattttggcattgctaaaaacttggtaaggtttattttgactacaatgtgaacatgcccttaattaaatcagctccgtgcatgcagcttttgactccatccacaaaattcgcatgcatggcgacgtggccggacagcatccaagaagcagatcctttgaacaaatccaagtagctagtccatgttgcatatgatcaccagaaacccaagcggatcaccgatctattagctctctctttaaagttgaagcagaggacgacaagccagcagcacagctagtagctgcaacgtgcaaaaaaaattaggctagctaactctactagcctcttacacacacacaaacacaagagtaggaagagaagattaagagaagaaggattgggttgggttgagtgtttcaaaatttgctgctactaggatccaattgccaacttggcacgcacacggtatgaaactgtgtgccgtatgtctcaaactgcctctctaatagccaaacaagccgtcactacaagagatcttatcatagttccgaaatccacaatagtcccggttccactaaaaacccggttggtggctacagcgggcatatatgatctttagtcccggttggtaagatcatctttagtctcggttctaaagatgttaggccttgtcagacccccagggactaaagatctcggcgatctttagcctggttgataacatcaaccgggactaattatctccctctttatatatgtcttcttcctcctccagcccgagcaagcttcaaattttctccaaaaaagaggggaggtcatgccaaaatttcttgtgaatttttttttggtgattatatacaaatcggaggtgtctaaaaggttagtaacttcatcctccaatgttttttggtgttatattacttttggagctatgtttcacacattttttgtctccaaaactttgttgtaagttgatgagagaaacaaattgtgtggggaagaataatatataggaattttgtttgtttatttaaaaaagttttattctcatagtttaaaatataatgaaaattaatcatggaaaatagaaaacaaactaaattgaaaattaaaagaagtacaacattaatattagtttaaaaattcaaaaataataaataagaattgtttggtggattattttataattattgtatgaataatgatatgtcattattgtatgactattgaaagagtttttaattatttgatcattattgtatgactgtcattattttatgaatatttatttatgtatgactttttttcattacatgtagg

SEQ ID NO: 56204 - DNA, 1501 bp, Oryza sativa
ggagatggaggcatgactcagtgacttgaaggcgtcgacacgtcgtcaccacgcgtcgacgcgtccaggactcggtcggctctcaatctctccctctatgtgtttcttggtcggctgaggatgagggacagaggaagggcgagctggagaggctgccaggtgggtccaggtcatggcaaactaggctagggtgagagggttgggtaagattctgggtaaacttgatttttagatcatttttttcggaattattttctcctctaactttgtaactacataattcaatgtgtagaccagaagaattagtgtagattttactggtggtagatgattacacctagattccattttctttggttgcactaaaaaaataatgggtggactgctcacagaaattaaacaaagatgggctattagaaagctagattgaatttttaggaggcttaaagagaggaggaaaattctagaaaaattatatttaggcatgataactagtctagtatttgaatacattatttcccatgttcacttatgtgcagttaaatgtacttttggatgaaacatggttttagccgattaaaatttaatttgatttcttttagttgtctgctttgaccgtttaatttgaggtatcaacttgagtgttaacacgttaccaaattacggaggataagtttgtgctaatcactatccacataaatttttccatgattttatcttgcacaaaatattttagagaattaggatgacctttgtttgtatatgtattcccacttcataattgcatttaatattattatagggattacattaaattttcttttagactgagaagatgatatttgagtttaatattaagtccacatgttatcacccaagattaactataggtttgtttggtgaaataattcttttagattatgctcatgggacctattatggaatgcaagaccaaaactccaaatgcacaaagaactcgagcctaggcatgcattatgtacatgtatgcttggtgacatttctagtctaatgttgggaatgaaaagattttattttgttctcaaattataatcatgcaatggtttaagttgatcttcacctaaattaaaacggaaatttttggctctctcaaaattggagaagttaacctctaactattttgacaagaaattttaagtcctaaaatttcgggtatgttacactaagaatacaaggaatgtgatagcagccgagaaattgaccatgtttcctcccccctccctttgctttcctagtaggattcggaatactctttggcatgacaatcttaattatctcccatagtctaaaactcacaaaaacatcagaaatacgctaagaataaattaagtaaagaacatgcacacacaaataataataatcatgttgcattaaattgctaaggtcagagaccaacagatgacacattggatagtgctatggccttattaaaagtagcaagagaaattaaatatgcttgtga

SEQ ID NO: 56205 - DNA, 1501 bp, Oryza sativa
gtagcatgtctaggatttttatataggtggttcaacttatataactattttaaatactctaaatataacaaagttagaaatataaattgatcaaatgtacatcataatatattaataaaagaactttgttttcttttttttttcaaaagttcttttgcatatgtatatatatatacattgggttaggaattttttgggtggtcccgggaccaccccaagtctatgtgaaaaggtactgttactcgaaaacaacgaaatgagacggcaagattaattttgtttctgttattaactcgacagtttgtgtgtgatttcagtactaccacgatttcactgtgctgactgctgaagatgagctataaaaaatgttgcacactgcaaattgtggattctctgagcaagtggatctccatacaagtcaacaaagaagtaactccttgtctccatttttaatggcaacaagatcgccagcgagattaagggacagtaactcccactgctaagcaagatcattagcaaccgcactgtaattaaaaagtccagtaattaaagtcatcagtggctggccgaggagggaggcaaagaaggattaaagaaaacaacttgggagcaattagacaaaggacttgatctggacttatatctaactccagcctcttcacctttccaccttctctcccacctctctctctttctctctcttcttcttctctcaaaggttgaggagagagagagagagagatccattgcttccaatggatgtcttcctttcctgagctgctgtctcccgttctctttctgagagcaacttctgatcagattcagattgccaacactgcaaccttctgaagctcaggtacttagtcactgctcagctgcatcatgtttatctgtgtgtttcttcagagttcttggcttggctcctctggtgttcttgtgctctgggttttggagggagaagataatacttgttcatctgccatggatgatgagcagagggatggatgagccatggggttgactctctgggtgttcttggtttcttggctaaggttataggaaggaagtctgaagcttgagccctgtcagttctgtaagatttgagctgattcttggcttccggtttattgccttttgttgtttgattttagtcgaattgttttggggaatcattcatatttgattcgagaagacttcaggatagaaacaaaaacaagggttcatttctcatgcttgcttctcatgtttctgtcaattgacagaaatattaggatttgcttcttttctccatgtaaattttgatttggttaatgaacactcagagagattcagaatgagccaataaacttggttcatcaggtgtaattttttatttcggcatgttgcaccatcttatacttaaaaacaaaattaaccctgtttttttaatgatttttttctgtgatctaagcaagggggttggacaaggattaatctgtgaggctcactctgattgaagcca

SEQ ID NO: 56206 - DNA, 1501 bp, Oryza sativa
tcaaataattaaaaactctttcaatagtcatacaataatgacatatcattattcatacaataattataaaataatccaccaaacaattcttatttattatttttgaatttttaaactaatattaatgttgtacttcttttaattttcaatttagtttgttttctattttccatgattaattttcattatattttaaactatgagaataaaacttttttaaataaacaaacaaaattcctatatattattcttccccacacaatttgtttctctcatcaacttacaacaaagttttggagacaaaaaatgtgtgaaacatagctccaaaagtaatataacaccaaaaaacattggaggatgaagttactaaccttttagacacctccgatttgtatataatcaccaaaaaaaaattcacaagaaattttggcatgacctcccctcttttttggagaaaatttgaagcttgctcgggctggaggaggaagaagacatatataaagagggagataattagtcccggttgatgttatcaaccaggctaaagatcgccgagatctttagtccctgggggtctgacaaggcctaacatctttagaaccgagactaaagatgatcttaccaaccgggactaaagatcatatatgcccgctgtagccaccaaccgggtttttagtggaaccgggactattgtggatttcggaactatgataagatctcttgtagtgacggcttgtttggctattagagaggcagtttgagacatacggcacacagtttcataccgtgtgcgtgccaagttggcaattggatcctagtagcagcaaattttgaaacactcaacccaacccaatccttcttctcttaatcttctcttcctactcttgtgtttgtgtgtgtgtaagaggctagtagagttagctagcctaattttttttgcacgttgcagctactagctgtgctgctggcttgtcgtcctctgcttcaactttaaagagagagctaatagatcggtgatccgcttgggtttctggtgatcatatgcaacatggactagctacttggatttgttcaaaggatctgcttcttggatgctgtccggccacgtcgccatgcatgcgaattttgtggatggagtcaaaagctgcatgcacggagctgatttaattaagggcatgttcacattgtagtcaaaataaaccttaccaagtttttagcaatgccaaaattttggcaggatttcttatgtattaaccagatttgccaacaactaaacgtagatattttttggtaactttggcaaaaaatgatatggttgaaaatggcatcaaagtgaacatgccctaattaacttgttgacagctactccctccattccaaaatataaagtataactacccttaactcaaagaccaagaaaaaaatattatcatcttgtagtttgaatcatcctaataaatataatgcatgcatccaataggattagataacatgagagtaa

SEQ ID NO: 56207 - DNA, 194 bp, Oryza sativa
gatcaaactatagttttgttctgttcgtcctcaacgtggagtagtggcgcttgtgcttccacgtcgccaccaaccatggcgatggccacctacctcgcaccatgacgtcatccaacctcctcctcctccgcttaaacgcgtagcctccattgctctcctcctcctccccaccatggagtcgtcgccgccgccgc

SEQ ID NO: 56208 - DNA, 1501 bp, Oryza sativa
cgctcgagctcgacccgctcgccgtcctcccgcgcgcgttcgccgccgccctgggcatgttcgtcccgctcgccgggaggattggggacggagggcgcgtcgtctggtcggccgccgacgccgtgccccttgttctcgccgcggcggacgacgtgtcggtggccgacgtcgacaccgacagcccgggctccgatttgctggagcggctcgtgccgggggacggcgacggcgacggcgtggcggggtcaccggcgctcgcgctccaggttacgcggttcgcctgcggcggcgtcgcgctggggatgcgggtggcgcacgcgctctgcgacggcgccggcgccaccaagttcctctccgccgcggcgcggttcgcgcgcggggcgcaggagccggcggcggtggcgccggtgtgggagcgggaggaccgtctcggcccgaggcgtccgccgcgcgtggtgaagccgttcgaacgcgtcctctcgctcgacgacgccgccgccgcggtgcacggaccgtacggcgcggccggcgacgcacaaggacagatcgcgagggagtgcttccacgtgagcgacgcgcgcgtggaggagctcagggcgcagctcgccggcgaggccggcatcaagctcacaacgttcgagttcctcgccgcgttcatctggcgcgccaggttacactgatcccgtcgaacacctgggacaacaaggtgattttatctcctctcgtttaactccgccatggaatcggtgatcgagcaggacgaaagccagaaggacgagccccgacgaggtcgtgaagatggtgtactccatgaacatcagcaagctcctcacgccgcctctcccggacggctactggggcaacgtgtgcgtcccagtgtacgtcgccctcaccgccggcgagctcgtcgcccagccgctcgcggacacagccgccatggtcaagaagagcaagcaggaggtggacgacgagtacgtccgatcctacatcgacttccacgagctccaccgcggcggcggcgtcacggcggggcgcggcgtgagcgcgttcaccgactggcgccgcctcggccactcggaggtggacttcgggtggggctcgccggcggccgtgctgccgctctcgtggaggctgctcgggagcacggagccgtgcttcttcgtgccgtacggcgcagccgacgagaggcggcggcgcgggttcaaggtgttcgtcgcggtgccggcgatggcgacgcactgcttcagagaggagatgcaggagctatcgttgcaacgccattgcctgcgttcgaaagagaagctgtaaatttcacacgaaaacagtccgttcaaattcaaaatggatagtactcattcaaataaagatcttcatacacatttccgaaccgcaatgggagtgaatcctgtttggatgggccaaaaaataaaatggtcgatcaagaaatttgaaatttccaactccgaatccgataagaaatcaaacacccctgtgtactgtt

SEQ ID NO: 56209 - DNA, 185 bp, Oryza sativa
ggtttcggaaaaaattcttggtattgaagacttgttctggacaaaaatgattcttagagaaaatgcgggccatatttctagaaaagaggggggaaatatggtgaaaataattttatgagggaagaagttcggcgaagttatttttgtttaactacagtgcaaaacgcgtttgacaacagagccga

SEQ ID NO: 56210 - DNA, 1501 bp, Oryza sativa
aaacagaactccgtgatctcattattctagattctatcaaagtaaaattaaaatcacgcaaacataagtacattaggtcccatcgtttcgctttttggggaataagccaaacggcatatttataaatgaaaaataatttataagtaaaacttttatatacgtgtttttagtgatatcaaagcaaaggttgaaaaataaacttcgatgaaaaaaccctaaaattaaaaattcaaattttgaccgataagtataagcataagcaaagaaaggacataggatatattctatctatactactttaaaatataatagcagtgatgagatgaatttatcatcatcatccaactatcatgcagaacccacataaaccgtgagtccctgagataagattttccatattttcgattcccataggccacacagatcccatcatagaaaaatgataatatcttgcaagataataatagcattatctatggctaactgtacctaagaagttacagcaaaaatagcacaattacgcgagatatatatatatatatatatatatatatatatatatatatatgaatgaaagattacgatatatatattagacaacggaatagtttttagggacttaaaaatgcatatataatgagttattgtttttttaaaaaataactgtctattacaccgtacgaatattttgctagtccggacaactctaccctgaattttctgaatatatggatttagcattttcaggtgccggtaagtcttctcgctgaagattccattgccaacctgatggtacgaccgcacgcgcaaaatcttagccatttccttgcaaatgggcttggattggaaacctcccaatttccaagcaattcagagcattcaaccaacagctacgcttaaggaaagtaatttgaaatgttttttcatacttttttatgataaaaggaaatggtttgcattcccgccctggcctttggcttaagtaggcagaccgtcaatagatttttctacttatacatacttgtctggcgaaatttaaattttcaactttcaaatttagagttgattttagatttttttcatcaaagtttattttccagtctttgcttttaaatagataagaacacgtaacttttatttacaaaatacttttcatttgtaaatatgccgtttggtttattccactaaatgaaaagacaaagtgatgggatatatctctaggccgtgcaaaaagaaaccatctaaaatgctataaagaccacgtagattatactaagtaattttacatatcttcacataataagagaattttagctattgacttcaaaagtgtagcatcattacacatagcattatactacgtctatgataacactatactttaagtggatatcccttcgtaaccttgttataacatcgaataatcataatctttttcaattcgtttaacgattattcgaatgacatttgaaaaaaaatatatagatgaatgttatgtgtt

SEQ ID NO: 56211 - DNA, 1501 bp, Oryza sativa
gtgaccgtcagccgcggtgattgttctcattgttaggtcgatcatgctgtagagaaagtataacagtagagcttttttcttccattttattagtgttggtgaatggtgatgattttatctcaaatcgaggtagccttcctgttcttctatcgtcctcagtgacatctgtaaattccgtccaaattatgtcagtgcagttaaagtactcttaatagctactccccgttttatattataagtcattttaactttagttaaattacttaaactactactacaagtttgttcaagtttgtaaataaatacagtaatatttacaacatcaaattagtttcactaatctataattgaatatatattttaataatatatttgtcttggggtgaaaatattactgttttttttctacaaactcaaaacgattataatatgaagcagatggagtaataatgcccttgcttaggaaggagtgaagcatcatggcccctgcatccaaaaaagattagattttacaacatactccctcctttgttcagattcattatcttagaatagatcacatctctatcctaggtgattcatttggacatagggagtaacttgcaacctaaaatactccatctttcctacaatatcataacctaaaactggatgagacatatccaaatacaacaaatctaaatagggttttgtccagattcattgtataaatatacattcaatttaagattgttatagtttgggacgaaaggagtattacttttgccactaagaaaaaaaataatttatcctgcatgtaacaaagatcaaacaatgtatgtttaccaggctcatcaggttctgattaataattcaatttatctttccatttactccctctatatttttttgtttgacgttggttagctcaaaattgaactaaccaacgtcatatatttgtgcaaggaggtagtaagtcttaaatacgtaaaaattacaatatatgactaacatatttggagaaaccaaaatatgaaataagtctaatatttttggaaggagggagtagattctagtgtccacgaatatggcttggttcttgcgtccaagccggctttaagtttacagcccgcttctcctctctctcctctcttctctcctacacttcagcatttagtcagcttatagcctactattatacttgctctaaggctatgttaccttcaaacttccaacttttctgtcatatcaaatgtttggacacatgcatggaacattaaatgtggatgaaaaaaccaattgcatagtttacatgtaaattgcaagacgaatcttttgagcctaattgtgccatgatttgacaatgtagtgctacagtaaatatttgctaatgatggattaattaggcttaatagatttgcctcgcagtttactggcgaaatctgtaatttgttttgttattaatctacgtttaatacttcatataggttcgtatatgttaattttttttttgaaaagtaac

SEQ ID NO: 56212 - DNA, 1501 bp, Oryza sativa
cgtgtgaccgtcagccgcggtgattgttctcattgttaggtcgatcatgctgtagagaaagtataacagtagagcttttttcttccattttattagtgttggtgaatggtgatgattttatctcaaatcgaggtagccttcctgttcttctatcgtcctcagtgacatctgtaaattccgtccaaattatgtcagtgcagttaaagtactcttaatagctactccccgttttatattataagtcattttaactttagttaaattacttaaactactactacaagtttgttcaagtttgtaaataaatacagtaatatttacaacatcaaattagtttcactaatctataattgaatatatattttaataatatatttgtcttggggtgaaaatattactgttttttttctacaaactcaaaacgattataatatgaagcagatggagtaataatgcccttgcttaggaaggagtgaagcatcatggcccctgcatccaaaaaagattagattttacaacatactccctcctttgttcagattcattatcttagaatagatcacatctctatcctaggtgattcatttggacatagggagtaacttgcaacctaaaatactccatctttcctacaatatcataacctaaaactggatgagacatatccaaatacaacaaatctaaatagggttttgtccagattcattgtataaatatacattcaatttaagattgttatagtttgggacgaaaggagtattacttttgccactaagaaaaaaaataatttatcctgcatgtaacaaagatcaaacaatgtatgtttaccaggctcatcaggttctgattaataattcaatttatctttccatttactccctctatatttttttgtttgacgttggttagctcaaaattgaactaaccaacgtcatatatttgtgcaaggaggtagtaagtcttaaatacgtaaaaattacaatatatgactaacatatttggagaaaccaaaatatgaaataagtctaatatttttggaaggagggagtagattctagtgtccacgaatatggcttggttcttgcgtccaagccggctttaagtttacagcccgcttctcctctctctcctctcttctctcctacacttcagcatttagtcagcttatagcctactattatacttgctctaaggctatgttaccttcaaacttccaacttttctgtcatatcaaatgtttggacacatgcatggaacattaaatgtggatgaaaaaaccaattgcatagtttacatgtaaattgcaagacgaatcttttgagcctaattgtgccatgatttgacaatgtagtgctacagtaaatatttgctaatgatggattaattaggcttaatagatttgcctcgcagtttactggcgaaatctgtaatttgttttgttattaatctacgtttaatacttcatataggttcgtatatgttaattttttttttgaaaagt

SEQ ID NO: 56213 - DNA, 1501 bp, Oryza sativa; identical to SEQ ID NO: 20768

SEQ ID NO: 56214 - DNA, 551 bp, Oryza sativa
ccacgatttgacaatatgatgctacattaaacatttactaatgacggattaattaggcttaataaattcgtctcgcagtttacaggtggaatctgtaatttgttttgttattagtatacgtttaatacttcaaatctacgtccgtatacttcaaaaactttacacccaaataactaaacacacccataaaattgtaatttatcgatcaatataactaataaaaaatacataaaacttccgggtattcttttccatccctattttctggttttttttctacttcgctttttttctcgccttttttccggttatttttatcactattttattaagtagcgatttttatcacgcggaagggtgtgtgcaagcagtttttttaatctgactgttttttcgttgacgggccgaacctagcgctgccgccacgtcatctacctcccaagtgttttctcttccaattaattgcaaaaatcaatttcctacttttttttaattacacactacaatacagacactcacaacgcacgcacgcaaaccctacctctattagg

SEQ ID NO: 56215 - DNA, 1501 bp, Oryza sativa
aagaggagattgagtggataaaaaaaaccccaaccaattttgggtgatcgagaaagattcggccggatttgatgggggaacaaatagttttacactctaatttgagatgtttttatgggtactttgtacgtgatccgtgttttatgctatctgtgctacttaaatctccattgtctgttaaaaagaaaataaaagtctgactcaaagaggtaaaagaaaaagtccgactcaaaagcgataaaaaagcttgtgtcgtcagtaaaaataaaaaacaaacatctcgtcgtaaaaaaatcatccgacttccttaaagggaaaaatggtctcgccaataaaaaacaaaaaaaaagtccgtttggtttttttggcacggtttttttttctattcttttgcacgtgaaagagttttttttacgcacgcgcttaggctcttggttttttcatccgttttttaatccaatcacgtctctcggacgctttgttgccggttttttctcccatacgcttttggtttttctaatctcgtattttaatctgatctgttcgcgcacgcctcctgagttgaaccctgccaccgcgccgccgccatatcgattgtgtgttatctccttcaacttaattaaaaaaatcgattccccactcctttctcatcattttctccattatttccactttcgattcggctttaatttgtcagatttaatgtctgtacggcgatcttcctggcaccatttgtggctgggtcgaagggaagcgggccaaacggtgggagatagcggactcgcctagggctaaaacggaaggaaggctatcgcccctaaacacgggaaatattttcattaacttttttaattataatctatagagatcccaatattaggattctcgttaactttttcaattataatgtatatagcgaacacaatattttaatttattgctcagctcttaatatatcagtgaaaaaacgtctgtacctgtttcaaggcacaggtattatttctagtatatataaaatatatataaagtttatttgtattaatttaaagtatatagatatgtattgatgggactaggggtgagttgatcgcgccggtgtagcctcgtgtggctggccgccgatcagcagcccccccttggagtcggtttgagacggcaccgacggatcgggattcgagtggtgccgaccaggccactgctaggacccgtgttagcccaccgagtatttagagccagcttgacatggaattcttatatataagtacgaattacccttccctaaactatcacggtcgatcgaattatccccctcgacccaatcgagagcggttttatcctacggcatacacatgtcaatccaatgagcatttctttttttaatggtgtggcccacctatcagatatactctttcacatcctcttcccctctctcgctctctctctcaggcgtcgttgggcgcgggtcacgcggcggcaggcgttcggcgtgcacggcgggtag

SEQ ID NO: 56216 - DNA, 543 bp, Oryza sativa
aaaatggtcccttggcccacttaaagcgtcatgtgggtttgtgaactcaagaaatatttacccttgatggcaaaatttctacgaaggtgtgttatttagtccgtatttatttagagtatgcacatgcgtacatgttcattcaacagataagaagatatctttgacctccaagtttctctggcgtgcacagtatatgcgtccttggttataacttatactaaaccaaattcggttaggtgacttcatatgtagtgtttgacgttgcaatgttggaaaatctccatgtagtattgtgattgaattgctcaagaatttccgggcaaaatcatatcaaatccaagcatccttagtgggacataaactagcagctatataacctattattttccagaacgatgaatttgtatcgctgaaaggatgattggctaggccaattatttcaaactcacagaaaacctataaccattttttagggggaaaaaactgcataacataggtaacggtgtcatccgtcactccccaaaatctcaagcgaatatttta

SEQ ID NO: 56217 - DNA, 413 bp, Oryza sativa
acctgagttagcccatatataattttttatgcttaacacaacaagctaacttgtcaaataggaaatgccaatttatgtgtttcaccctactttggttgattctctgataatgctaagctaactttgttgcagtggtttgaatacataagctgcggagctttcttgctttcttgtttttcttgcttgcaatattagtacacatggtaaacaggaacccaagttcacagttcatgtagttgggattgatcatagaattcactgtagcgaattttatatgattgataatggagtggccgcctggccggtggacactcatgttgcgccgtataaatatcaaatagaaacttacacattctgaagagcgaacaattgttttgaatctttctgacatgtgctaccacttgttttgcaga

SEQ ID NO: 56218 - DNA, 1501 bp, Oryza sativa
tattaaccctccggatctatttggaaaggcaccacaaaccggatgttagatgcagagattcattgaaaagaaagtctccagtctcaatctaagtgtcatcttgtgatggctcttgtaaacaaatatcctctcatctgttttctagcatggctgatggctttatgagttatgataaccacattggcatttaactgcggttatacatacatatacatatacatatacatatacatatacatatacatatacatatacatatacatatacatatacatatacatatacatatacatatacatatacatatacatatacatatacatatacatatacatatacatatacatatacatatacatatacatatacatatacatacacatatacatacacacacacacacacacttgcgtgcaatttgttgagaagtgttttctgcctcaaaaaaaaatgaaatattgcagactaggtttaagaaagtagagaaaaaccagaaatcctgtctgattttttgcctttttaaaaaggtccaattcaaggcataaatgacatctttcttccttgtagaatagatgcttttttttatgtgttatatacctgattcaaatatagaatcttgaaaacccttgctcttaaaaaaaaaacattgtagaatatgtttttttgccatctggctagggagcagattttttgacatgttttcctaatcctcttatcctcactgtagatcatcaaataagaatgtcagtatgctatgttgatgtcttataaagacttatcttattattcactatacatacaatgacttaaggagaaggaaacaagtgcgaacaaactggatcttccctaggaaaattttggctggacaccataaacttgtcaaggatattacttctaaacacaaatgataaaacctgactctgatttcttgcagtcatcacctcatgcatacttccatgatttcttataatacatcgcttaaaaccacacatttatcttcgctttgttttcttccccttaatgaaatgaaacgcagttctcttgcattttcgagaaaaaaaactgcacatttatggtcatagctctagagaaccccaaatttcatgtctaaatgcacccaaacaaggcttgtggtcataaattttcatagacctaaccagagccaaaatgtagcatatgcttgtgttcaaattgatgtctgctagcaaggtgaacaactgtagtactgtaccattgtctcatgtggttgtgtctcaaccaaagctaagcttagtaggattttgttggaggcagggacaaatttgttgacaacgttcattgatccatagtaaaaccaaccgaatgcaataccttggggatgagtgccattagccaataaatctgcggtgttctgctaacataacctttagcatgtggtttatgtaattttcttgtttatgtgttatttctcttgattgggtaatatagttgtaactttacttttcttgtttcttggtataga

SEQ ID NO: 56219 - DNA, 280 bp, Oryza sativa
ttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaa

SEQ ID NO: 56220 - DNA, 361 bp, Oryza sativa
  unsure (1)..(361): unsure at all n locations
cgcgggccatgaatgccatcgaatgcacgnacanataaaattttattggttagtcggcgctgaacatctattatcgcatcgattcaactcaagaggcatcaattctactcatccctgttaacggtgactctgtgccgggctgctggcagatcctaaatatttgagttttaatttattcatttgtcaaaagttatttgtctctgttcaaggatgatttatgttccaaaaagaaaaaaaaattgagtcatgtttgctccttttcttttattttctttttctttgggtccaatttaattaagtctagtttgtgcagctaacttaaaaatatgcattaattccttcctttcaatgttcctttata

SEQ ID NO: 56221 - DNA, 1501 bp, Oryza sativa
ccatcgattttacctgaatgcgctgatttgattcgagggatggcttgggagaggtgaggaattgaggcggtggatcacaggaaggattttaatgaacttttcgaaggtggattcgagtggaatggtgaaccctagtttgccggcgcagctctgtactgtagcaggaagtggggaaaatggcgagagttctggcggggaagacgaagtggcgcttggatcacgtgattttttgttaagggtatcggaggtgcgaatgggcttaggcttgaacagtacctcagcccaatacttttaacagcgtggcccattgtgctccttagggacttaggcattttttgctttggcaacttatgcgcacaatagtgttgcccaatgctgataaaatctttttttacgcggtcatataattcttcggaattattacaatgcgaattttcaggtgtggcctgtcacgttcttttagggactcaggcacttttcgcttaggccaaagtgcgcgtgatcaagtgctcaataccttaaaatccttttataccgcagttactcaactttttaagagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcattttttattgaccaatattatggcttaggctgattatatattatagtcatttttccttaggcggttggtaaatcctttatgagtttatttactcggattttacaccacatatgcctgttttcattatgatggatagtcatagcttaggctattagacttattcattaccataatttttataatgtttggtgggtaatctttagagttttttattcggatgcctgtcaagtgtgttcattcgtgaaccttttagagtgttaaccactcggattctttttattatgactaaaaagcagtcggctagaatgcctctttaggcgccgcatatgcttctgtcatatgatgcatgattgtgctattattttgttctcaactatatgtttagtttgttaactaatcacatagttgggggctacacctaattaggtgcatctattcgatgcaccatattccttattttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgaggatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactcc

SEQ ID NO: 56222 - DNA, 156 bp, Oryza sativa
cgaattcgagctcggtaccccgatctcgatcagggaggaggagactcgcgtgttggcggtggcaacggaggtagccgggcgggtagcggcggcgtccctgcgagcagcggaggcgctgtggtgccggtcagaggcgactggacccgtgcctggcca

SEQ ID NO: 56223 - DNA, 1501 bp, Oryza sativa; identical to SEQ ID NO: 46683

SEQ ID NO: 56224 - DNA, 796 bp, Oryza sativa
tagttggcagattaattgataaaccaatcatgattaaccatcatgagctattattaaaccatcattaaataatagtgaagcataagttatcccagtagtgtgctaatgtttctaagcatggctaagcaattatgcctaacatctagctgaaccatcatataaagctcaactagtcaaattacattaacccaaggtatcaaagaataaagtaatcaagaacaaaagggccataacaaataataggttaattccacccaatgacattcgaaaataaatgcaatagttgaatagaaacaatagctttaaacaggatcaacatgctcaaagggttgttaggaatctgtgtgacttgccttgctggccttggaaatcctcaaagtcttctcctgcaaaatcagactctcccggaacgtcggaatctaaagagaaaagaacaaaatcaccaaaacagcacataaacacgcatgaacagtacatgtggatatttttaacatgtagatctcaattttagaaaaatttagagacttgaaccaactaaatccgagctaagatgaattagttatgaattttcaaagattaaatcgatttaaatcatttatgtagattttaattgaattatgacgcaataattaattatttttgaaaaggaaaagggaattattgcatcagcgggtcgggtttacggttgaccgggtgcacggcggcggttcacgaaacggacggccgagatcgatccatccaaaatggacggccgagatccatcggtccacggctagaccacgagggatgatgacga

SEQ ID NO: 56225 - DNA, 333 bp, Oryza sativa
  unsure (1)..(333): unsure at all n locations
cgcgcgccagataaggaccgtctcctacngcaagtagnacatcatcttagatggaccgtacgtgaaaatgagccgattttcccgtgcggacctattaagagggccgcatgcaaaaatactaactccctcttttcccactcacacactttaaaatttcacctctttctctcctctcccctcccctcaatcccattttcaactttaaaatttccacgcagagcttcttctctcagtcctctctctctcacgcttctcctctcctctctccaatgtcctctcctctctccactgtcctctcctctcctcccgatggcggcagcggcggcggcgcgc

SEQ ID NO: 56226 - DNA, 693 bp, Oryza sativa
aatagtcaatcatgagtatccccttagtatgagctagtgtctctaagcatgggtaagcatcctattcgctttagctaaagccatataatgttctagctgatcaaatgtattgaccaagtgacaaagaatagggaatcgatagcaaaagggctataacgaggcaataggttatttccacccaatgacattcgaaaatgaatgcaatagttttatagaaacagtagctttaaacgggatcaacatgcttaaagggttgtttgggatctgtgtgacttgccttgctggctttgtaactcttcaaagtcttctcctgcaaattcggactctccgggaacgtcggaatctaaagagaaaagagcaaaatcaccaaaacagcacataaacaagcatgaacagtacatgtggatatttttaacatgtagatctcaattttagaaaaatttagagacttgaaccaactaaatccgagctaagatgaattatttatgaattttcaaagattaaatcggattaaatcatttatatagattttaattgaattatgacgcaataatgaattatttttgaaaagaaaaagggattattgcgtcagcggctcgggttcacggtggaccaggtgcacggcggcggtctacgaaaacgaacggctgagatcttatcgatctaccgccggtccacggctagcgtcagcgc

SEQ ID NO: 56227 - DNA, 1501 bp, Oryza sativa
atttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccaaggcccggcaattagttaaccatagacatattttagttaatggtcgtatagtcgatataccaagttttcgttgcaaaccc

SEQ ID NO: 56228 - DNA, 632 bp, Oryza sativa
tgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaa

SEQ ID NO: 56229 - DNA, 519 bp, Oryza sativa
tcacggcccatccggcctctccccacgcgcgcgccgctgacgggtgggcccgcccgccaccctcgctgacgggtggggcccacccgtcatctccttcctcccgccgctcccgccgcctcgcccgcgcctagcgccgccgccgccgtgaatcccgccgcctcccgtcgtcccgcgtgaaatcaataggggggaattactccccgtgatcccctccccgtttccccccattttcccctctctctctctctcgcattcaaacggctggatttgctcccgcaaatctcgccggcgccattgatggcggtcggacctcccggccggtttccttccttccccggccgccctctcccccttccaaccccatttaaaccctccccgcacctccttcgcccgtttccacccttttgccgcaccttctccacgccggaatcgagctcgcgccgtcgccctctctctcctccgtcgccgacgaccttcggccggctctctccgctcgccgggaccgtttcccgccccagc

SEQ ID NO: 56230 - DNA, 195 bp, Oryza sativa
ttgcctgtggagtggagtcgccccgctgcagaagtcaagcttccgagtctagctcgttttttcttttccgctgcatttgtaatcttttatatttttgtaagacgtggatctgtatgtcaacaactgtcgtttgtgtaccctggctggtcctagacagggatttaatgcacattcagcttaaaaattctggttcgt

SEQ ID NO: 56231 - DNA, 1501 bp, Oryza sativa
tcattacggggtgccagactgtgaagcggcgagaagtccgtgggggtcgcgagggagtccattgcccctggttatgagggggagattatgatcaggaacggtgcaatgtggtgagttgtgttgtgtgagaggtattgtcatagttcctttccaaggtaccgtggtggtactgaggcgcatgctgacatgttgtggagttgtgtcttgtgggtacagtggtacatatctgatcagagtaaaactattcgaatagccgtgcccgcggttatgggtgggtctaacaatgtttttcgtgattagtctcacattactcagtattaatgaaaatactgtgataactaaattgactcttggtttggaatggtatatttcctagtttggaggtttgatttgtacacctaggggttggttggtcaaattaaggttgggcctatgcaacatgggtgtgttgtatagtgtttatttaatattgcttaattacataactgttttactattctctttcaaatgtttattaaatgctttttatgccaatgagcttaattatgccatcctttgttattctgtgcatttgcatatttgctgtgtggcttgtcgagtatatcatatgctcattctgccatttttcattcttcagaggaggagtgcttcagtgaaggtgatgatcaggaggattaggctttgttcgggtcgagttgcttgtggagtggagtcgccaaagatgtttagtcttttgttttttttccgctgcgtagaactttattctttgagaggaactatccacctctgtaataatttattttgcgcatattaattaattatttgatagtactctattatcaatttgttattgtgtgcctcggatgattcctggacgagggtttgacgcacatgtaagcgtttggaattttggatagaaattccgggcgtgacaagttggtatcagagccaccttgaccttaggacaagccaaatggtaaaccttaagtttccttcaaattattttggaaaatagaactgctcttctctattctcttataaattaattaagttggcaccacatgcaaggttatgtacaaaatttattaaattctaatttagcaaaacagaaatttgttcttttattttgaaagaaaaagaactttactgtttagggtattaaatagtataattttctgaatttcattggttagtcggcactgtacatctattatggtatcgattcaatcaagatggcatcagtactactcatccctgttaatggtgactctgtaccgtgctcctggtagatcctaaatattttagttttaatttattcatttgtcaaaagttatttgtctctgttcaaggttgatttatgttccaaaaagaaaaaaaaattgagtcatgtttgctccttttcttttattttctttttctttgggtccaatttaattaagtctagtttgtgcagctaacttaaaaatatgcattaattccttcctttcaatgttcctttata

SEQ ID NO: 56232 - DNA, 1501 bp, Oryza sativa
ctataggtttgtttagtgaaataattcttttagattatgctcatgggacctattatggaatgcaagaccaaaactccaaatgcacaaagaactcaagcctaggcatgcattatgtacatgtatgcttgatgatatttctagtctaatgttgggaatgaaaaggttttattttgttctcaaattttaatcatgcaatggtttaagttggtcatcacctaaattaaaacagaaatttttggctctcaaaattggagaaattaacctctaactattttgacaagaaattttaagtcctaaaatttcgggtatgttacacatgcattagccattcatgatttacaatgcataacctaaacatatagcaaaccagatatgctagcttttgcttagccctgccaagttagattgcataaaatataatgaacttagattgggacagtacgcaagatttggttgatttccgggtggctagtactgtctcggtcgatataagtttaccaagtacttatgtcaaacgaacgagtacgaccgcagcttctacaatggggacagacctagatattatgttaattaacaatgtggtacctctgtacagtggttcttatgtaagtcctcgcgaaggaggcaaatatatgccgcgaagggcaaatgtgatatttaccgaggcgcaggtaaatatcttgattatcgcgcgatgtgtgtgtaaatttatgaaaacctggttgagatgacgtgggaatgccagaactcctctcgctgctgataacgttacagtcatagcgcatggggactagagttcatggaacaggtgccacaattgttaataacctaataatgggccatgactaagctaatgattagtggcaagtcatggactgcgggtaaagcgtacatctactgcagtatgaatatccttgaatctattcgaatagccgaactgacggatttgaggatcgggactcatatggtactttggttagaaactcaattccagattttattaaatactattgcatcaaatacgttgcaggctttctccctctttattctcagccttctgcaagtaaacctagctctacacggatattacctctcatgcattcattgttgaataatataatagcttgctgagtacgttgtactcacccttacttcaacccctctttttcagagtctatttggagttcttgttgatgctgggagttcaatcacataagttagttccctttaaacctaatcttcaagtctagcatagttagatggtttaattctatagtaaaacggcagagttgagtcatcgtatagcttctgctgtaatagttagccacaaacttgtaaatgtcctattattttatataaagatatctcctttggagtcttgactaaatgtatgcaatgaagatccagattgttgaacctatatcaatctactgatccagggcttgatacagttaaacatgtcggtttccaaatcattagttttgggatccgacatgttttg

SEQ ID NO: 56233 - DNA, 1022 bp, Oryza sativa
tattgttctttaattaattcaaggccaaaaatccgacaatcaagttgggacaagaaagtatagcgcctagacaaagcatctgcaatcgcattatctttccctttcttgtgtttgataacataaggaaaagattcaatgaattcaacccattttgcatgtctacgattcaaattattttgagagcgaagatatttaagcgattcgtgatcggagtgaataacaatttttttaggccacaaataatgacgccacgtctctaaggaacgtacaagagcatacaattccttatcatacgtggaataattcaaaacatgtcggatcccaaaactaatgatttggaaaccgacatgtttaactgtatcaagccctggatcagtagattgatataggttcaacaatctggatcttcattgcatacatttagtcaagactccaaaggagatatctttatataaaataataggacatttacaagtttgtggctaactattacagcagaagctatacgatgactcaactctgccgttttactatagaattaaaccatctaactatgctagacttgaagattaggtttaaagggaactaacttatgtgattgaactcccagcatcaacaagaactccaaatagactctgaaaaagaggggttgaagtaagggtgagtacaacgtactcagcaagctattatattattcaacaatgaatgcatgagaggtaatatccgtgtagagctaggtttacttgcagaaggctgagaataaagagggagaaagcctgcaacgtatttgatgcaatagtatttaataaaatctggaattgagtttctaaccaaagtaccatatgagtcccgatcctcaaatccgtcagttcggctattcgaatagattcaaggatattcatactgcagtagatgtacgctttacccgcagtccatgacttgccactaatcattagcttagtcatggcccattattaggttattaacaattgtggcacctgttccatgaactctagtcccca

SEQ ID NO: 56234 - DNA, 1501 bp, Oryza sativa; identical to SEQ ID NO: 46690

SEQ ID NO: 56235 - DNA, 1501 bp, Oryza sativa
tccgtgtcgtcggttgcattctcgggctgtctgagctgcaacctaagttaaggtaaataagtcctctatttattttaaggattgcaatgattcatatttatcaccgcgggtaccagcgctacatcctgggactggtactgagatcgcggtttcgtaggaagcggctcgcgctgtttttcctacgacacgctcatatcagatgccgttgtacggcggtgccggattggggtgtgacattatataccacaattgcaaacaagatttatgagtagtagtattatatttgaaaaaagaagatgattgttggttgtctcagtagcttttcctcgtgccacaaccaagtaatgtgtgccttgcttgctagtgcctagttggatgttttggcttgcattggaaccaatagatcgagtaattaagcatgtgcttatgtcttgctgtatgactaagctcgggcgcatgcttgtactggccgggccttggctctgccactggtcgaagaatccgccacggcgtctaaaccataaccttgctttaccccgcctgctcaccgccctcctccatccctgtggctctggcgccgctgtcggcgcctcaccgtcaaccgtagggtcaccgcctcccacaaccatccttctaagcccaacaatctcccctttctttcccctctgtcctcgctcctctcaccccccatctcaacctaggaccataattcatacaatagagatagacacatttcttttcaggggaaaaaacgtctcttgaaataaaaaaaattatgcacctgcacagcagcacaagcaagccaaattaatttgtggaccaatttacttcctccgttcccatttttagctataaatctggacaactatgtgcccagattcataatcaaaagttgctatattttgggatggaggcagtaggactttatcaataaccaaattactcacgacactttgcatgtgcaattttaggtcaggggtaaatatattggggccatcaattaatttatggagcctgaaatggaacagtttaaatccatgttcaaccgcggaaaggccacagcccccttcttgggtgattagtaaggtcgaaggcaacgcgacttttctaatccccacacacccgcctgaaaataacgcgcgcggggctgtggctgtggtgttatttgcttgttcgcttcgggagcaccagctcatcgcaagcgaccgccatggctttcctcacgcttctctcccgcgctctgatctcgccgccgccgccgcctccttatatagccgcgttgctcgtgtgtttctcggcacgcgctcaacccacagctgccacgatcgaacacacgtgcgctcagatcgagctgatgatactagctagctagctagctagctatagctagataggcatgtcgtcgtcaactatataggtgcgcctagcttgctagctgctgccctagctgaagccgatcgatcaaatgtctgaccacgggccgccgccgccgcggtcgtcg

SEQ ID NO: 56236 - DNA, 1501 bp, Oryza sativa
gtgggttcggttggctgtcggaccagctggaggttgctcggacgcgatggggacgcgcgcgacgcgcaggcatggggcgctctttccctctcctgcggggagcggactctgcacggtgggcttgggctcgtgcttctctgatgcggagtttactgggggttgttactctggttttggccgtttggggctttgtggtgacggggacgtaagctgaaagaagccggatcgagagggatcgtgattcattgctcggttgatgcggacgcgtgtgagttggagagcgcgtgattcgttgtcggagccgtggtttatggatggatggggttgcacttgtggggttgatgacgatgctgatgccttccatcgttccctttaatgcacagggaaacatacatacgagcttcatgtgcacactccgtacacaccaattagtaaatgtcacaaaaaatctataaaaattagacatttactcgtaatagtattacatatatatgaaaagtctcgtattcaaatttattgtattttaaccgtaaaaaaaatcagacagttttaagggtaaaaatttgtcaaaaaattgtcttttttattacagctaaaatatattgaagataagatttcacacgtatgtgtaatactattaaaaatatgtctctaattttttctaaaattttctgtgatatttgctagctggtatatacgggaaacttatgtgtatagaatatattcccaatgcacatatgctcatctgaacgtggtaagcttatgtttattttcacgcacaagttcatcctaatacaacacaggaaaccccatgtaggcgtaaatgacttgcacataaagaaagacaactctcacagtttggcgaactagcatatactactaatcggtagaattaaagtttaaatgcacatatcatataataatattttttttgctaatatgaaattttaacaattattaaagacaaataaaaatgcaccgtgacgtttagcacgcgcatactactagtactactaatcgttagaattctgatgcatgtttcatcactccacagtttcaaaggacgctttgatacagaaaaggtacaaagagcagcatgcactaatcgaattctgatgcaatgtttcatcgctccactgtttcaaggacgcttgatacagagagggtacaaagagcgtcatgcgctttgttgctcgagccgtataacaacgggccccactttagtactcctactatggtggacttggtcagctggtctgatgcgccacctgccaatcgacggataccgactgggatacggctgcattatctagcagccagtcctttttgccgctaaggggaatagaccgttggtttggcagttagtacttcgcatctcgcaagctggtttctcgcggtattctggatgggctcttgccgtattctggacgggctcgcggtattctggtctggatgggttgcgcgcatgcgcgctgcgtcgctgccaatggatgggacccgt

SEQ ID NO: 56237 - DNA, 577 bp, Oryza sativa
tgttatcaaagatcgtctcctcaaaatttccatcccaatatagtcccgaagctcgattccttctattgggaatcccgtcatagaaccccatccgtgaactttgtagaatgcccgaaccctaactccgtccagggattcaccttcgcgtcataaactctctccttggttccttcaaaccgattctcaaattcgaattcaacctctcaggttttgattcatctatctttctctctttatcggttcgtcaatctacccttgttttatttctcgaacttctgacccaagtctgaatatgcaaatcgagatcacttccacccttgaactctaaaccccaagattcaatccctttcgccttgagttctccccaaaatgatttccgttctgaaataatctcgaagtccgaacccttctattcagacttctctccaaaatccttacccacatatctcgttgagtagtcaaactcaagctcccaagttacactctctttctctctaaattatccatctccctttgactcgtctccgaatattgttcccttccttgactccttcctattctcctgagaccgagtatc

SEQ ID NO: 56238 - DNA, 816 bp, Oryza sativa
gacggattaacttatttaggaccgacttaaaaaccaatatcgaaaaaataaatggcaacaaaaaagacatcaaagtcaactacaaaaaccaaaaattaggactcaaattttagctgtgggggataacctaaagaacaaacggtgcagttgaatatattggtcaagcgtaacaaagcccctaaaatgtcaatataaattactacggtaagaggtgaagttagcatagctatctggtgaggctcttgtggtggaacctatattcgcctaggtgcaaattttatatttgatacaaatgcttgtagttatggttaattttcagtggtaaacgtgtataaccgtcaacagcaagaggcatacgttgaattcatcaatctcaaaaatataccaaacttgctaccttgtggcgccgatgagttttagcgtcgggtaggcagcctcattgtcgcttgtagctgcagcctgtaacctttgaaacttgtaactctcttctcaaatcttaataaactttggctgtcattcgcaagcccgacaagaaaagacaaataactatatataatgtgtatatgtcgcctacattatatatattatgtttgaaaaacatatataaacaaatacgtgcgggtctctctctatatatatatatatagagctaagattacgtgattataagtgcttatataggtcatgatttctcaagccagccgccagctggcaagcgcaagtgcagttgcaagacatagatcccataagcgtgccggctgcaagacagaagtgcacttgcgctatcctttttttttttcctttttttttgctagc

SEQ ID NO: 56239 - DNA, 441 bp, Oryza sativa
ttattttcctatgggttataatttgattagcatgaaccttatatgttggattggttcagctaaatgctttatgtaggtttgcttagccatgcttagaaacattagctaactaaagggattaattataaactatgttactttattattttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagctagcgtgggcaacggctttatcttttgtatagcatgattcaatatagtgcgccagactgtgaagtggcgagaagtccacgggggtcgctgggtagtccatgccttgtttataag

SEQ ID NO: 56240 - DNA, 1501 bp, Oryza sativa; identical to SEQ ID NO: 46680

SEQ ID NO: 56241 - DNA, 188 bp, Oryza sativa
atttttccgtgtcgtcctctttaatggaccgcttgcgaaaatgagccgattttcccagaagcaacgagataccgcccgcacggaatctaaaagatccctatccaggaaaatcgtttctgtagtagtgattcatgaagttccttctctacttgatcgatccattttctttgtttcttttttggcataga

SEQ ID NO: 56242 - DNA, 1501 bp, Oryza sativa
atcttttgatggtaagtgggccattagcacggtaatagatgtacagtactaacaacataggaataataaataaattttaaatgaaaacagctaaagaagtcataaactgcatgtgctattagtttggtttaattaaaagagaaaaagaggagaatagttctacttttccaatatttttagagggcttctataggtaaccatttggcataacctagggtcaaggaggctctgcaaccaatttgtcacacccggaatttctatccaaaattccaaacgcttacatgtgtataaaccctcgtccaggaatcagccgaggcacacaataacaaattgataatagagtataattattactctaatgaatattcgaataaaatgtcgttatagaggtagatagttcctctcaatcaatatagttctaagcagcggaaaataaaagaaacagcgcaggcgactcctctccataggcagcttgaccagggctacgcctaatcatccacaccatcagcatcgctgtaaaactcctcctctgatgaatgattgcaaggtgagtatatgacatactcagcaagccacgcagcaaatatgcaagtgcacaggataacaaaggatggcatagtataggctcatttgcataaacaacatttaataaatatttcagaatttaatgaaaaagtaaactattaattaaacagtattaatcgaacgctatacaacataccctgttgcataggcccaaccattcccggctgcacagtgctatctccaaactaggaattaaccattccaaaccaggagttaaacaagacattaacatcatcatttaatagagtgagaaatgtgagactaatcacgaaagacattgttagacccgcccataaccgcgggcacggctattcgaataatttaaactctggccagaggtgtaccactgtacccacaagacacaacctcaacatcatgtcaaccatgcgtcgcgatacttgacaagtacccgaattgagattgtgacaataccctctatataatacaattcaaagcagtgcaccgttcccggatcataatgacccccttataaacaaggtatggactccccagcgacccccgtgggcttatcaccgccacttcacagtctggtgctgtacaacgaaccatactatacagaaagtaaagccgttgcccacgctggcttgtggttggcacggtaaatgtttcacaaccaaaacttgtgaaccggtccttaattgtcatgaacacaaccatcaaaaccatatgatcacaacccaccattatcaagttttagttggtaaattaattaattaaccaatcatgggctattattaaaccatcattaaataatagtgaagcataagttatcccagtagtgtgctaatgtttctaagcatggctaagcaattatgcctaacatctagctgaacaatcatataaagctcaactagtcaaattacattaatccaaggtatcaaagaataaagtaatc

SEQ ID NO: 56243 - DNA, 1501 bp, Oryza sativa
tccctcggattcgtttggaaacactcccgcaaacctcgccggcgccattgatggagcccgagatcgccgcgccggtttccttcccctccggccgttctctccccctcccaacactatataaacgctccccgtgcctccctccaccgtttccgccactcgccgctctctctccccgtcggaatcgagctcgcgccgtcactccctctctccgccgtcgccgccgagctccggtccgccgccgtcgtcgccccggaccctctcccgtttcggcgtcgcttttttcgggttcgccgcaacctcgccgacctcgtccacccctccgtttcgcccgccgaccgccggaacgccgtcgccctcgttgacccgagccgcgccgccgccttcctccgctccggtcgccgtcccgtcgtcaccgtcgacccggggtgagccgtggaccgccgtttcacttcccccttccctcccctttctcgggcgccgctccgccgcgccggtggtcgccggcggcgaccatcggggcgcgggcgcgtcgcctcccgtcggcttttccggcgaggccgccttcgggcgcgccccgcggctgccatgtggggcccggccgtcagccgcccgcgccctcgggtgcggctgacgcgtgggacccacggcgccgggcggcgtaatccgcgtgcacccggtccaccgtggaccgagaggctgccgcgtgggccccactcccgtggacccggtccgcgcgctcctcccctcagctgacttaataaatccgattttaaattaaaatttaaatgaagaaattcgcaaatatccatttaaagagcatataaacttcaaatggccataacttggccatttgaactcggaattggaccgttcaagtctctaatttttccttaagaagccaagaacccatttttgtgctttgtttctgtttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattatcattgttattgttattatttccttgttcaccctagaataaacaaaaccccaactagtggacactctactcatggtatcactagtatgattttaggtagatgcttcgcttttaattaggtaacattaggcggttttacaactctagactttggggatattcatatcacgtggacactatggaatggtttggttatcgtggaattggcttcacaccgctccttccattcaaaatccccaaaatggttttaggctgggctcggggtgcatggttttgatagtagcacctcggccatataaggaccggt

SEQ ID NO: 56244 - DNA, 505 bp, Oryza sativa
cttcagaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattatttccttgttcaccctagaataaacaaaaccccaactagtggacactctactcatggtaccactagtatgattttaggtagatgcttcgctggttaattaggcaacattatgtggttttacaactctagactttgggatattcatatcacctggacactatggaatggtttgattattgtggaattggattcacacctccccctctattcaaaaccctcaaaatggttttaggctgggctcggggtgcatggttttgatagtagcacctcggccatacaaggaccggt

SEQ ID NO: 56245 - DNA, 1501 bp, Oryza sativa
attctatctattttcttaataactgtgtccaactctaaaactccttatatcttgggacagtacattggtttatacataggtaacagagatgttagctgtcgagaccgagcgagcgcctaagcaaataaaagatgattttccggctcgacaaaaatgtcttgtgaatgagttcagtaacatcacaatgcttggtgttaatcggatgtaactttagtagaggcattaattagaaacgcgttgattgacaaatgaaaattgtttcaccaatgaggaacacatacgatggtcaaaagatgaacaacatcacagtcggtgctttaatttgcacaatctggacggcataacatgataagcaaaaaacctgactcatcaattaacttcacatctgatccctgaccgaaacaatgtcagatcgatgtaggtagagggacaccaaattaattaactagctagcatggccaaatattaaaggacatatatatatatatatatatatatgtgtgtgtgtgtgtgtgtgtgtgtgtgtgtgtgtgtgtgtgtgtgtgtgtgtatatatatatatatatatatatatatgtactttaatatttacaccgaacttctatttccaaccatgtcgactagatctggacgtacgacaatgaaaaaaaaagtcaagcgaatgtttgttaagctaacacgcgcagtacaaaaagaaaactctacttagattgaatccaagtttattttgtccggccgtgcgttagctttatttgacgtgccattgcttcatttcacataatgaaagcgactaataatataataagtaaggtgcgtacatgcttctattacccgtatggtcacaaaagtattagcattgtcactagaatgcacacctacaatttgattcaaccgggtaaacatcagagattctttttggtttagtagtggtgcataactctactctttagatttaaatcctactagctagtaatcacaattttatacacatgagtgtattaagagatgtactcgattgtgtacgtatacttgtcttccgagtaataaaaaataatttcatttgaaacatgaccaaattaaaatccaaagacaaataatgaaagcttaaaacattaaaaatccgatatattctctccgctcaaataattgtcgctttagctaactccttagttattcttttttttccaaaatacatacagtaggcgctcatataaatgcgcacgtactcacacatacccatccctataagtaccttcaaaaactaagccagtatattctgtaattcacaaagttactatatagatgttttgttgttaaagaatacattgtctaccactaaaaattaattaaccgaaatgcaaacacacgtgactagtaatttaaaaaaaatatacatatttcaaacatcgtggtttttatgtttttagattcacaatgataaatacatccctaatatatataattcacatgttgtttaactacgtgactttctaacgattaa

SEQ ID NO: 56246 - DNA, 1501 bp, Oryza sativa
agactctattttttttctttttatcctattaatatgagaatgtctaggccatgagctgctttttctattactttaataagttataatttcaattatctctaaattgtatggctatatggaatctagtatcctcttccaatattccttagttttttaattttgaattttagttatttttaagttgtatttccatatggattctattttttattttttatcttattaatatgaaaattttctaggtgtgagagcaaaagtggagatttctttttctattactttaataagttaatagattgatagtgcttctgtcaaagatttttttatgtcattcattcgttgtgttttgtccatctccagtcacatcctagcataggaaaaaaaatacaccacatctatactatctatatagttgatgctcgctaactttaaaactcaacatgcaagtgtgtcccatcatcacaaactagcaattattatctagagtattttaaatatcatgcaaatgtggcatatcattcgcaattttattttattttagaactcaatatgcaagtaatgacaaattattatcttcacaatgtttttatattatatatatatatatatatatatatatatatatatatatatatctatatatatatatatatatatatattatttttataatatataacatacattcatccacatattttacagcaaatcgtggggttcaactagttgtatatcggtttagaccgagattcaccatcatcatatatatttcattcattgctgccctgggtgcgtaggtttggaccttggataatttagtttttacattaatctaaaaatgagtgttcatgtcgagtacaaatcactacttattgattttaaatatctacaatattgaaaaaaaatactactccctctattttaaaataattgtcaatattgactttgccttttcaactttgaaatttgatttctcttaaattttaggtaagggtgagaaattaataggatgcaacacactttgacaatgtgatatttgaaaaggtatttatttttaaaagaaatgaataatcaaagcgtgaaggtgaatagtatcactcatagttatttaaaatcgaagggagcaaactgagacttgaacatgaaatcaaatagtttttttttcaattttttaattattaaaacataataaagctataattaagcctccaaactaagtaaaaccttattgataacgaattttataattattaaataatggaaaaaaaacagcagttgagactccaaacacaaacaaaatttgataggtaaggcaaaatcaatgcctttcagctttttcagatcttaatcgatgttttcccccgaaaagggcctcttttcaggtactaagtgaatcatttgccaaaaaggatgaagagaagatttggcagtgcagcgtgcttgtcagcttgtgctgttgtcgttatccttctagacatcgtgttaccataaaaaaagacga

SEQ ID NO: 56247 - DNA, 1365 bp, Oryza sativa
acttctatgcaaacatctaccaaaatagttttcttcaaggcaaattgctgtgtgaaataacggtatgatcagatttgttttatttcatccaaactttaagagacatcaggatatagaggagattatcagataaatgagataatcaaatggaataaaagtccatagttactccacaaaattgagaatatcttttccacacaaggcttgccggttgcggctgttatatgctgtctgctggaagtacgtacgttttcaatgtggttgctttctgccggaattttttacttcagtatcagactatcctagtttggttccttgcttagaccaaacgcacgtaattaactagtcgtgggcactggattccatttattggtatccatccatttgtcaaaagcccttagatcatcagctgataaaaagtctagagcatcagattgtgtggtctcctttactctgcatccacatttgaagacacgcatgtcttgtttctgtagttcccaggcagcactaacaagttctgtcaacttagctacaaaattcatcgtctttttttatggtaacacgatgtctagaaggataacgacaacagcacaagctgacaagcacgctgcactgccaaatcttctcttcatcctttttggcaaatgattcacttagtacctgaaaagaggcccttttcgggggaaaacatcgattaagatctgaaaaagctgaaaggcattgattttgccttacctatcaaattttgtttgtgtttggagtctcaactgctgttttttttccattatttaataattataaaattcgttatcaataaggttttacttagtttggaggcttaattatagctttattatgttttaataattaaaaaattgaaaaaaaaactatttgatttcatgttcaagtctcagtttgctcccttcgattttaaataactatgagtgatactattcaccttcacgctttgattattcatttcttttaaaaataaataccttttcaaatatcacattgtcaaagtgtgttgcatcctattaatttctcacccttacctaaaatttaagagaaatcaaatttcaaagttgaaaaggcaaagtcaatattgacaattattttaaaatagagggagtagtattttttttcaatattgtagatatttaaaatcaataagtagtgatttgtactcgacatgaacactcatttttagattaatgtaaaaactaaattatccaaggtccaaacctacgcacccagggcagcaatgaatgaaatatatatgatgatggtgaatctcggtctaaaccgatatacaactagttgaaccccacgatttgctgtaaaatatgtggatgaatgtatgtt

SEQ ID NO: 56248 - DNA, 1185 bp, Oryza sativa
agaggttttcggacacgaatgaaaaaactaatttcataactcacttggaaaccgcgagacaaatttattaagcctaattaatctatcattaccacgtgtgagttactgtaacacttatagctaatcatgaactaattaggctcaaaagattcgtctcgcgatttccatgcaaactgtgtaattagttttttattttatctatatttaatgctccatgtatgtgttcaaaaattcgatgtgatatttttggaaaaaacttttggaactaaacaaggcctaaatcaatctttacaaatattttatcacctagtgttcgatctataagtaatcccactgattcactaacttaaaaaaccagaagtttggatacaatggtgttagtgtactcatgactgaagtttttgtttttcctatgtgaatcgactttggatataggattttacaagatggtagacttcctgtttatcagtgttatcaacgtttttcttttatactagaaaaaatacacgtgtgttgcaacgggtgaaggttattttaatattattattgttatatggtttacctaaggtgaaattcactgtgtcaattcgtttggatgtatttttttaaaaaaaaatcatgagctgcgcctgggagtctgatcgtctcaaattagcatgagggttttttttaaaagagattccttataagatttcttctttattttaaaaaacgaacgaacttaaaaaccgacttaaatatgcacatgtattttaaaaaacgaacgtacttaaaatccgactcataaacggataatgtaccaaagtaccggcaaacatatttaatttttataatagtagagatagggcctattaagattgatgttattttaaaccatactttatcattgtttggtaaaatcgataaatatatagctgcatttagtttgttaccaaatattagtaatgcatagaaaattttggcataacatatttatttcattctaccaaaatttggtaattctgtccacttaccaaaaatttggtattgctaaattttggaaatgttgatttaatttggcagtaatccccataaaagtatataactatttgattgataattgaccggagaatcaaacaagagagtcgtgaaaaatcatactatactttactgtatatattcttcttgtcgtactcccgtttcagc

SEQ ID NO: 56249 - DNA, 1501 bp, Oryza sativa
cccccgctaccacgagtccacgacaaggagaggcggggagacgagtccctccctaccgctcgaacaggcggccgccgctgcggcgaatcgcgagagcggcgagctccggcccgggggtgcccatcgggcggagcgtgcggtgtctccgagcccggaacctggcgtggcgcgcctgccggcgatagggttggggaggcggatcggccggcgtggtggaaagcggaggtagctgccgggacggagtggggaaggggaacgggaggcggtcggcgctagaggcggcgggcgtgcactttggtcgccattttttcaccgctactgccgccttttttcacttaggtccctcccttatcccttaaatcattccgctgcctgtacggtgtagttagtagtagacttttgccgatggccgcggccctgcccaagcgggagcactcagagcacagcagcccaagcgaatcgagcgacggcgcgacgcacggcacattacgcggacaccccgcgcccacgtgaacctacgacatcagcccacctgctacctccacagaagcacagacgcctcggtcaaaaccatcgtctccacgggaatttttttcggttttagattttattaaaaaaatatttacagaaataatctatcggccaaaaaaattacaaaaatagaccctgtcgcccacctctggagcggcaagctgacgtggcaaacaggggaggaacgggcggtgacggagggagagttttttgcagaaaacccttgccgccctctggtggggcggcaaggggcccgaatgcaaaaaagccagtcggggccgggtattttgcaggcggccccttgccgccctctggccgggcggcaggcctcgctgcctataaaaggcctgctgcccagcccccagccctcattcttctctcctcaattccagtgaaaaaaaaaagaagagaggggaggagaagagaagaaggggcgaagccctgccggattcagacgccaatttcaggtaatattcatagatcctatatgtgaccgctatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatatttcagaactcagtcatattcagtactctcttccccacttgcttcattacaaatccgaccggctttcgtcaatggctagacgccggggtgttgaggatccaaactggcgtagcgatccttgtgtatacctactaccaccttggtgccagcgtcctctctacctatgcggtgatcgatgccaactaatggcttcgaggaatcctaatattcgaggaaggcgcttttttaggtgctatgaccgtgaggtattttattatctgcatatgcttattcattccgtatgggcaatcgctttattcttcgtaacact

SEQ ID NO: 56250 - DNA, 1501 bp, Oryza sativa; identical to SEQ ID NO: 46677

SEQ ID NO: 56251 - DNA, 1501 bp, Oryza sativa; identical to SEQ ID NO: 56221

SEQ ID NO: 56252 - DNA, 1501 bp, Oryza sativa
ggagggagtagctgtcaacaagttaattagggcctgttcactttgatgtcattttcaaccaaatcattttttgccaaagttaccaaaaaaatatctacgtttagttgttgccaaatttggttaatacataagaaatcctgccaaaattttggcattgccaaaaacttggtaaggtttattttgactacaatctgaacatgcccttaattaaatcagctccgtgcatgcagcttttgactccatccgcaaaattcgcatgcatggcgacgtgcccagacagcatccaagaagcagatcctttgaacaaatccaagtagctagtccatgttgcatatgatcaccagaaacccaagcggatcaccgatctattagctctctctttaaagttcaagcagaggacgacaagccagcagcacagctagtagctgcaacgtgcaaaaaaatttaggctagctaactctactagcctcttacacacacacacacaaacacaagagtaggaagagaagattaagagaagaaggattgggttgggttgagtgtttcaaaatttgctgctactaggatccaattgccaacttggcacgcacacagtatgaaactgtatgccgtatgtctcaaactgcctctctaataaccaaacaagccgtcactacaagagatcttatcatagcactggtggagaaaccatctttggtcggtcagccgaaattcacaatattcccggttccactaaaaaccgggactaaagatcatctttagtcccggttggtggctacagcgggcatatatgatctttaatcccagttggtaagatcatctttagtctcggttctaaagatgttaggccttgtcaggcccccggggactaaagatctcggcgatttttagccctggatgataacatcatccgggactaattatctccctctttatatgtgtcttcttcctcctccagcccgagcaagcttcaaattttctccaaaaaagaggggaggtcatgccaaaatttcttgtgaatttttttggtgattatatacaaatcggaggtatctaaaaggttagtaacttcatcctccaatgttttttgttgttatattacttttggagctatgtttcacacattttttgtctccaaaactttgttgtaagttgatgagagaaacaaattgtgtggggaagaataatatataggaattttgtttgtttacttaaaaaagttttattctcatagtttaaaatataatgaaaattaatcatggaaaatagaaaacaaactaaattgaaaattaaaagaagtacaacattaatattagtttaaaaattcaaaaataataaataagaattgtttgttggattattttataattattgtatgaataatgatatgtcattattgtatgactattgaaagagtttttaattatttgatcattattgtatgactgtcattattttatgaatatttatttatgtatgactttttttcattacatgtagg

SEQ ID NO: 56253 - DNA, 1501 bp, Oryza sativa
aagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcatactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgctaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatgctcaaagggttgtttgggatctgtgtgacttgccttgctagccttggaactcttcaaagtcttctcctgcaaattcggactctccaggaacgtcggactctaaagagaaaagagcaaaatcaccaaaacaacacataaacaagcctgaacagtacatgtggatatttttaacatgtagatctcaattttagaaaaatttagagacttgaaccaactaaatccgagctaagatgaattagttatgaattttcatagattaaatcggattaaatcatttatatagattttaattgaattatgacgcaataatgaattatttttgaaaaggaaaaagggattattgcgtcagcggactcggctcacggtggaccgggtgcacggcggtggttcacggaaacgaacggccgagatcgatctatccaaaacggaccaagatctaacggtctacgaccggtctacggtggacggcgtcga

SEQ ID NO: 56254 - DNA, 1501 bp, Oryza sativa; identical to SEQ ID NO: 46683

SEQ ID NO: 56255 - DNA, 1501 bp, Oryza sativa
aagtttttggcaatgccaaaattttggcaggatttcttatgtattaaccaaatttggcaacaactaaacgtagatatttttttggtaactttggcaaaaaatgatttggttgaaaatgacatcaaagtgaacaggccctaattaacttgttgacagctactccctccattccaaaatataaggcataaccacccttaactcaaagatcaagaaataattattatcatcttatagtttgaatcatgctaataaatataatgcatgcatccaataggattagataacatgagagtaaaggatttaaaaaagtaataacttaatgaagaagatgtcatagttaattgcatgcttgcatacatgccttatattatggaacatctaagaaaagtggttgtgccttatattatggaatagagggagtagtacctaattaagcatgtgtgttaatttattattaactagtaatctgcccgtgctaacgctgcggcgacatttagaaatacaaattaagatcgatggatatagctattatgttgttaattaaattgccacatgcataaaataacatagttattatcctggttcaaatggagtcattagtgacaacataccatggtaaaagcaaaagtaattaaactttggaacttggcaccttgaagcatcaaatccttgtctaccttgctgtctccctgtcaccccggccccacttaattctaaattaaatggatgagagaaagagattaatatagtttagtgtgatagtgccaacacatggaaaatttagagcttctagttctgtccttctacatctctcttaaatgtgggaccaagtccttatggggcccactaatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagagagagagggccaatttacacccaaacttcaccatacctctcatcttctcataggaaacatctacatggggccactagacagccactcatacttggttgagtgaagtacgagtgggatcacagcctcaaaccattgccaactcctttaaatcgtctctacccctcatgttgacaactagctctcactttccacctttacttttaccattcactactgcaaccaagatttttgtgtgagggctaaaacgatttttctgagcgggtaggcggcccgcacgcacctaggggtctgggaaaataatgatttttgcgtgcgggtggtgcacccccacgggaaaacaaaaatccgaaataacatatttttttttaaaaaaaatgaaaccctagaatctggcggtgggcttccgcccgacggccatagt

SEQ ID NO: 56256 - DNA, 1501 bp, Oryza sativa
ttattaaatcagattactatatctggattataataagccgatatataataagctgttagctatttgattctctggattattagctgttacacccaataatctactccctccgtctcataatataagggattttgagtttttgcttgcactctttgaccactcgtcttatttaaaaaatttatgcaaatataaaaaacgacaagttgtgttaaagtactttgaataataaagtaagtcaaaaaaataaataataattctaaaattttttgaataagacgagtggtcaaacagtgcaaacaaaaactcagaatcccttatattatgggatggagggagtagaaaaagcacttttagagtggattaccagattatagtaatctggcttatagattataataatctatcataatacgctatctatttgtttcagcttactcctaataatccagattatcataatcctaagctgaatcaaacagggcctaactcggtaatttcaattacatcggcttttgcacgacaataaactcctaagggtcctttgaatagtaggaatgaaaacaaaaatggaggaataagaaaaacacatgattttgacagtaatgtaagtgtgaaacagatgattgcaaaacacaggaaaaacatagaaataatcgtttgactgagtcgcaggaaaaacacaggaatcagatgagagagatatactcaaaggattttttttttccaataggttggacctcttgctaaatttcctccaaaacttacatgcaatgagtcatttcataggaattgtatagaatttggaaaattcaattctttaaatcaaagagccaaatagaaaaattccctataggatttcaaccctatgaaattcctctctaaatgttttgattcaaaggggccctaaaactgtctatagttcatatcttgatagaaaatgagctagatgtggatggataagaaagttgaggtggttcaaagtgatacaatataaaattagctactccctccgttccaaaataagtgtagttttacattattcatgtttaacgtttgaccgttcgtcttatttagaattttttattattagtatttttgttgttattagatgataaaacatgaatagtacttttctgtatgactaatttttttaataaaattttcaaataagacgaatggtcaaatgttggacacgaatatccacggctacacttattttgggccggaggtagtagtttagaataaaaagggtgaataaatgatgcctaaactgaaactttggtaataaaagttggttcaaagttggatgcaccctttcttttcaaagttgttctgatacctgataaggagaaatacggatatagatgcaccggtggagacaggatcacaggaggagcactttatgcttgacctttttagttttgtttggatacattttactactactttaacaccgctgctatatccaggtagatatggcaacggggaattcaccgttagg

SEQ ID NO: 56257 - DNA, 1501 bp, Oryza sativa
ccttccacgtcagcagcaggtgtgattgggcggggagcacatacaacagacacataaccatgttatccgttggcacaacaggtgctcatctagtcatcggtcggtctccgatctatgcagcgcattgtgcagctcgggcattcgatccgaactccaacatctttgtgaagatgagctgtactttatccaaacgttcggtattacgagtactagtttatagtactccgtactagcagtgcatatataagcaggcctgacagcttgacgatgccttttggtgcctccaaacagtgccatcttctaggaactccaaggagtggcaggtttccaaaaaaaaaaaaaggagtggccgagttggggctgagcgagcgagagcggaggagcgggtcgttttttaacgcgcggtgcggcgatgccggtgccaaacgccatccgtcgcgcgcacgcgcgtgggtgctgagctgagccagaacacagggatccaggcctgtgcgcgagccgcgcgcacgggaagctcgctcaagcccaaccacgcctcaacgtggggctcgcttgcccgcgatgccggccggagcagggctcttcgagacatgggttttgcattttgtagtttataggatggactatttcacgcttatcctacagctctttgagacatgggtttgcattttgtaatttataggatggactattccacgcttatcctacagaattttctcaatacacaagcatgcgggtcctaaccccaaaagcaaagaaaaccagagctaatcatggtctagaattctaatcgatagcaattaggtgtgctttacaagtcagccggccctttgttacaagaacgtgcgatagtccgatttccatagcacagttgtatccgaaaaggtaccggctaccagaagttaaagccgcgagtgtcaacttgacggcccgacggctacgaggctaaaaaatggcgggtcccgacggtttgtccaaagccacgcgccacgcgactttagagctgagacccggtgctaccactggttggcccgtgccgctgaccgagtcgtcacgcggccggcctccctggaccagacaccgacccggagcaagagaaagcgaagccgtgaacagtttgctcctccattgtgaaaagagtcaaaattaatctttttccttggtatctcatattctccaactctatgctactaataaacaatcagcataatctttacattgctaattagcatccgagaacaaaattgtcgctctgtcagcatctgattcctcccccgccgaaatttggaaagagggaggaaataaaaatggtaaaaaagaaaaagaaaaaaagagaggctagattactacaatacgcatgcggctcgcgctgttgctgtcagcagttcaacaccgatcagtgtgatcgctcgatcgctccacgtccgtatcgacgggtaagcgcgacttctcgtccgcggcaactctgtcgtcactctccatgttggcggcgcccgctccg

SEQ ID NO: 56258 - DNA, 1501 bp, Oryza sativa
ttttaattatttctcaaagtgtggatcaagttttaacttactgtgtttcatattataagactttctagtattgtccatattcatatagatgttaattaatctagacacatactggatatgtgtctagattaattaacatctatatgaatgtgagtaatgctagaaagtcttataatataaaacggaggaagtaatagatttagatttttggtgcagtgataaatgtcactggatttttccctaaaacattttgtgatcatttatgttgaatttgattgaaaaaagggatatccttgagagattaaaatcaattcctctatttaaggtgtcctagagctcaatgttcaaatcggagaagaaaatcagaaccatagaatatacctatttccctgacaagtttttaaaatttaagcgtaaagaatgagagtcaaacacaaataaaatgggctaacgaaatctcgcgcaggcactactattgccggccatagcgaaaaaaatatcacgcagggcggcattatcatgcatagcttaataagaaacgaaagaaaaaaacatatctgtacgaccatgtgattcctgtttttttttccctcatggcatatcttgatttggaattttgtcatagacttcagaaaaatgttttatcagtacagaatctggacgagttctcgtaaaactgaaatcaataccttagcaataagatttactactaactctgaccagtggtactaaataagataatcaatgccacttactgtagctataaaggagaaggtatgtaactgagtgcacccacaatagttatctataggctctttacaatagatccatgtcaacatattttcctacttggaagagattaaatgaagagagagagcaaagctatctactaacctggagaaagtctatagagaaaaacgaggcaatggattagagagctatagatacccatgtagacataccattgaagtggtttactattaatctagtctattactgagatgtaaatgttttatagatagcaacttactttaccattgcgggtgctctgaagccaaaaggtacttgtgccaacatgtttgtcttggataaactaaaatatgtccttcgaaaagaataaaacaaaacaatattaaaggtataagtacatcgtgtatgttttatatagtaaatctaaataagagctgttgttgaacgcgcaggtacacgaattagcgaaaaggaaatggagataatacgcatgggcggctctggcagatagatacagcagcaaggacaagaaaccaattcaagaagtgtcaaaagcaaagtgctgcgcctatgcgcgctatgagaggaaaaaaggccgggagcagagcactcctcgcctatataaagagaggctcaggcttcccatcccctcgcgcggctcagagcacacagctccaccaacctcacacggcctcaggcctcagcctccaaaggggagacaggagagaaagctaacgcttctctctctctc

SEQ ID NO: 56259 - DNA, 695 bp, Oryza sativa
attaacgttataatgcattttagttttaaggaatgtttaagataaatactttccaattttattatgatgtatggatcaagtagtatgatgcatgaacttcattggcggatctaggaggaaaaaaattaatgatggtttcgtggggttctcatagtggcggttctcgaatattttttttttttgaagaaacccatgcatgaagccaaaaatgtcaaatgtgagagaagtacgaaatggtcagtatctaacctgtggaaaatatggtcacattaccattagtttgagggcggacatacgttcagatgccatttgttgcccaaaagaatcatatctgtaaaaacaaaaatttgaacagatacattccgatttgcctatgaatgaataaaaacactaatggacatgagctaagggcgtttacagtgcattgagttggcattcggcctcagcgtttcccaataaatatttcgtgttacgttcgcttctgtcgcacctacttgaagtccccgtatttaactttgatcactcgttcttcagcctaatcctgggtaagtaacgtggggagagagagagcatcatcctgtggaagtcataaccccgcttcctccactcctcaaccgcatggggatcagatgtattatgaatggcataagaaaacttaatgtacttttatcattttccatactcctttcgaaaga

SEQ ID NO: 56260 - DNA, 505 bp, Oryza sativa
aagcctaattgctctagatttgacaatgtagtgctacaataaacatttactaataatagattaattagccttaataaattcgtctcgtggtttactggcggattctgtaattactccctccatattatatgtatgacgccgttgactttttgacaaacgtttgatctttcgtcttattaaaaaaatttatgtaattataatttattttattgtgacttgatttatcattaaatgttctttaagcatgacataagtatttttatatttgcataaaaattatgaataagacgagtggtcaaatcttggttataaagtcaacggtgtcatacattaaaatacggagggagtagtttttttattagtgcccaaacatctcatgcgacatcctacataatacctgatgtgacaatgccaaaactttacacacccgtcccttcgtttgtacaaatggccagatcgacagtgggttataagagcagaaagcttcaagtttccgcactgatta

SEQ ID NO: 56261 - DNA, 1296 bp, Oryza sativa
taaatgacactttaaccccctcattcacatatataagagaaaaaaaatcgaatgcaatgaatttttttatagataatgcatcgtaatttatgtagaacgaaaataattatgtacttgcaagtgtatacgatagacattgcttaagtttgatgtgcacatgttaaaataatgggaagtatttctgcaatgttatttattcatcttggttttctcttttctagtgtatagttatatacaaattattggcaaaaaggatattttctaacagaaatattgactagaaatagccatatggcatattaagtgggcctaagaatgattttaagccaaaacaaatacttataggacctacgtggacaaaatgaaacctgaaggacctaattgaccttcggtgaaacttgagggattaaattagctattcacccatttaaatatatatggattaattgtttagaagaaaagactaagatgatgagactcaatgagagaaagagaaaaaggtatataaatcaattatccaaaaacaaaactaagttgatatgattttataagataaaaaaaggaaatgatataatttggacgatatatcaaacatccaagagttagaaataattgagatgatatggcttaatgagagaatagagaaataatattacctatacttaataagatgaattttatagatatataagaggcctgtgtgtctaattgtctatttcttccaatctgaaaataagttcaatataggctgtgtttacttcagcgcaaagtttgaattttagttaaaattaaaggtgacgtgactgaaaagttgcgtgtatatgatagattgatgtgatgaaaaagaactgaagtttggatgtaaactttgatctaaacacagccatattcacgagtaatatcaaagcgcatcaacgatcactttttacgagataaattacaacagctcgatgtgtggtgctctgctatgacatgacgttgacgtactcgttagcgctgtactccctttgtataaaaaaaacttaattcttaagtgtgtgtacaatgtttgaccgtctgttctatatgaaatttttttatgattagtatttttattattgttagatagtaaaatatgaataatactttatacataacttatctttttaaatttttttaaataagacggacggtcaaacaataaaaacagaaacccagaaattaagtgtttttgagacggagggagtagaggtgtaggttgtccgggcaacgcttgattggtgctcggcgatggcggctggctggattggttatgtc

SEQ ID NO: 56262 - DNA, 1501 bp, Oryza sativa
aattacaataacaataaaaaaatcgcaataatttggttacaggcatggcatgatgtaataattctcaagagggtattaattattggattttaggtgtatggaatttgtgaaatccaataaatggtttcactttacttgcagtaataccctctgaaatactccctccggcccaatttataatagcagaatgcttcaagtttccactgttactatgactggatcgtcggcgttagagaattcttctgcgagttcaaccgatgccgttccgaaaatgctgttcggcgatcgatcgccctagggatggggtagcgatcagattcgctccccacctccccctccctccctccacctgtttccttttttggcaccacattattttcatattttagtaaatttatgcacctaaagtttatacacctcaagtttacacatctatagtttagagaccaaaactttataagtcaaaagtttatatatccaattcaaatttgaatttgaattcaaatatttttttatatagtatttctatacatctaaagtttatagacctaaagtttatatacccgtttcaaatttgaatttgaattatatctgattcaaatttgaatttgaattcaaatattttctatatatagtatttctatatatctaaagtttatacacctaaagtttatagacctaaagtttataagtcaaaagtttacatacccgatttaaatttgaatttgaattcaaatattttctatatatagtatttctatacatctaaagtttatagacccaaagtttagaagtcaaaagtttacatacccgattcaaatttgaatttgaattcaaattttctatatatagtatttctatacataaatttttctaacttttgttttttttaaaaaaaattgtgtggtgtactgtagtagaaagacaagaaggggagggggaagggggaaaagagggaggagtataggggggagagggggcaaactaatcgctgaagggcccataccgtaccgttcactcatcagtcatcaagccctgtcaataggataagcgggcgaagtcacctctttgtccacaacctgctgacacagacgtgcgcaagccccgttctcgtgacagaacacatattatgtaaagcataaaaagactttcgatagaacagaataagaacatttcgactaggaaaaggcaattcatgtccctccttccaagtaattgtcttgtaccacaccagaaggtgatcatctttttcattcttctaatcttaaatacattcaagttggaccaaagaggatagcatagtgctcaaccgacaactcacatgtttctaccaggttatctttcgactttcgctcactggaggattgaagctaccacgccgaagacttgaccagtgaggtagtgaccacttttttgtcgttctctccgccaaccttatttaagtggacgccatgtaacatccaagaacacaccacactcgcaaaaatggttgtctacagca

SEQ ID NO: 56263 - DNA, 1501 bp, Oryza sativa
ccacatgtcagcagaggttgagtggtggtaaagcattggtgcgacaaccatggacttgcaggtgatgagcggcgggtgaaaacccagcccggcctttgccggaccgacaacaatggttcattccccctcctaagggcgttgtcgtgccgtctcatcccttaagggtgtttgccgggcgaaagcccagtcttgactcttttgagtccttgacggacggcggcagtggttttccatcgcttctctccttggagacatcgtttaggcatctccttgtcgaaaccactcgaacgattggtgcaagcacactctagatagagttaggctttgtgttggttgtaagggcgtttttgggcattttcgtctgtgttcctttgttggcctagcggcggtcggtcacgcttagcggcaaccggttcggtgctagtcttctctcggacctgtgtgttggtggtggtatattttttctctttttcctggttacgaccttctaggaatgtaatcttgtaatttttttttctgctttatcaatagaacttcgcatcgtctcgtgcgagtcgctcaaaaaaatatctactttagagaatcaggttcttaggccctgtttagtttgcgagacgaaaagttttggtgtgtcacatcggatatacgggaacacatttgaagtaataaacgtagactaattacaaaacatattacagattccgcttgtaaactgcatgacgaaattattaagcctaattaattcaccattagcaaatgtttattgtagcatcacattgtcaaatcatggagcaatgaggcttaaaagattcgtctcgcaatttatacgcaatctatgtaattagttttttatctatatttaataatccatgtatgcgtccaaacattcaatgtgatagagtgaaaagtttttgtttgggaactaaacagggccttattcatctgaaagcctgaaacttatgtcattatcagattgcaaatcataaaatggtactcacaccgtcccaaaatataagcatttttgaccttaaaacaatctttgagacgctactctgaccaataatatctataaaattaagtcgttttaaataaaaagatatatatattatgatattttgtttaatgataaatctagtagcatcaatttaaaatgatcttttttatttttttcactattaatggtcaaaattaaaattgtttgacttagcattattttaaaaatgcttatattttaggatgaagggagtagtattcttgaataccattatcaaatatcaattatttatgtggaaaaatatgtcgagctcaaactgtccttttgcattatcgatgaccttgaccaacatagccccagcacacacggtaaagactagagacggccagctgcaagtctgcactagcgtactgcatacgtactgaaattggtagcttctcactctccaagtcagtctcacaagtccacattaaacaagcatcaccactcgtaactagtaacaaaaaa

SEQ ID NO: 56264 - DNA, 1501 bp, Oryza sativa
accaacagaatttggagtgttgaaagcctgggtgggtatatcccttttcaacttacacgacatgggtgagtggtggtggcggtgcttttcggatgaactacaggaaatccttcaacacgttcttcatgttggtctgctggtcgatttagaaaggagagaaatgccagcgtgtttgaggggtaccgtcttgcacgcttgggcagtcatttggtgaaacggttttgctatgtccctttgtgttagatttttgggctcctgtcttagatgaaaaaaaaaatccttagcagttacacttatacacttagttatagcgcacttacactctgttacaatgtacttacattttttagctacagtgcatctaaattagattttttttttcaacagtgttttttctctaaatttatgattttttggcatatttgtcttttttgttattttatttaaaatgggttgtatagattggttgaaatttctgtaagatttgaagctccaaatctatcaaaaaatcaataggttttcaaatccttggtgaaatcaaagatgaagtattactttcaaagagagcaagagttttcaaatccttttctaagtagctccggtaatgtaagtgttaagtttctctagtgattcatcactagcctcaacagtgttatgtcgatgtcaagtacttcgtcgtaagaaaacccttcctaaccttaatcaaaatggttgcccttcttcagccaacccatctaaaaacatatgactagggctgctgctctttccaattcattttttatgttttggacaacgacacgtcctccaaaacacatctttaattatattttttattgtgataagaaatttgccacagaaattatatagggataaacaaactaaaaaaatgtgtctttacaaacacttttctttgttaaattttctataggagattgggaaaatcctcaagtactccatccgtatgagcttttggaaattcaataggcccaacctctcgagctactctatttatcctccaccttatctcttggcgctaataggtgtttagtagcctctctagtcatattcaaaccaagcctctctagtcatattcaaaccacctgtcgtcgatttgatagtgcattggatttactactagttgattattaagggtggacttctttttctcacaagtataaaattaagtttaaggcgatttcaatttcgaattatcatagtcgtttcataactggttaggaaggatatgacacaaaatagttatactttaataacgtaatatttaactgaaacaaataaattcacaaggtaaatatagcataaatataggcacatataagattatatattctatcctctcctgtcattaatatgcgttatttttaataataacgtcatatgttaaaagaccggagagagtatatatatacaaagttcaagtattgctagaacctgttttatctaccttatccccagtaccccactcctcccctctctctctata

SEQ ID NO: 56265 - DNA, 234 bp, Oryza sativa
tccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccact

SEQ ID NO: 56266 - DNA, 449 bp, Oryza sativa
tgtgtgtttcttttgggacgcaaagctctcgctcgcggggagcttactgtgtaagcaacatgccgcgttgattgcgccttcttttcccttgggaaaaagaggccgaatcgtcgtcttctttcgcttgctttttggcaaggatgctggattgctggccacctcacttcgaaataataaaaacaaagtaggagtagtaaggtagacggtaaaaaaaaaaaaagaaaagaaacttcgacgcacatctggccatgtgaaacaaagaagaaataaaagcaaaaaattccgttgccgggactcgaacccgggtctctcgggtgagagccgagtatcctaaccagctagactacaacggatgctggtatctattcctgcattatacaaattaaccatggcctgatctgatccaaaccataaacacgggtcgggccgtacatccagctgatgcatta

SEQ ID NO: 56267 - DNA, 714 bp, Oryza sativa
ggatccaattgtttatgtttagattttatcagttgtcattgttgataacgatacaatgctactgctttgccgggaaaaaatagctgaagattgtcgaacacaaatacacaattattcccctacatacaagataaggagcacaaatacacgatattttagctaagaatttgtgccaggaatttagtggcaatagcccatcaattataagccactctctgatattctctctttatgctagcttttggttctttcgatcttctagtggtaagccccacacccatctagcaggtactatttcctggaaatccaatgcaaagaaaagcatatattctcactgtgatattgtgagcagcctaagtgacaaccaaaaggagctttttggttggcatattttatttccagggtactagctagtacactattttcatctgcactctcattgcttgcagggaccaagtagttggacaaacaatttattttctcattacaccaacattgcaaaaaatatcgttattgtataatatttcacaggtttattcattcacattcatggtgtttttgtgcccaattcagaattctcatttctcaatccaaattcaagcctacaaactaatcattaatcataattttcctgaatcagttagcatgtgtagatgattacatcatacttgaaaaattacacctacttttactaccacctatctcccaattagc

SEQ ID NO: 56268 - DNA, 1234 bp, Oryza sativa
catcatcttttttcccccaaaaccttgataaaacctggagcggcctccaatccttcacaaaccaaacaaattgaagcattggagcccgatccggattggaggtggccgcggccatgttacggaccaccggagcggctgccggaatggcggattaccagtggccggccggtgtcggtgaagcggcggcggccggtgcatgattgcacatgcacgcacgcacacaccgatctggcaacgaacaagctaagcactcgccgagtcgccggcacgagcggatgggagtaatgcgataccacatcaccatttactcctattgccctattggcatcacatccataggttcaggcccctttgattcaaaagaaattcatatgaggctgtgtttagatccaaagtttggatccaaactttagtccttttccatcacatcaatctgtcatacacaacttttcagtcacatcatctccaatttcaaccaaaatccaaactttacgctgaactaaacacagcctgaatttcagagaattttattcctataggattttttcctatatagccctttgaatcaaaggaatggatcctatggaatcctatgaaattcctatggattgtcttttcctatgcaagttttgcaggaaatttaacatgaggtagaacctcatggaaagaatactttgagtctttatctctccttaaattcctgtgtttttcctgcggcccaatcaaacaatcattcatatgtttttcctgtgttttgatttcctctgttttacacttgcattcctgtcagaatcctatgtttttcctatttctccgttttttcattcctgtaattcaatggggcccttatccttttctatttgcttcggttgcacattttttttaattacacattaaagcgcacacatactcattcttatgaacatgcgtacataaaaccctatcgtgtctgatcacaattttgagttttccattgcgaattgtatgagttcccttcgtagtttaaaatcggtgtgtaaatgactaaatgcacaccaaatccagtcgacacacccaaaacttggcaatatgaaaatcaccgaaattacaaaaaaaaaaggtgaattccgaagcaaagagtggccagtgtgaaactaactcagcgaacactctcctcacagctataaattctatgcttcacttgtctcgcttttgctccacttacaccaacagagatttgcgagtagattttgca

SEQ ID NO: 56269 - DNA, 1501 bp, Oryza sativa
tacttgaactctcttttaatttttctaattttagatattattttattttttattctaaattttaattaatctcgtattgggtttttatatggatttttctttcactattgcttatttttaattccgaatttcagctaattttaaattgaattcctacttgaactcttcttttattttcttttgctaatttcggatttatttatttttatttcgaattttaattaatctcgtattgggttattatatggactcttcttttaatattctttatttttaattccgaatttcagctattttaaattgtatttctacttggactcccatttccttttctaattttggattttattttattttttgaattttgattaatctcgtattaggttcttatatggaaacttctttcaatattgcttatttttaatttcgaatttcagctatttttaaattgtatttctacttggactcttctttccttttataattttggattttattttagttttatttcgaattttgattgatctcgtattgggttcttatatagaaacttctttcaatattgcttagttttaattccgaatttgaactatttttaaattgtacttctacttggactcttcttttctttttttttctttttatcctattaatgtgggaatttctagctctcacaacgaacgtggtgcctcctttcaaagctgttttaataatataatagattaaatcttagcaacaagatctcatatggttatattttgataaaaaatcgagcgttgtttcaccccttatagaaaaattgtttcatcatgtaattaaatgtgtttcaaagagatgcaacatttcgataatactgactgcaacatcgacaattactgcatgaaacatttagtcctaactaatgaaacattaaaaaagtcatgtgaaacataatatattcacaagaataattaatttgctaaaacattttttagactgtgggaaaaatatgtgtaacatttataaatggaatagtgaaacactaagaaatacttattgaaacaactgagtaaaactatgcgcaacattaaaaaataagttttaaaaaataatcagaatataatcgagtgaggtcttgttgtaaagatttaattgtaacgaatcaaatagtacgatcaaattattgaccagataagtaaaacagaaaaaaaaagttgtttaaagttttaaaataaagttgttataagcgtatacatcacccgtaggtgcacctgagcacaagaaaaaaaaatcacagtataacacatgtactactaacattgagtggaggcgttcgatatttgtgattgtatcggacgtcagacagtaattagttttcccgcggggcatgcggtgcgcccccgcgcccgctgcgaactcgggccggaagaacctatctactcctgtgtggatccacccaaaacacaagctcgtagagactgagacccggcctttctcgcctcgcggggccaccgccaccagg

SEQ ID NO: 56270 - DNA, 1035 bp, Oryza sativa
gtcatgttgatgtgtcttttcctccatttgcaggcatttttgtactccttgaagtatagtatacctcttgttgcataccatgaggaacaatgtttgaccctctttgaacatcctttggttgatttgttgcacacaatccactatgagaccaaggtctgatctaaagatatttgctacgcaaacttatcttttcttcctttttaacaatggtcggcagctgagtaaatgttaaattctcttcataggtaaaagtggtgccttcagttgaggacctcttggggtattcatcttttcaggtttgtctatccgtaactttggcatgcaaaagtttacatatcatatctgttaaggatagtatgcctttctaccttactgtgaaatgcattagtatatattagttgaacaatttttgaagtaacactgcgatgtggtaaaagagcagctgttgctgggaacttgtgatatagcatgaggacccttccaaaatagacagaattgtagttgaattatccacattatcgtcacgactcgagtccatgactggataaccactgccggaactagcaatagcggtagagctgctattttctgaaagcctttctctattagcattctggaatacagacaaaaatcttccattctaatcactgcagccactcaaccagtagtgttaaatgtagtaattcctgatgtatgctcccttcttggctgtccaacataaaaataaatccataaaaagttaagctaacccataggagggcttacacaaatctcttgaagatggggtttctagaatatggctagaaaactactccctccgtttcacaatataagtcattctagtattttccacattcatattgatgctaatgaatttagataaatatatgtctagattcattaacatcaatattaatgtgggaaatactagaatgacttacattgtgaaacggaggaagtactatttaacaatcctcggtgaatcttcagtaagtcaaccagatagatatttagaccagttttatttggattgga

SEQ ID NO: 56271 - DNA, 1501 bp, Oryza sativa
tttacattggattgtgtgagaaccatttgtccttttgtttaaatttaaatagcatgaaactcatccttttgttgttcacacttcacagatctcatttatggaggtgtgttggaaataaaatcagaccagcccatctgtgatgtcaagaaaacaaacatcaagaaagtgcaatttgcaactagtgaaaattttatgtgagactattagtgttcctttgctctgagcaaacgtgtcaaattcatgccaattttgtttttctgtagaatacctgtatagctgcgctgcacaaagcattgctagttgttgctcgatcatgtaatgcaagagtactctagttcccagctgataggattttgcttattagctagctgtatttcattccacccgtttttagtagttgaatttcaaatggatggacttaaggaaatgtaagaagccaggttgatcccagaagaaaaaaaatagttgagtttccttgtgaaaaggagcagtacaagcgcagcacaacatgttagctgaaactggatacctgaaaccctagtacttgtttgtttccactttccagggtcatattttttgttacgagttaatatgcatttgtacatctttcttgctctggtgtgtaggtggtttagcactgctgcacaggaggctggtgctgcttggtcttgacagcagacaggtaaatgatcctttcgagggcctcttcgctatcatcttgttgcatggctttggcaagtgatttgatcgttgattcatgtctagtcctgctgcatagcttttgcacgccttcatcctcttattgtaggtaattttctttgcaaggtcctgaacacatgtagcatcagatatcgatgtgaatgattgggattttccttggtaatagttggacagccctctcctgcagaaaacaaatttacttgttagaaaacatatgatttagtgtcaattttgcaattgaagtagattttatggaagtggtctggaacgtttgatcttttaatatcgacattattttctccagtcatttcgtcttttgaacaaaatgttcaaataagacctgatgctgcatacatacatagatcaagcccaatttgaacattttgcttgtcataaatgttatgcaaaatagaatctctacaatttagcaggtaggcaatatcattaaaattcaaccaacaaatctgaaaagctgttcggagaaaatcattgtctagttgaaaaaatgaactagctagtagctactatatcatttgcaaatgtgttcattcaactaatatagtttacagtagtcaggtgataaatccttgtttgctggcacaaattgggaacacaagcaacaaatttcacaccgttaaagcatctaccgaaacttgaaattcatataagcatggtgcaattttctctaactacgagtacttctgcaggggaggagcaaagcacctgataggaagctgggctatcagtgaggacaagtcacagagcggcccttcagaatcca

SEQ ID NO: 56272 - DNA, 747 bp, Oryza sativa
gattccggcggacagagagagcggcgagtggcgggaacggtggagggaggcacggggagcgtttatatagtgttgggagtgagagagggcggccgggggagaaggaaaccggcgcggcgctctcgggctccatcaatggcgccggcgagatttgcgggggcaaatccgcccgtttgaacgcgagagagagagggaaaaatggggggaaagggagagggaatcacggggaatgattcccctcactttattgcacgcgggggcggcgggatgcggcggaatccgcggcggcggcggcgctagggcacgggcgaggcggcgggagcggcgggaggtaggggatgacgggtgggccccacccgtcagcgagggtggcgggcgggcccgcccgtcagcggcacgcgcgcggggaggaggccgattgggccgcggggggaagaggagagagagggagggaggtgggccgagccggcccaagaggggaaggggggaaaaaggactttttagggtttttctttttataaaacctttttaactttgtttatttcttaataattattatttgtgctctgaaaattccactaaaatttatttacgcattttaggcttttaggaaatatacaaaaatcctccaaaccttatttgacttttaactttgcacattttaattgttggaggctttcacatggattttacttattctatgcataattttgaggatgtattttagagtcgttttgggacgcgaca

SEQ ID NO: 56273 - DNA, 1501 bp, Oryza sativa
ctttaagtcttcgtcgccaccgtcaggcctgctcgcgccatgccgtgccagatccaccgacgcttgctccaccaccgaagctgtcgaagctcgcggcggccatggatggatggacgaccgccggtggcatcgccgctaccgctcccgcgcgagatctcgcgtgcttgggtctcgctgctgactactctgagcttgccagcttggctctcggaagaaatgcgagaaagaaggagccgccactgccgtgacgcggttctatttttgtaaaattccagtggcacagttacgaatagacgaattgtaatgatatttttctgaatagccaaatttgcaatggcatggatcaaagtaaccctaaattgaaagccatccagattttgcattttgctgcgtttaccagctgaacatgatagcaccatatatttaggggatgataatctagctacacggttacaccctagctaggtaggtaaaattcaactaacatgtccgatatatgaaagctaaattggctatgcacatgagcacatccactctgtggatgtagaggatgggctattatagtttcatgaatagtgatgctattgtcatttgaagatcagtaatgctattgtcgtagggatgagcatccgtaattagtgccctaaagatataggctaactctcttataaaatattatgccttaatatcgtatcaagtttggatattctatggcattctttcgtgtttagctaccactatattgattttgtaacccgttttatttttttagataatggattaaataaaacctggcctctatatcctgaaggatgtacacaaccatagtattacatcatcaagcacttaggcttacaaacaggttcaaaagcaaacgatgccgtaggaggcgaatggacgacaaagacatccagaacaagtctcacaacaaaagattttatctaacacaattcaatcttcctcttcaattccacctagattttgagtagaattccataatgataactttcaattttaggcacccaatctttaaagctttctcatcaccttctttaagaagcaaagaccactggcgagcccgatgcgttaccctgaaaataacctgcaagagagagttaatacttgagccatttaagactacatcattactagcaagccaaagtgaccaatagatattgaatatcggtttaccgccctattgtttttttatactttctgtgcgccaggaccacacaaaaagatagtaatactcacagcatctatactacgttctttatatatgcagcacaccttgaaccacttaattcctactccggtatatacggagtacatataaataattggtgtcaatgtgtcatgcaccagcgcctgaaatcacggagaatagacatcgatgcttcctgacaaaacttcactccatttgttcactgaaccatacacatatagacacctagttgtataaaaatatatctcacgcgttactaatttatgtgtataaata

SEQ ID NO: 56274 - DNA, 1501 bp, Oryza sativa
atcatcatatcgatgaattttctgccaattgatcaaagcggagccgataatcaggggcggaaatggcacccccttattgccgtcgtcctcgtcgtcttggcctccgcggccgcttcactacctctgtaagcacctctgagacacttggcagatatatcttgagattgtcaaagtcgtcagggacgtcttgttgtcacccgtatatactgtctataaccgaaagaataattagccatgagaaaaattaaaatccaatcccatcatactaggaattaatagcatatgcacgcgaggatgagagcaagtataatagtgatctataagcttactataagcttatgtggaggaaagagataaacaaaagagaatggtgttggctctcatgcaagagctaacttaacacaagctccaagacaaatagattaaatgtatgagtgagagatagagatagaagaagaaaattataggtaaccttatagctaatctattatatgtgttgactttagtataggttaggggcgcgggcgccgcctcccgccggctgcgccggcttggctgccctcgggcgtgccgagtggctgctgcgtggggcccggccgtcagccgcccacgcccttaggtgcggctgacgcgtgggacccacggcgctggccggtgcgagcccgggtgcgcccggtccaccgtggaccgtgaggctgccgcgtgggccccactcccgtggacccggtccgcgcgccccctcccctcggctcacgcaataaaccctttttaaattaaaatttaaatgaagaaattcgcaaatattcatttaaagagcatataaacttcaaatagccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattaccgctttgtttaaattcccgcgttatcactgttttatttagccatgcctatttacctttgttatgaccttattattattgttattgttattattaccttgttcaccctagaataaacaaaacaccaactagtggacactctactcatggtaccactagtatgattttaggtagatgcttcgctggttaattatgcaacattaggtggttttacaactctagactttgggaatattcatatcacctggacactatggaatggttggattattgtggaattggattcacacctccccctctattcaaaaccctcaaaatggttttaggctgggctcggggtgcatggttttgacagtagcacctcggccatataaggaccggt

SEQ ID NO: 56275 - DNA, 1501 bp, Oryza sativa
aaaactaagttgatatgattttataagataaaaaaaggaaatgatataatttggacgatatatcaaacatccaagagttagaaataattgagatgatatggcttaatgagagaatagagaaataatattacctatacttaataagatgaattttatagatatataagaggcctgtgtgtctaattgtctatttcttccaatctgaaaataagttcaatataggctgtgtttacttcagcgcaaagtttgaattttagttaaaattaaaggtgacgtgactgaaaagttgcgtgtatatgatagattgatgtgatgaaaaagaactgaagtttggatgtaaactttgatctaaacacagccatattcacgagtaatatcaaagcgcatcaacgatcactttttacgagataaattacaacagctcgatgtgtggtgctctgctatgacatgacgttgacgtactcgttagcgctgtactccctttgtataaaaaaaacttaattcttaagtgtgtgtacaatgtttgaccgtctgttctatatgaaatttttttatgattagtatttttattattgttagatagtaaaatatgaataatactttatacataacttatctttttaaatttttttaaataagacggacggtcaaacaataaaaacagaaacccagaaattaagtgtttttgagacggagggagtagaggtgtaggttgtccgggcaacgcttgattggtgctcggcgatggcggctggctggattggttatgtcccttccttccccttctagcagaacagaggagcttatgtggtggctgcaaggagtgagaaggcgtggcactgtggcagtggttaggagcgcttagctccgttttatcttaagttttgaagcaagcaagaaaagctttaatcccagccttttaagtatttccttttcgcttgtttgttatttatgtcagttatgagattaggaaagtatgtactcgtgtaatctttggttatgtatatccacttgtgaatgttgtatatgctaaattcctatctattatttaaaaatacagtaatatcagagcattttccacataaaaacagtccagccgttgtactctttggaactgaggatccaccggaaaaaagattccatttgatttcttaagaaccaaaagacatgtggccctagtctcaattaaagattagctttcgttgtcgaagaccttgaccacttactttgcagtctcgagtgtttggctctttcctacaaagatgtgcacatgttaagaccattagcccaagtcttcggtcatctatgagctctgagggcatatccaatctcttctttctataaagctaatacctattaaacacataaaacttaacatacaagtataatatttattagcactcctaaaacttacatgcaagcatgtcacatcaacccattaattaatcacacaaaacccaatatgtaagtatatattagttatatttacattttagtctgc

SEQ ID NO: 56276 - DNA, 1501 bp, Oryza sativa
tccttgttcaaaaaatgtttcaagaaaaaccatggaggtgttagcatgctgggggcaagaataacctagtgttaacctttatatcttatgtcccatattctaatcttgtacggagtactaatggacttcaatttaggtggtgggcattttattttgccaatgttcggtgagtgatgccgagatgcatattgaattgtgcgtgatatgtcatatgtgttctaaattattgccttttatgaataatattgcatatcgtgtgtatctcaatgtgaagttatcaaatttataggaaaagggattatccaatttttttagcattttttgactactttctacatttttaggaaacaaaaataaattggaaatttctcatcggtttctcgacataatcgattggttttcgatacgaaccaattgatattttcactttgcttgcactttcaattgccgatcggaattttaatgtttatgtttgacatttggatagagtcgataggatttcgacacatgaccgatccactttgcttgcactttcaattgctgatccgaattttaatgtttatgttcgatatctcggtagagtcgacaggatttcgacacatgaccgaacaaaaccgataatttgaatttaaatttttggctacaaaatttgttcggaatctgtctcgatcggatctggcagcatactgccagcgtccggcatggaaggtgtttctgaattgtgaaccctggtggcggtggccccgcgaggcgagaaaggccgggtctcagtctctacgagcttgtgttttgggtggatccacacaggagtagataggttcttccggcccgagttcgcagcgggcgcgggggcgcaccgcatgccccgcgggaaaactaattactgtctgacgtccgatacaatcacaaatatcgaacgcctccactcaatgttagtagtacatgtgttatactgtgatttttttttcttgtgctcaggtgcacctacgggtgatgtatacgcttataacaactttattttaaaactttaaacaactttttttttctgttttacttatctggtcaataatttgatcgtactatttgattcgttacaattaaatctttacaacaagacctcactcgattatattctgattattttttaaaacttattttttaatgttgcgcatagttttactcagttgtttcaataagtatttcttagtgtttcactattccatttataaatgttacacatatttttcccacagtctaaaaaatgttttagcaaattaattattcttgtgaatatattatgtttcacatgacttttttaatgtttcattagttaggactaaatgtttcatgcagtaattgtcgatgttgcagtcagtattatcgaaatgttgcatctctttgaaacacatttaattacatgatgaaacaatttttctataaggggtgaaacaacgctcgattttttatcaaaatataaccatatgagatcttgttgctaaga

SEQ ID NO: 56277 - DNA, 1501 bp, Oryza sativa
cgcacacgctagcacgaactcggtcagcttagcttaagtaccaaacgctcgcagagaatcactgtaattacatttcttgaaatgcgtagaggtggacataaatgtaataatacccgcggtttgactttgaagtaagtatactccctcctgttatataccccctccgttttttaatagatgacgccgttgattttttctcacatgtttgaccattcgccttattcaaaaaatttatgtaattataatttattttgttatgagttgttttatcactcataatattttaagtgtgatttatatcttatacatttgcataaaatttttgaataagacgaatggtcaaacatgcgagaaaaagtcaacggcgtcatctattaaaaaacggaggtagtaataattgacgttttggataaggttgaagtcaaactttataactttgaccatcaataacttttaaaatatttagtttaaagatactagaacaacatatatagatttatcattcaaatcactataataaaagtgagcatgtatttatttattgtatatcttataatagaaaaataaagtcaaagatatattttgtataccatgtcattgtccaaaacgtcaattaaaatgaaactggagtggagggagtactacagagagtgattaggcccagcgagaataataagaaaatgtagctgctcgttacgttcattaattaattaattaattattaatcggatggattgggacgatagccgtggtgctaattaagtttgcacggctgtctggttgcatgatgtctgaacttaattaatcagaaacctcatataggaaattaggagcgtcaatttcaattccatttccatcatgagccgaacaagcgagggcttaagggagacacaataatggtgcctaaaccttagaaggcaagagatgactatatacttaaattgacgttcggttagtctaactaaaaggtgggttctcaagcatgtcgccaggctggcaactgggcacacataaacattttgtaacagtcgtgcattagccatttagcctttgcacaattgtgcttagaatctagtactagtacttcattccattcagaaggttctacgtagttcctatatacttgatcatactaccattttccctagccttttttccggggacgcctacgcatcggacgtccgatagatgcactaaaatcggacgtctctctaacagctctctctcactacctcttgcatgcatgtatacatacttatttacccagtataaatagttttatctaataatttatcaatccaatctacggtataattatatcattgtaatcattataacaagatatgtccacatcggacacgactcttatctctaacaaactctaagataccataagtctttgcggcagacttttgcccaaacatatctctaaggaaattacataaaatatcctaattaatagatacaattgccttctgaggactctatccatgcgtggcaa

SEQ ID NO: 56278 - DNA, 1070 bp, Oryza sativa
caaaattagaaaaggaaatgggagtccaagtagaaatacaatttaaaatagctgaaattcggaattaaaaataaagaatattaaaagaagagtccatataataacccaatacgagattaattaaaattcgaaataaaaataaataaatccgaaattagcaaaagaaaataaaagaagagttcaagtaggaattcaatttaaaattagctgaaattcggaattaaaaataagcaatagtgaaagaaaaatccatataaaaacccaatacgagattaattaaaatttagaataaaaaataaaataatatctaaaattagaaaaattaaaagagagttcaagtaggaatacaattttgaaacaactaaaattgaaaataaaaaataaaaacattaaaagaacacaatacaatattaactaattttttttaaaaaaaatctgagattagaaaaagaaaaataagatttcaattaggaatacaatttattaataactaaaatttttgataaaaataaagattattgaaagaaaaaaccatctaaagcacatgacgagataaattaagtaacaggcctataaaaagtagagtggtgcaggcggttgatacaatatataaaaattattaataaaacaccaaataaaatcctaatgacgattaaaaggagggacattagacaggccgtgaagcaaacgagtaaggcagttgccgggacttctaaaaagtaaaaaaaacaaaccccattgataatcatatttgatttttaaaatcctaatgacaataaaaaggataagcagcggacggggtgtataagggtatagttgcggagccgccgacggttgaggggacttctagaaaataaaaaatgaattccaacgatagttatgttcgatttttagaatcacaatgataataaagagtaggcggcggacggactatacaggggtatagtggcatcatttgatggggcttttaaaaattataaaaaatgaaagtacaagtccaattttaaaggttcagaacttctaaaaagtaaaaaaaacaatgataatcatgttcaattgtaaaatctcaa

SEQ ID NO: 56279 - DNA, 391 bp, Oryza sativa
gggggtaatagcgaggaggaagaggaggagaggacggaggagacgacaaaaccgggcggctgaaaaagtaaaacttgtggaggtgggcccccacccctccctcctcccccacttcccctctccaatatttttctccctctctctctctcccctctactactactactcctttctctctctctccaagcttctttctctctctctctctctctctctctcctgtgtttttttgtttgtttttatacgtactctcgcttggatggatctgcaccgcgcgccccctgccccatttgtgagagttcctttctctcttttcctcgccttttcttttgttttcttctcgcgagtcctttcttctcctcctccttctcctcctcctactcttattagg

SEQ ID NO: 56280 - DNA, 1501 bp, Oryza sativa
taagtattaaatgtagacaaaaaaatcaattgaacagtttaactgtaaattacgagacgaatcgtttgagcctaattacgccataatttaataatgtgatgttacaataaacatttgctaatgataaattaattaaacttaataaattcatctcgcagtttacaggcggaatctgtaatttattttattattagtctatatttattacttgtattcgtatatttaaaaaaagtttggcacacgaacagcctcacaagcgaaacagccaccacgcatgccagccggtgacagtgaatcagtgatgcacatgccctcaggaagattgctgctgaatgcaccatggttctgacataaagagagatgttctctctttttcggggctgcttagggcctcgtttagtcccaacttttttttttaaacttttcaacttttctattatattaaaattttactacgcacaaacttccaacttctccgtcacattgttctaattcaatcaaacttttaattttggcgtaaactaaggccctgtttagttcacaccaaacttcccccaactctcaatttttcatcacatcacatcacatccaaaacttttctacacacataaactctcaactttccccaaacttttctccaatttcaggaactaaacacagcctaaacacaccttagatcccatcccaaaaattttcaccccatcgcatcgaacgttttttaccctgtcacattgaatgtttgaatacctgcatgaagtattaaatactacctccgtcccatattatttgctgctttgagtttttgtttgtagtgtttgatcattcgtcttattcaaaaaaattttggaattattatttattttgtttgtgacttgttttattatcaaaagtactttaagtttgacttattatttttgtacttgcactaatttttcaaataaaatgaatggtcaaatgttgtaagaaaaaagtcaaagcaacaagtaatatgggatagaggtagtataggctaaaaaataattaattgcacagattgcgactaatttgcgagacgaatcttttaagcctaattgctctagatttgacaatgtagtgctacaataaacatttactaataatagattaattagccttaataaattcgtctcgtggtttactggcggattctgtaattactccctccatattatatgtatgacgccgttgactttttgacaaacgtttgatctttcgtcttattaaaaaaatttatgtaattataatttattttattgtgacttgatttatcattaaatgttctttaagcatgacataagtatttttatatttgcataaaaattatgaataagacgagtggtcaaatcttggttataaagtcaacggtgtcatacattaaaatacggagggagtagtttttttattagtgcccaaacatctcatgcgacatcctacataatacctgatgtgacaatgccaaaactttacacacccgtcccttcgt

SEQ ID NO: 56281 - DNA, 1501 bp, Oryza sativa
cttgcttggccactgtaaccttttcagtgctctgctgcctctgcctctgcctggcctgcagtttctctgcactgcatatttgcatttgcatttgcatttgcccctgaatcctgatgaccctgacgacacacggatagacagacagggcaaccacaacagcaatgtgctcgcggcccaacgcaggcaggcacagaggccatgagagagagtagaaaggaatactagccgaataggaatagtagagtactacaggtctacagcagcggccaaaagagcaggatcctgcaaatcttctccgctgcacgcctaattatccccatcaccatctcattctcacccacctatggccttgtcgcttgctgttctgcctccataatcatcatcatcttcttgctaatactactctattactagctgatgagcttgttaatggcactttaattagtctaaagcaaaaccaccacattattagagcaagtttaatagtataacccactacttagtctaattcatctatagccgatctaatagtcaattcatacaatagttgcttactatactattaatatatggtcccacctatcatacatatattgtgtcttggagtccgtgctgcagctggctacagatctgtagcccactgcttttctttctcatttttatctcattaaaatatatttatagctagcttatgctattttaactgctccatctgccaccttttgagtgagaggaatatagagaaagagagagagagagaatgcagtaggcagcagaagcaaacacgaatctctctctatcagggcatgataggaggagtagcaggataggatgtcatgggcggcatctcagctcagctcaggctcagctagacgctactcgcatcggagcatcacattgccgtgtgccgttgctcgcattgcagctgcagctactactaccattcccacaccttttctagctctctgttccacacctctccctcttgcattgcagccaagacagcaaccagcagcagcagcagctcagctagctagtttctgctttcttgatttgttcttggatttgggcgagctgtacatctagagagcgggtgatgggggaggcgtcggagagcatgaagaagatcagcagaggccgtctcggcggaagctggatgggggagccaagcgatcaccatcgccatggcgatgaacaggaggaggaggagaagacgctggagctcagccttgggctccccggaggaggatggcgagcggcgtgcagggacaaggggacgacgacgaagcactccattgcagcagctgctgctgctgatgatgatgatggtgacaagagctccatgctctccctgggctactccacactcgtctcccactcgcaaggtacagataaaagaaaaagttcacaactctgtaactgatctcgtgttcttgcgatgtcagttgcatgttactgtaatagacatctagttatacgtgtgtttttgttagtgttttgg

SEQ ID NO: 56282 - DNA, 344 bp, Oryza sativa
cgcttggatagttctttagaaaatcatgagctacaattaggagtccaactttcatcttaagttagcatgcgagttttttaaagagatttcttatacgactctttttatttccaaaagcaaacggacttaaaatccgacttacatacggatatgtgtttccaaaagcgaacaaactgacagactcaaatacggatggtgtaccaagagaccaataaaaacatcttcagtttttataatagtagagattattagtccacccatctagtcaatttctaattatataggcctataccgttgtataatatggacatattacaggttattaggaaaactagagttagaaa

SEQ ID NO: 56283 - DNA, 1501 bp, Oryza sativa
aagaatgtaccgatgcagaggaaatgcaatcctcttgcattttgttgctgaccactttgaaacatagagtttaattctttattgtcttgcaggatgcttccagtgataggcatagaggaatgagaatggacatcgacgacatgtcttatgaggtatatctattattcagttctaagagagctggtactaaagtccatatttattcatgtaaacattttagccccaagaaccttttgtttggaatttattcctttccgtttgtttgatgttggttgtgtggcattctaggaattgcttgctctaggggaaacaattggtaccgtgagcactggccttccagaggatgaactgtcaaattgtctgaagagaatccactatgtgccctcagcttcaacaagtcatgaagatggtgatatcaaatgcataatatgccaggtatgttcatttactagcattgcatcattagaatgatctatagtttgatgatatgtgagttgctctggttatttatgatatccttaattccttactgtcaacacttcttccaagacatgcagcaaaagaaaaggaataatgagttttatatccttactgtcgatgctaaatatattttaacatacaaaccattataagtcaatcagatgatataatactactatatagtaaactagtctaaaatatcatgaaaatttgggccaagaacatttctgttatttaatttcgagatgaatgactaatatactgtactgaaaaatatgatgtaccaatcaatcaaacataaattcaggcactggatttgctgaagaaacttcttagtacttgaaaagataatctggtgatgacatgtggacatgttccttctcctgcttatcttttcaggaggaatatttacctgccgaggaggtggccgagatggcgtgcaagcattactatcatcttgcttgcatccaacaatggcttcggcaaaagaattggtgccccatctgcaaatccgtcggttctgctacgaaacattagtgtacttgagagaattgaacaagatgcagattcattttgtttacatagattttcattatattctttgtttagattcaacttgttgctcaaatgtccagaactgttcttgctctcactccacacaatgcagcgtgggcaaagaaaagtagcaggaaataaatcaaggtagaaaaattttttgttattgaacagacaacccattctatacagcaatttgaagtccacattattcgttattgatatggcgatctctattgagtcagagttcaaattcaagtgtatgtacgcatcccttgcttctcaatcctcaaataccagtaaaattaatatacaatctctgaaaagaaaaatacaacaatgttgtgataagcagccaccatctaacaaaattttaagtctagaacagatgtgcatggggaaaaaactaagggaaaagttcattttacacccttgaactcttatgcttctctaaaatacacccccg

SEQ ID NO: 56284 - DNA, 1501 bp, Oryza sativa
acaatattttaaagctctctatcttgagtcacacattacatttttccttttccaaaacaaattaaatttatgacctaaactaaatcctaaaatccttgttgcatgtgtgtgtgcaccagaccaaactcttgcaaccataccatgcttgtgcctatctaccaatagtctaacattatatcatcacaaaagatggatgatagagaacgttagcaacatcgtttgtcgtaaaggagccactagcatctcatatgtttttttaactaaggagatttactaatcagtagtgaaccaatggagttggtagcacgaaataaggtagaggagcgatcgagatagtttgccgaaagaataagcaaagagaaacatggtaacatttgtaagttggaatagacttgtaacagaggtggttaggacaggatgggaagaaacgtggcgagtaagaaagaaaggttctaaatttgagtttattgagcctataaaaagtcataatttattttgagtgatccccacaactagagagtaaatagtttctacatcaagagggatatagctatctatcatctacatgacgtataagtgaaatgaatagttcaaatttgactaccccagacatattctagccttcttcactattaatacaagcgtgcacatcccgctccttaagactcatggtatagccttcttcaaaaaaatgatatggtgttgtatttagttccaatcatatagtgtaatatgccactatgataggattctgaactaacaatcaaggcaatgtagtgtcatccttcccacaccaattaggaattggttgtgcctactaccaatgctctaacattttggtgctaagaaagttaatcatcagagtctaacgatggatgatagaggaatttagggggttgtcagcctctcctatattttctcacgacggagatgtactaatcagtagtgaaccaatgaagttggtagcacggaatgaagagatcaggataatttgccaaaagaataggagaaagaaaacatggtaacatttctaagttgaaatagaggtggttagggcggatgagaaagaaacgtggtgagcaaggaattacgtttctagattggagtttattgagtctttcaaaaatctaaaattcattgcatggtgagctccacagcgggagagtgtaaatggtttctacaacaaagagatatagctatctgtcatccacatgacgtataagtgacacgataagtccaaattcagctaagctgatatattgtaatactcttcacatttaatgtaaacatgcacacccttcttaaagatggtatttttaggacctgctatctcaagtcgcgtattatacatttctttttacgaagcaaattaaatcctcatccttgaccttatcttttattttttaaaaaaaataacatcatccttgttacgtgcatgcatcggaccagcccttgcagccacaccacgtctcctgccggcctctagacgtattacatccct

SEQ ID NO: 56285 - DNA, 1501 bp, Oryza sativa
gatgggagagagactaaaaacagtaagctccggtttgatgtaacgtacatgaattcacgatccgagctgtttttggacacaaagtaggagtatctcaccgttgagcccctacacaatccgagttgttcttttttggacgttcacatgaactaacctactaccccggctctggagagaggtgcgctcgaccgttgtgatggctaagctaagcgcgcggggagcggaggagccacccatcaaggcatcaatcaaacaacgggctagtggtggaactacgacggcgaccatgtagctagccgctcgtgccacgctgtgattcaacggatctcgcctgcgctagctctggtgcgacgtcttgttgcgagaccaaaaaaaacaacttataacttgaatcataaggatgatggagtacatgctagtggtacgactagccaaagcgtggcccggcgcaacggtgacatgcatgcacggagcggaataatgtcacatccataccagcccgcgaccgcgaggcagccagcgtccgatgcgctcaggacaaccaggatcgaagagaagaggcaaaacccccacaaactccattacattcccttcctaaacatggtgctacgtgcactactagcacacgttttaccggacaataagtacgttaaatgatgtgaagcttatcatggttgcagctaataacacgactgtgacacgactaacgtttggcacggttatcagaggctggcagccaacacatggccgtaccagggacgaaaataacacagacgagacgacgtcacttccacggggtagtggttttcgcatttagctgtggacttgctgccaccccttcctttgcgtagcgctttttcctagcgccttttttttttaccaccgacagacaccgccgtaatactggcaggatccaagtacgcccgtcacagaattggctgtccatccaattttcgcatacagaaagaatgacacatggcattggggagagaaaggacaaacagttatcacctcaaagcgctactacaaatctcacatatgcatgagcccccatcctctcctctcctctcctcttcttgtttacactcaccgacacccatgtggagtgaagcagagggcattcatagttcacgcattacaaccacaatatactccctccctcaatttcgaaatatttaacaccgttgattttttagcacacgtttgatcattcgtcttattcaaaaacttttataaaatatgtaaaattatgtctacataaaaatatatttaacaatgaatcaaatgatagaaaaagaattaataattacttaaatttttttaataagacaaacggttaaacatatgcttaaaaagtcaacgtcttcaagcattttgaaacggagggaataaagaaaaaagatcagaagggagacgacgacgacgacccagcgtgcaaatgctttataccctaaaaaggactagtacgagtgagcaagagagtgagcaagcatggattgag

SEQ ID NO: 56286 - DNA, 1501 bp, Oryza sativa
ttatactttaatgcatgcttgttatattatagatgggtttatcttctttttattgcaacacatgacttgatatgctatatgtatgctaagctcttgaacattaataaacataattcctatgtttgatgaaatcattgtcaaaagggggagaagtaatgtgaaaatttttggatttttggagaagtaaggtgaatttttggagagttattgagaacagcatgtttttggttcaattgggaatttctttctttttaaaaagggggagaagttttcttttggattttttagcacgatgtgtacatttgtacgcagtgtgctttttaccacttttgtttttatttttccaaacacaaaaatatttttaataaggtttgccaatgtgttcattaagagggagattgtaaaatcaaaggtgtttttgattattattctgtgatgaaaaattggacattggagattattggtgtttaaatttgttttaaaataaaagattttctgcgatatctcgagacatttctttattcctcgtataccaacttttataggggccttatttagatcgtaccctaaaatttttcagccagtcacatcgaatgtttgaatatctgcatgaagtattaaatattggctaaaaaataattaattacatagattgcgactaatttgcgagacgaatcttttaagcctaattgctccatgatttgacaatgtgatgctacagtaaatatttgctaatgatatattaattaggcttaataaattcgtctcgcagtttacaggcggattatgtaatttgttttgttattagaccatatttaatacttcaaatgtgtgttcgtatatccgatgtgatatggtaaaaatatttacccctggatctaaacacagccatagattattttttttacctactcacttttatacgggtttaatccccatatatccatttttttactagtttattacgtctcctatcaccttttacatcattttctttatatctgcaactctctccgtccagaacataaaggattttggaggttagagagatgtgacgtatctacaaatataagtagattgtttttcaaatttataatattacgatgtgtcaaatcgctctaaaacacaacacagcactttgtattataggaaggagagaatactttgctagtttaagaaaaaaaatcttttatatcaagtggacgaagagaatagctatctgacgtaggatgagacaacaatactactagtacacaccgagacaagccgagccatacgtacgagtagtacgtgtacgtgtctggagcggcaggtggccacccagcacaaaaccataccaaacccccgcgccggccgggagccaagccaacgtgccagccgcggtttccaccattccaccacgcgcgaggcatcgccgtggcgtccgcgcgagccgtgtaaccggcggccgcttcacgtggggcgcgcgcgcgtttcacctgcgcgcgggcgctgcgctagc

SEQ ID NO: 56287 - DNA, 1378 bp, Oryza sativa
gattcacctaggcacgagaggggaccgcccgttgcccgctaggatcaggggtaaaacttgaggtgtggtgtgcttggctagagggggttatgcaaagggtcctgtcacggtccctttccagtatgtcgtggtggcatgtcggcgcacggtaacgtgtcgcagggctgtgtcttgtgggtacagttgtatacctctgatcagagtaaaactattcgaatagctgtgcccgcggttacgggcggtcaaccagattcaccgtgattagtctcaccctagcttagtctaatggaattgattagttcaggcgaatggttgggcctgttacaacgtggggtagctttgaacagtggatggttaagattgatgaattattacaactattttactgctttcaactactgcctttaaatgctcgctttatgcaaatgaaccgctctagctatcctttggttatatcctgcatcatacccttattccggtatgacttgctgagtacggtggttgtactcagtcatgccctatttccccccaaaccccagagtttgagtacatgttagatggtggcttctccgaggagtaggcttcgtccgtgccatcgaggttgcctgtggagtggtgttcccgctgcagtccaagtcaaggcttagctctatttatcttttaattttccgctgcatttatgtaagacttttatgatgtttgtaagacgtggatctgtatgtcaactttgttatttgtgtaccccggccggtcctggacggggattttaatgcacattctacttggaattctattcgggaatttctgggcgtgataagttggtatcagagccgaccttgactgtaggacaagccaaatggaaaacctaagagccctctgaatccttttcattgcatatgttctttgcaattggatttgttctgggaaaattgggatttgtttctgtagttcaagggaaaaatcttggtcgctcgtttaagtaagatttatcaaatcaggtcagtctagggttttagtaaaattatttgaggtttatttgacagttagtcgggatttgataggaggaatgcattgggtcctaactcaggaatatgtgttgcaagttatttatgctcttattggtattattagtatgtatctaatttctcattattttatcgctatgtaagtccgtcttatttattcgctctcatgcaaaaatgatctatgcacaaaattccgctctcattcgttcattttatttgagtcctttactgctttatttaaattggatttgaacatgcattgatcctacttctttgtcttctctagatggccgaccacccacccaaccaccgtggagaaggcatggatgattttgtggcagagttggctcgca

SEQ ID NO: 56288 - DNA, 1501 bp, Oryza sativa
ctattctttcgataaactatctcgattgggcctctacctgatttcgtgctacgaactccattagtctacgccatgaatttaatttgtttaggtaaagaaaaagaaaaatactgatatgctatacgagatagcatagagagtattattaaaatgccatctgacggagaaggatgttcatgctcgcattaatagtgaggagggatggaatacgtctagatgccggcaggagacgtggtgtggctgcaagggctgatccggtacatgcacgtaacaaggatattgtttttttaaaaaaaataaaatataaggtcgaggatgaggatttaatttgtttcgtaaaaggaaatgtataatacgcgactcgagatagcaagtactagaataccatcttaaagaagaaggctctgcaaacttacattaattgtcaagagtattacaatatatcggcgtagctaaatttggacttctcatgtcagttatacgtcatgtggatgacagatagctatatctcttgttgtagaaacaatttactctctctctctctctctctctctcgttgtggagctcaccaagcaatgagttgtagatttttgaaaggctcaataaacttcaatctagaaacttacttccttgctcgccatatttctttctcacaccaccctaaccgattctattccaacttagaaatgttaccatgtgtttttacctattcttgcaacaaattatcctcatctctcctctacctgattttgtgctatcaacttcattggttcactactaattagtatatctttgtagtgagaaaatataggagaggctgacaaccccctaaactcctctatcatccatcatgattaacttccttagcaccataatgttagagcattgataataggcacaaccaattcttaattggtgtggaaaggatgaaactacattgccttgattgttcgttcaaaatccttttcgtagtggcatgttacactatatgattggaactaaattcaacaccatatcattcctttgaagaaggctataccataatgtcttaaggagcaagatgtgcacacctgtatcaatggtgaagaaggctagaatatgtctagggtagccaaatttgaactactcatgtcacttatacatcatgtggatgatagatagctactatatccctattgatgtagaaattatttactctctcgttgtggggatcactcaacaataaattgtgactttttataggttcaatgaactcaaatttacaacctttctttcttactcgccacgtttctgtcacgcccagaaattcctgaatagaattccaagtagaatgtgcattaaaatccctgtctaggaccggccggggtacacaaacgataaagttgacatacagatccacgtcttacaaacatcataaaagtcttacataaatgctggaaaattaaaagataaatggagctaagccttgacttggactgcagtgggaacaccactccacagg

SEQ ID NO: 56289 - DNA, 1501 bp, Oryza sativa
tgattggtataaagatctgtatggattgacaagactcacgaccaacaagacatgcaggtactgtattttccaagtctcttccagttttgttcctttcaatttgttcctcatttgcctggcgaaatttgttcctcgtttgtctaagaagtgtggggaataaagtattcttacactctgccaccacccgacgatctgtaatttatgtcccccatccatgttacgttttcttgttagtttagttctccaaaacacaggtaattaggagaacaatattcagatttttttttctttaaattctttctggccaaggttttctgacttaattgatgcaactactacgggacttcctatgcctttccataaaaaaagtacagttcattcatcctgataggaattgaagtgtaaaacagagaattgcaaaatacagaaaaaacacaggaatgatcgtttgattggaccgcaggaaaaacacaggaatcggatgagaaatatagactcaaaggaatttttccaagaggttggacctcttgctaagtttcctccaaaatccacttacaatgtgtcattctataggaatttcataggatttgaaaagtttcaatcctttgaatcaaagggccaaataggaaattttcctataggatttgaatccaatgaaattcctatataaatcctttgattcaaaggggccctcattgtgtagcagcctgttgtggcggatggtgatggcaggcctgccttccagcttgaaggaaagaactgaaggattgaaggttaggcggcataaacttgtgatagcacatctcatgtgtctgataataacataatgcgttgatgtgcaatcagcgatcttgtacttcttaattacaatggttagaaatgtagctcttgacaaagtaatgattcaggagttctggtaattgagaaaacgagacagcatcatcacttaaccgttgggctaaatgccagccgatggcttctctgactcaacaattttcatggaaacgaataggattacaggagtgccaacgaatgtgatatttgcggggaaattgaagcaagtttttaacaacatgccttcccagtattgagttagagaattattgcatggcccatttcctttcggggtaaaatttggtaggtggtgaatttgacaatgtgatggcaggaaatgacatgccgttagtgtcgaacactagaaatgattctttgtattggtggtgaggaacaaataatggaaggaattcaactcaaaagctcaactctctaagtagaaaggtaagatctccaaattaaacgccggggaagaaaaaaaatcaaagttgaaagagggacctctgcaaatgaaactgaaggcgcagtttcatcttctttagatgagatgctaccatccaatctcaaatcagtgttaacggaagtgatttagatgaatattaagtatgggtatagaaaacgagaaaacgtatgatcatttgagttttaattatttcaaacttacaaa

SEQ ID NO: 56290 - DNA, 1501 bp, Oryza sativa
ttcctgatcctgatgttggatgaactagtaatgggctaacaacctttttttaattgagattactagcgacttagcaaacatatttctgtgcatcatatatgctaatttgtgctttgtatcataatgtatgaacttgagaagcaagatagggcaacaatagttgaatgattgtttagttacattcattgaaagagaatttttcttgcaaattaaagacaaggacatcatcacttatttccaaaatatcaaacaacgaaaagttgatctccaaactgtaagatttcttcccaatttatcattttctaccctttatgtatttcatatgttggcactttgatatgtttactaattagtattctatatgttaaacaatttcaaatgatgatcaattctatcaatgtgtgaatttatgctcaattatacgctatatattatataattattagtttgtgatactatacaagccaattagccaattattaggtttttaggtctatgaacaaattttttttacccctttctatttcgaatacacaagtttaaaatcctggggccgccactgttctcgagcgattagatcacacatttttcttgcatttagaagcatagttgtatttgctacacaggttgtaatttgtagttgatttttttgctgttatcaatctttgaacaataactttatttataactctgaaatcctggggaggtccatttgaattttggttgatttctcctgttttaaggaacccctagattgctgtaatgctgtgtctgtgaggaatcaaatcgaaaatcttactctccgttcatttagttatagccttttagatttttattttctccatggtgctatccttaccaatcttatccatctatccttggtttgatgatttatgtgcttcttcttcagcgagcaagattaatcccaaggtgcgggtgcagattatcttccaaacatgtttggggctctactgggactccatggcacatgttaagtgctctggattgcttgctattttctgctcctcaatcgtgctcattggctcacacatggacggcttcagttatgcacaaccgtcttgtaggtggctgtttcagcagtttgtcagcagcagtagcatcggctattcgtgtacctgttgcaagctatgggacttctgcagcacaaagcacatcaaaggaccagcatggcagcaacatcaacagtgcgctaaaagttttgaatcttgtaccaagaaaggctgactatgacaaagtgggaggtccatgccatcaccgactaatccatgactgcatgaatgacatcttgggggttcaatcaaatcatactatacacaagggaaatggtgtcacttttaactcatgcagcaatcctgcacaggctaaatttgatagctttgtttcaaataatggctcggctttgtgttccaggactagattcataaaggaggacatgtttatgctgataatggagctgcacaggaaaggagaaaccagtact

SEQ ID NO: 56291 - DNA, 1501 bp, Oryza sativa
tgattatcaactgattatcgagtgatcagctgttaattgtcgctgttaatttggtttcttcaggattcgaagcaccattgctgaggtacagtattcgtcaatttctttaacctcctcctcctctcttcgtcgtcgttgtctgtcatcttgctccgcaattttcttcatttgctccacaaatttagtgaaagaaattaacacctgaacaactctagaaagagactgaatttgagggaaaataaacagagcaaacatgacaaataattgtatgacttaaaaggtgatattgtcatttttactgaattatccctatctttctgcagtgacatgcgtgaataatagttctcatcacccataaggccatcatcagggtttcaataaataatattagacaatgctcatctttcatttcaaatagtttaatttcctgatcattttgggactaatcatggttttaaactattcgtccctcccttcatattataggccactttgggtttgacctaagtcaaatatcattaagtttgataagtttataaaaaatgtagaaacatctacaacatcaaattaatttcattcaacaaccatcgttcaatatattaatttttctataaatttggtcgaacttaaagaggtttgatctataacaaacctaaaataatttataatttaaagaggtgatatactcattttgcaatttttccatattctatcctcccgctaatgatataaatatgtcaagcgggtttatatatatatatgtatatatataattttaatggaaaatttcatgttcacacaaactttaagtccacacatcgtgcatatatataagtgacaaatacagtggaaattattgaaaatactgtacatgccaataatattatacctatgtgtaaagtctatgcattatactgaaataaataaaaattctgacagttttacaagtaaaaagccattagattttgtacttaggacaaacgtagtcggaactcttttttttgggcaaaaaatgtgtaaagtctatgcattatactgaaataaataaaaattctgacagttttacaagtaaaaaaccgtcagattttgtccttaggacaaacgaagtcggaactttttttttggggcaaaaaatatgtaaagtctatgcattataatgaaataaataaaaattctgacagttttataagtaaaaagccatcagattttatccgattttatccttaggacaaacgtattcggaactcaatgaagggttgacaatgatccaatttcagtgttccagtttctgtagaaatatcttgaattccaacaatacaacgacaaacccgtgatttcttcatgtggattttactgaaatctatgttttacgttccagttttaagtgcttccttgagcttcaaatagtacgacatcccagctaaatttatctcatacaaattctacttttattcccattctagattccaaaaacaatttacaagctgatgtgtggttactg

SEQ ID NO: 56292 - DNA, 1501 bp, Oryza sativa
ctaaaatgattgcaagagctagccacgcaaataaactgtttttggatagcctacttcgtacgttttttatcaagctggtacgtttcatcaaaattctctatataaaagtaattttaaaaaataaaacaaatctactttttattttttaataattaatgattaattaattatatgttaatcatatttctccttttacgtgcgactaataattcgcttcaaaacggactttagaacacgtcgtatacgaggcttaactccatatatagttgttgcattgagctgactatttcagcctcagtttatgctatgtgttatgttatactgtgattatgttttttgtgtgtgtcgctgtgcgattactttagttgcttttacaaattaaattacagctaaaaattatttatctaagtttgttgatgtccatgtcatttacttaataattgctttatattatgtacataccttatcagttagcaacctctgtatacagctctattatactccctccgtcctaatatgtagcaaacctagaacgagattagacccatcctaaaactacgaatctggacatatggcacaggctcggttacacaatatggagatatcgtgcatatttttatgaggcctatccatatattcaaattcacatgaaaaatattggtttgaacaagtgtaatccacataaacaatatacatattttatctggatcacatttgtgctctaagcttacacgggtggagaaaccatttttggtcggtcggtcgaaattcataatagtccaggatccattaaaaaccgggactaaacatgatctttagtcccggttggtggctacaacggacatacgtgatatttagtcccggttggtgttatcaaccgggactaaagatcctggcgatctttagccccggttggtcccccctttatatatgtcttcttcctcctccagcccgagcaagcttcaaaatttctcaaagaaagaggggaggtcatgccaaaattacttgtgaaatttttttagtgattatatacaaatcggaagtgtctaaaaggttagtaacttcatcctccaatgtattttgttgttatattacttttggagttatgtttcacacattaattgtctccaaaactttgttgtaagttgatgagagagaaaatttgtgtggggaagaagaatatatagaaattttgtttgtttacttaaaaaagttttattctcatagtttaaaatatgatgaaaattaatcttaaaaaatagaaaacaaactaaattgaaaattaagagaagtacaacattaatattagttcagaacttcaaaaattgttaataagaattgtttgttggattattttataattactaattgtatgagtaattatatgtcattattttttatgcttgtcgaaagagtttttaattattttatcattattgtttgactgttattattgtacgaaaatttatttatgtacgatttttttttcatttcatgtaga

SEQ ID NO: 56293 - DNA, 1501 bp, Oryza sativa
attatgagtgtcttgtcactcttcatgactgttggcagcgtggggtttggagatatctggctgcggagagcccaccggccggggcaggtcccaatcgttggagctggagtagctgacaaattaagtgtgtatgaagatggcagaatggggtagatggaacgaaaagataagagcctttttggcttctacgtgatgtacgatcctaagagctaatctattaagaaaaggctggttgagagtggagtacttgtactggtagctaggatcgcgacctataattaattttatactcgagattttgttagcttgcacgtatgagcatttttttaagcaagaacgtacaccaatttgaggttgtaattgtctctaccctactcgattgataaaatcatttttcatggaatgattgtttcgtgttcatatcagtcaaccgtctattatagtgtgtcttttccgccatataatgagataaatacaagctactctcgtaaaaactactccctccgtcccataatataaggaattttgagtttttgcttgcactatttaaccactcgtcttattaaaaaaatttagagttattatttatttttttgacttactttattatccaaagtattttaagcacaacttttcatttttttttatatttgcacaattttttttaataagacgagtgttcaaacagtgcaataaaaacttaaaatcccttatattatgggacggagagagtagtgaattgtacccgagtcatctcctctcacagaccggtgctcctttttcctctcttattctcttccctttacttagtgaagtttagcggtgtctatgtataactattttattgtttctctacatgctctaaatatgacttttatactgttatagttcttatatgttttccatatatatagccctcgtgtactctagttattcattgctttatgaatgataccatttgaaagcagaatgtattatactagtgacataaaaggaagccattgtgctcgctctcgtgacctagaaattctctaattaatccgaaaaaaaagaaatatgaattattaattaaaatgtgggttcaaatcctatctttctataaagttaaggctcactacatcctaaagcttaacatgcaaatatgccacatcatccactaacatttactacatctcaaatctcatgcaagcatgctaatctattaagttttagagctttaaaatgcaagcatgttaattaaattatcatcctacataattcacataatatttcaatatatctctgcatcattttttataatatcttatatacctatatagttcatcctcacttaaatttaagagctttaaaaaatccaagcatgttaaatcatcattccacataattctcaaaatattttcattttgtataatatctatatacctatataattcattcgcacttagttaatgttatttctctcttctctcattaagccatatcacctcaattgtttctagcc

SEQ ID NO: 56294 - DNA, 361 bp, Oryza sativa
ttcctgcagccctatgatatgagtaccaagttacctaggtacttgagcaagtgttatatactccgtatctcttatttggttctataaccaagatcatcttttttttttcataagtagtttcacttgaacctacggagtaagtgtaacggagtatctatgtactagtcgatatattttttcactgaaatcacatataaatgtataatgtaactagcttaattcttagtacctcacgtacgcccgtaactcagtgagaggtgtttgtgcgtgacttgaggatccccgggctacaacatgattttgttttctccgcttagcatgaatcttggcgtgacatgattttttgtttttcccacctagc

SEQ ID NO: 56295 - DNA, 264 bp, Oryza sativa
taaatatagaatatagataaataaacatacacatctagatatattctagatcctcttttcttgactatatattttagtattttaataaatttaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcg

SEQ ID NO: 56296 - DNA, 271 bp, Oryza sativa
ccgccgctaacggaaattgaatcgagttaccgtcctcctttcctcctcttgtgacttctaacattccttacccaaaactctaggtctgcccaaaattctccaactccaccatcgacggctcggttgcgcgggagggggtggatagtcgaagacacagaagggcgccgggccgctgggggctcgtcccgaggcgcgcggcggcaaggtgatgcggagcagtcaagggtcgtggcttccggcacccgggcgcagctactacaggcggcaacaa

SEQ ID NO: 56297 - DNA, 1501 bp, Oryza sativa
gcgaaccatgtgcgccccaaaacaaagccaaaacaggtattggaaaagcctaaaggcatctcagcaacaatgataatcttaagctatgaactcatatcagcagttatccaaaggcgcatgtaatgctgatattgtctcatttcatgaaaatgtgaagaaacagcgactgccaccagaaacaatcaagcaagttcagttaacgtggcgagctcatcctgtgtcctttcggtcgaaatctaactacaggttcttttaacaagttaactccaggttatgatgctgtagaccttctccatcatcagctaacagctctaaacacgctgcctatggtgtcgccatcctcaatgaagaatatgataaaccttccaaaagcagactggtgaaaaaacatagtgttcagttcgatgctgatggcaacagccataacgcaatatttgaagaaacaagtcagttgatttcaaaactcttcaaaccatattaactttctacttgcctggtattagtgccaaatattgcaaaataattttatcttgtttcacttttgtttctctttgcctcacatgctttcaaggcttgaacatctgccataaaaaggaagcaacacagatattgttagaacaaagtgagataatgttacgataataaaaccagaatccagcttgtggaaaactaagacagcactaactttaaacaaatatggatgtaactatcatagctaccatacttttatcctcaaagaaatgctacatttagctcggatcacaatgcaaggcatcttaaaattgcaacatctcaactcaggtctagccccttgacttgagcaaacattaacctcatcacagcaattgtacagccaaaagacaaaataaaatgtggctgtaagttattcgattttggaaagcaactaggatgcaaatgtgtgaccaaactttgtgcagtgctaggagcctaggacattagtgctatatggcaaagttggatctgcatgcctgctgttgttacttgttaagggcctgcgagctgttaggtaagccaaatgtgtacaaattgcctcatggatcagcaacttcttttactagaaaattacccagtaatatcgcacaagtgcgcatggttgtaaagaagcgccgaaagacataacttcacgaagccttagaatagtttcaggaaagacatgaagctaaaccacattcacatgtagatttatcttggatgattctaactcccattctagcacgttttaagctattgaaggccatatcatgccattaagaacctatctatatgcaagaatttcatacaaaacaattcaattcccaaagaagcaagaaaaattccccacatttccttttctctctgagagtgtaatgtgataagcaagtgagcctcacttcagctataccataagcactctcttttgaagaagaaaatttcgtagcattcctgagtttacattaacacttgataaaccagaaaccattcacatgtaacatgaggcagt

SEQ ID NO: 56298 - DNA, 298 bp, Oryza sativa
gagcatggaagtataagcccgcaatagaacagtctgcgcagtcatagtaaacctgtgattattaaaaaagtatcggatttttcagaaagcaatttatactctgcggtttgtcaataatgcgaaataccaagtctgatgattgtcgaaaacttttggctgtaacctatttacacttccagttctacttttttctgataaccagagaagttcatatccgtacataattgaacacggaagaaactatccgatggagaaagccaccgggagaatggcaggagttggtgttctcggtctgcaa

SEQ ID NO: 56299 - DNA, 1501 bp, Oryza sativa
gtcataggttctgtcattcccactgcttctcctttaatggttaggtttgaatctcgcaatggagcttccaaaaaatttctttccgagtcaatttctcagtttattaactcaggacgctctttgttattccttgaaatttgtatttcttgtttcaatcaaattacgatttcgaattctttgttatttttattatattgatgctttatcacattgctttttatgatgtattcatagaccatacatattggaatcctatatctttcttttttctcttccttctttctatcatccttccttttatctacatcccctttagttttgcttcacaacttagaatcctatttttttaaagaaaaaattgcagttgctacacgtatatgatagatttacttatttatgatagatgtatttattcatatagtgactgtttcttagttaggatctcgacaatacgaagcaataggttggttattagttcattttctataattacatagtagggttcattctatttttttaatcccctttttgaaccctaaaaaaaactaacgagtcacacactaaacatagcaattttattaaaagatttctcaattttcattaaatcttatagaaagaggtagaatttcttctttttttcagggattttagggaaaataaggctcttgtcattttttattctattacttaacagaatgggaagacagggttggttattcttcatctacgaatatccaaattttaactcctaatactccatagatagttcgaattggatagcagcaataatcaattttagatcgaattgtttggaggggaagtctaccttttttgatgcattcggcacgcgcaatttcttttcccgcgagacggcctgcaatttttacttttactccctttatatatgttttttagttaattcaatgacccctgtacatttgtcgataaattttctcttaaaaatttgacagatgtaattatagtacaatcgtagtgtagttacactgtaactcatatgtaattacactgtaacttgcatgtaactacagtgtaacttatatgtaagtttcacgtaattttgaatcgttagatctattacaagatttgtactattacaagatttgtactagtgaggaagaaaacaaatcatagcacacacatatgtgaaaaaatttgttcccaaggtctccattttatcgaaataacaagttacggaaagatttttgaaaattacatacaacttacattatagttacagtgtaattacatgcaagttatagtgtaattacactacgattatactgtaattacatccgtcaaatttttgagggaaaatttatcgacaaatatatagcaaaattatatctcattcatatgatcaattgaccaccatatctggttctcttacccagtttcactttcatagcacgtatgagagcacgcttgtgctttgatgctttctcgcgttgacaactcgaaaacgtgtttatccatagttcca

SEQ ID NO: 56300 - DNA, 1501 bp, Oryza sativa
gaccacacaacggagctgggacgttgtacttcgtggttcgccactaactgtggtgagcggccaggcttgtcaaccatagtaaggctccatgtttttttatatagaaaaaagtttaatgtttttcgacgtatgtttatgtacgtatattgattgcaaattatatggatggaatctagggtgcacttagagatcaacagatatcctataaccaataaatctaattagatctagtccattaaaaataaattatatttattagtcattagttatgataactctagtcttctatgtactaattagacaccctggaaaatctgtgcatgaatcgtgtaccggttcagatgaaaatagttcatatcaatgcataacttaataattataaagtttaaatttttatattatcaaattaatggagtaccggttggggtgaaggaaaaacatcaaagctcatggttcggatcggctcgaactcgcattcataacaagccaagcgaagctgagtttaatgagttagctcgttactacaaaacgttatcatatgtctatatccttagtttgtattaactagcatagtcttctaattacgtggaaactattttagtaattcctttattaatttctatttattagtacgttaacatatgataaaattgtgaattcaaaattataaaggttgatgtaaatgagatagaactcattaacaagctagatagtcagtcgagccgagctagcgttttggctcgttaagattaacactctaagttaactcattaaggtaacaagctcaaacaaatcgttacccacccttcacgtatgatggtctagaggtggagtgaggatgaccaggttttaaaagtattggtgtccacgaatattaaacaagtgttttttaataggaattaaagaagcatccgacaacgtatgaaagctagggagaagatttgtcttgtttttttttcacgcgcacacttcccgaactactaaacgatgtattttttttaaaaaaaatctatagaaaagttgatgtaaaatcatattaatatatttttcaagtttaaaataattattactcaattaattatgtgttaatgactcatctcattttgtgtatttctctttttttctcttcttttattttctctcaaacacacccttgtaagatcagggatatgctattggtttatgtctctttaaaaatttgttaggggtgcattatgagagcacggtaatggagagtttaagcatgatacaactttatatccatattgtcaatgtaaggataaggcataccgcctatacatgggtttacgatacacggagataccatagacctaatggtatacgagaaggtatcctttgattaagaaaatatggtggataaagaaagaaattatcttcccggaatagaaggtgttggagttctagtcagaaaagataaggtatccttacttcgtatcatgttctatttctcagagttctactttgagaggaaaatgatctt

SEQ ID NO: 56301 - DNA, 766 bp, Oryza sativa
cgtgcccgtgatctggagccggtcgtaagagaggagatcaatcaaagagagaatgacattggccttgtttggatcctccgggctctctgtaatcttgttatttaggagtattaaacgtagattaatgagaaaactcattccataacccccgggctaatttgcaagacgaatctaacgaggtatattaatctatgatttgctacagtgatgctacagtaatcatccgttaatcatggattaatatacctcgttagattcgtctcgtaaattagccaagaggttatggaatgggttttgttagtactctacgtttaataattctaaatagtaagattttagagggctaattattagcccggaggatccaaacaagaccattgtccggaagatttgatgtgatctagatgtggttaatcgaatctgacttcgaaggaaaattctttagatgtgcttatgtgctgctggttcgtgctaattatttagatgcttgaatgaatgtaatatcctcccttcccttcccttttaaaagcttgattaactcttaagatcctttggtttgatttgtcttggaaactaggatgaggtggagcttatggataaatggttttaactaaagatatatagttctaaaaaaactaagatatatggatttcaccagcccaaatagtggggatgcctgatcagccggacaaacaattcccaacaactaaaatgtacaacatatgcagtagatgatccaaaaataaggcagagaaaaactggaata

SEQ ID NO: 56302 - DNA, 1501 bp, Oryza sativa
agaaaatgtgttttagcaagttcactttgcatctctcgtttttgtactccatctcacgtattaaataaaaatacttaaaacactatggattgttgttttgatttacgtggcatgctaatcagtaaaagaaaaataaaaaacataaaacatgtgggacctacatgtaaatgaactttcacctctatgagagcggcggccggggctagggtagaaacggttgcactgagtttagcggtgagtgaaggagaagacatcaccatgcgaagtatggctgtggtggcgaacgaggacgcgaaagtggggaggacagctccacgctcgctaaccaccgagcaatggttgcggtagcttcggtctccaaggaggaataggatccggactagagacgggagctagggaagcgacgtcgatgcaaccaacagaggtggatgtgcttagtggtgaggtggagacgaaaatggtggtgacataggtgtgcgaagaaggcgtcaccatatgctttagcacccgtggcctcaacgagggagggcgagtcatcgcttggcgagtgcacgcaggcgagcaaagcgcggatacgtgtatgctgcaagccggacagggagagagacatactcctaagtgacctaaccccacgaggagaggggcaacggtcatggcggactagtagggtcgcagcaactgtccgacgagcttgtgaggagcggcctcgttgccaccggcggcatggatggcaggggtggcgaggcggtgaagatgatacgggaggctaagattgcgtaggaggagctcgacaaggagagaaagatgatgcggcttgccgatgagctccgcgagggtaggcatggctccagttcaagcttgagcctttctagtccgccgcagccaccgcccctctccctgtcgtccgccatccttccagggcgtcgcgaccgctgccattctcctctcggccaccgccagcctcccagcctagaaggaaggggggaaagaggaggaagaagagctggctactaacatgcccccatgtggatcccatgctagcttagcatggttgaccgtagtcaactcgccacgttgactagaaccgagcactatacagcttagggcgtcgagtacaccggttttgcaagtttacggacgaggtatatctagtagtatttcgattctcaacgacacaatttaaactagatatgaaatttagagacttaaattgaacttcacagacattgggaaacagtgaaacacggcccggttcgcgccgaacagtctggacctcgcgctcgcggcccgcacgcgcacgggagttgcgacctgcgacgagacgcgggcagccgggcatgatctccccgcgtccgacgcaaccgcgtttattttcttcccatggctgcctccacgacgcccgcgccttcgtccgttcgggggtagggcggccgccttgtgcgggaagaaagcggggggtgacttaaaagcgggggccaccgttgcacgccgtggaaaccag

SEQ ID NO: 56303 - DNA, 1501 bp, Oryza sativa
ctaagcgatcacacagctagccggtttgggcactaagcgatcacacaaccagcctaaggccctaagacgatcctgccaacccgttcataaggatcagatcctacataaaaacaagagtaaactgcactcacgatacacgaacttacgtggtgggtgtaaatagatataataacttgtaaattattagatcctacataaaaacaagagtaaattgcactcacgatacacgaaattatgtggtgggtgtaaatagatacaataacttgtaaattatgtattttagtataacaacttgtctagtccgtgagaaccaggccaaaacaatccatgcattcaaaataatttgatgtggcgttgacacggatgccatgtcgctttccttcttggctcgtttcagttcatgtttgcatctttttgcacaaaagttataaaatcgtaagcatggaaattttgtttcgtgcactctattacactcacccatccctgaaatagttcaatgcaacatggacctaaatcgctgactagctacaagtgctcagagatattggtggagggtcgattggccattacactaccgttttaatacgtggcaattagtatgagatattgctaacaacttgtatgagatgaagctggcagctacacttctgtcgttgatcagtctgatcaccagccactctagttgtttcagtcttagaaactactactccacggggtattacaggatatgtgcttcttccactactgcaacctccatcttcttgccattacagcggcgtgcaactaattgtctcctcaaccgcatagttccggtgccacatcatgttattttcaaatacacggactattttggccttaatttatatggactacacgagttgttgtactgaaatacacattttgtaagttgttgtatctatttgcacccactatacaagttcatgtaccatgaatacaaatatacaatttactctaaaaacaaggataatctgttgcgtggttgtccccgatgttaaatcgactacgatctaacgccggggctcgctctgtcttcttctgtataaatcatgcttgtttacggtttacataatgccctgacatttacatctgctcgttatatcctgataatactagaagatccatgcagttttttgagtacatactcgatattatctgctatatgtcttgccttctagaaaatatttttcaggaacaattatgcactcgagtaggttgtggtcgagtacactctattatcaagaacattctcgacaaatgcggagttatcgcacccgacctaccaacgaagaccgacgacctatctcatagcaccgaccctggctggactactcgagaaaaggttgttaacggatagttcctcgcaaacgccgtcggtttgatcacccgacatgattgcgagcggacatccggatatgctataagttgggtgtgtgagtcatgctggccacatgatatgcacatgtaataaaccaactttagc

SEQ ID NO: 56304 - DNA, 1501 bp, Oryza sativa
aggtaaatatggtgctaaaagaaaccctcaggttgtatcctcctgctatgtttctcaataggatggtcaacagggatgtcaagctgggcaaactcgacattccagctggcacgcagctccattttcccattcttgacattcaccatgatgttaacatatggggcaccaatgcagatgagtttgatccatcaaggtttgcagagggcaagagctatcaccttggtgcatactttccctttgggattggccctactatctgtgtcggccagaatcttacgatggttgaagaaaaggtggcccttgcaatgatccttcagcgtttcgcgcttgttgtctcgcgtcctatgttcatgcgccaatgcatggagtcacactccaaccccagtacggtgctcaagttcttgcccataagatttgagacttcgatggatttgtgtgtggatttctgggtctttgcagtaaatatggtgaatgcagcagacgtacatcgtgtattatatatctttgtgaacaattttggaaggatgtttccagctcgtctgaactttctatcaaaagtggaatttgctggagccatgggagcattttccatgtacaaacaactcttaatacctgcagaaatgtacagaaaataaaatggtttgcgattgtaaatattccagttctctcctttttatttttggatatccactgcatttgttgacatatttagtttacccgtttgataaggcacccatttttgctggtgaaatctatatatcttaaaaccatttgtgcatgagctccatctcatcctagcttaaaggatacagcacctctggtttacgcgatggcaaaaaagaagagtgcaaacctgcagcaagcatcgcattccgaccaatgattggcggaccttgacttgcctgctgtctcagggtggacgacggatctaattagccaactcgtcgacgtctggggtgttgttcatagcttacaattaatggagaacaaagaagacaagatcacatggaagctaaccagccacgacgaatacacggcgagatcggcttacaaagcgcaacttcttggcacaacaacgtccaatttcaatgccatcatctggaagtcctgggggccgcgcaaatgtaaaacttttgcttggctcgtcatccaaaatagaatttagacctccgacagattagcgatccgtgggtggccgaataactccatttgcctcctatgtcgaaggaatccagaaacaaccctccacctcctggcgggatgcagatatgtgagaagagtttgggcggcacttgcggactggacgctatgtgaacagataaaatcaacacagtggcatcaagcctcaacactcttcgagtggtgggaggtcaccgcatgctcaaatgaagcaccaaagaaccccctatgccgaaggaatccggaaacaacccttcacctcctggcgggatgcagatatgtgagaatagtttgggcggcacttgcggactggacggcatgt

SEQ ID NO: 56305 - DNA, 1501 bp, Oryza sativa
tccacctctgttggttgcatcgacgtcgcttccctagctcccgtctctagtccggatcctattcctccttggagaccgaagctaccgcaaccattgctcggtggttagcgagcgtggagctgtcctccccactttcgcgtcctcgttcgccaccacagccatacttcgcatggtgatgtcttctccttcactcaccgctaaactcagtgcaaccgtttctaccctagccccggccgccgctctcatagaggtgaaagttcatttacatgtaggtcccacatgttttatgttttttatttttcttttactgattagcatgccacgtaaatcaaaacaacaatccatagtgttttaagtatttttatttaatacgtgagatggagtacaaaaacgagagatgcaaagtgaacttgctaaaacacattttctggttgattacagtcgcttgttgagccattggatcggtcataggattcgtgctagcatacttaattacgcgtaactagttgtgctttataggttacaggtcgctaattagcggtctactggagaactttgctactatttttttcttcactgcatgcactcgatcaagtatgagtatttgtaccgaccagcgaaacacatatgtaattaaagtataaatatgtaattagtatatattagtagtatatttagacagtagttacaccctacatacacaccacttacatatataattagtatgtaattttgtaacttacatatgtaattttagtacttacatatgtaattttgagacttacattgtaaatacactaaaattacatatgtaatttagtaacctacaatgtaaatacatgccgactaacttttgatgaaaaatatggtgttataaatatagctactcccgaactttattccttctctgtgagatatcagtggaaacgctcggtggaatcgggggagtatttgggagcacgcgccgacgcgcgcgtcgtgcgtgccgtcgtctttgtcgcggtggagcggagcgcgcccacttgcgcgcctgggccggaggcgggcgcgccgggggttcgggaatcccctggagccacacgtaaaggcgcgggcgggagggagggaggggccagctaggataaggcacgcgcggccgctgcgattggggcgcttgtgaacaccggggcgccacgtggagaggacgttacactccagccgccaaatttccactcccacacccgcgctcccctcccctctcttttccgtgatcgcacctcgcccacgcgccccccgccacacacaatctctgcagctctccagcttcgttggaactcgcgaatctctctccgatcccaggtaaagcagcgaacgacgtcacgcacgacgctgctcggtggatttcgttccttgctggggaaaaccatgcagagacgaaggtgaatgatctgcttttgtgtacttgcgtttaccaggtgaagcgcgagcttggagttggaggggagatcgatcagggccagga

SEQ ID NO: 56306 - DNA, 429 bp, Oryza sativa
tcctgcagcccagaagcattaaaaaaaaaggaggccatacggcggcatgctgttgcctgttggtgcactgcataatcccagtttcctcgcctgttcagtgtccccggcccggaaagacggagcctcgcgccgcccagatccacacacatatgcctctgctgctgccttgcgaggcgcgatcaagcctagccacacgccgaggcgactcgacgcgaggcctcatccgggaggaacacgtacgggtccgcatccccttccgcgcgctcgcgctgcacagcacagcgcgtgcgccgagagcgacgagggaggaagccctccccacctcaccaccacacaaaacccgcgctaatccccccgtggcggatagcggataaccagaagaaagacaggaggactcgaggagaggagagcgtgcgcgggctgcgatga

SEQ ID NO: 56307 - DNA, 1501 bp, Oryza sativa
atagttctaagagcaactgagaatttattttctttctagcacggtgtctgtttagctgttctatatatgcatatatgctgactggaaaaacatgatgaaatatccttctctttgccaacctttaacaaaaatccttgaggttgtcatatcaagtagtaattaacagtgaatctgtctctcaatattaattattaatctgaggctgtcgataaaatgaacataatttgatctctagatgctgtgtcgctgttgaggttaataagattcaatggatgcaatgaattagatacattttctgtgatgctgtaactgatcaactacctacttctgcagctataccttctcttcgggcccgtgactgctcaagtaaggagaaagaggctctcaactacttgtttctactggtccctctaatcaacgtcattatcccgttcttcgtgaaatccttcgctgttgtctggtcagcagatacggttgcattctttgtgatgtatgcttggaaggtatttcctcatgtcaaatgttgtctgctccttcaatattcagccagttttgttgtcaaatgtttaacaagattcatttctacacagcttggatggctgcaacggtcagagtgaacaatttcctgaacgaaggagcatttgaactgcaaattttgcctaagtgaattttggagggcacgctacatgcgatgaatttttcctagatttagtttcgtgtacatccatggagtgtaaagaagcttgctatgtagatgtaccttaaattgtcaacattagtgttgactaggaactgggcatctctcaacctgttatggtttcccagtagatcatatatgtctgcgcgctggcatgaaacggttgccaattgcatctgcttcgttcttggggctacaattcgcaactgaatttgctatatatttgtcgacaaattttccaccaaaaatttaacagatgtaattatagtacaatcgtagtgtaattacactgtaacttgcatgtaattacactgtaattataatgtaacatgtatgtaacttttaaaaatctctccataacatttatttcggtaaaatggaggttgtgagaacaaattctttcacatatgtgtatgatgtgattttttttcttcctcaccagaacaaatcttataatagatctaacgattcaaaattacgtgaaacttacatataagttacactgtagttacatgcaagttacagtgtaattacatatgagttacagtataactacactacggttgtattataattacatctgtcaaaaagaaaatttgtcaaaaagaaaatttgtcgacaaatgtatagggagtattcctttcttaaactatgaatttactcttttggaaaaaataagtctctttgtttgaattttagaactttgaattttttaccctgaaaaaaaaaagaaaaacctaaccatttaaatctttggtatccttcaaatcttcggtatccttcgagtcttcggtacgcttcgaa

SEQ ID NO: 56308 - DNA, 1501 bp, Oryza sativa
cggctcccttcttgtctcattaccgttagcacattttacgaactattaagctatatgttttgttttgtgtgaaaaaattctatataaaagttactttaaaatatcaaatatatatatttgttaagtttataataattaaaacttaattaatcatgtgcatgtaatgagaaagtttttgtacaaattaatttagctattagcacatgattatttaagttttaattattacaacattaacaaatggataaatttgatagtttaaatcaacttacatagaaaattttcgtatgaaacacaccatctagtagtttgaaaaacatgctatcgaaatcgagataaaatatgaatcttaatgagaaaataacatgtgaaaatatatcctctcttatgtccgcctctctcatattgtcatacatgagaacactctcattcaagttgtcacccttgtaagcttgttccacaaggaccacactctggttcaatttccgcttattctctcttcccccgcgcctctccttccctattctggacaaggcaacgctccatctatatatattgtccctatcgaccgcctctacattggcggcgcttcggattaatcccattctatcacacccagaaatttagcccaaatttctagactattttgtgtattaaatccctatccaggaccagccagggtacacaaaacgacaagtaataaacagttccaaacgtaaataaagcgtaaaatacttacaggagaggcacttagtcctcacaccgaaacaaaagcaacggcagcagaaaagacgatcctagcggggcttcagctccactccacaggcaaaactcaactggggtctgagtcttggtcctctaacttcgtcttcagctcagaagcactacacttctgaaaagggggaataatagcaaaggctgagtacaaccaccgtactcagcaagccacaccaatgatgcaaacgtgcaaggggaacacaaggacggtttgtggctatttgcataaaggcggttgtaaaacattttattgagcaaaaccgtaaaactattgagtaattaaagtaacattaaatcttcactgatcaacactacaccacgttgaacaggcccaaccaacccatctgaactacagtgcattgagtcgatttattaaggtgggactaatcacggtgaatctggtcgactgcccataaccgcaggcacggctactcgaatagttttactctgatcagaggtgtacaactgtacctacaagatacagccccacgacacgtttccgtgcgccgacatgccaccacgacataccggaaagaggtcgtgacaggacccttcacataaccccctctaaccaagcacaccacacctcaggtttcacccccactcctcgcaagatagcgggcagtcccctctcgtgcctaggtgaatccggaagccgcataggccgtcgcaggacccatccaaactccatcacgcccacccttgcctggatgcgtcagctaga

SEQ ID NO: 56309 - DNA, 1501 bp, Oryza sativa
aaaagacgatcctagcggggcttcagctccactccacaggcaaaactcaactggggtctgagtcttggtcctctaacttcgtcttcagctcagaagcactacacttctgaaaagggggaataatagcaaaggctgagtacaaccaccgtactcagcaagccacaccaatgatgcaaacgtgcaaggggaacacaaggacggtttgtggctatttgcataaaggcggttgtaaaacattttattgagcaaaaccgtaaaactattgagtaattaaagtaacattaaatcttcactgatcaacactacaccacgttgaacaggcccaaccaacccatctgaactacagtgcattgagtcgatttattaaggtgggactaatcacggtgaatctggtcgactgcccataaccgcaggcacggctactcgaatagttttactctgatcagaggtgtacaactgtacctacaagatacagccccacgacacgtttccgtgcgccgacatgccaccacgacataccggaaagaggtcgtgacaggacccttcacataaccccctctaaccaagcacaccacacctcaggtttcacccccactcctcgcaagatagcgggcagtcccctctcgtgcctaggtgaatccggaagccgcataggccgtcgcaggacccatccaaactccatcacgcccacccttgcctggatgcgtcagctagaggaaagctacactacaagcccagccgttgcccacgctggcttatggtaagcatgataaattcttccagggtttcccgcgaaccggtccttaatcgccatgggcacgactagcaaaaccatgcacccacagcccaccatgtagtcgcattttagttggataattacgaccatgaagtatggctagatgtcttgagcacgcagctcattctgatactaaaaagatctaatactgtaattatcccatcaactgagctagtggtaattaagcatgactaagtatatagttctagctaggtcacataagtaacatgagctagtctatttattacccaaggttgacaaatgacagatatcaagtaaatatggcacaagcaaacagataggtaatacccggatcccatgtaattagcaagacatgcaattttatttgcaaacaataaaacatttgtaaattaggatcaaaatgttcaaggggaatgtgtgacttgccttgcttcttcacttggatcttctgaactcttttcctcgtgaccgcgatcttccgaaacgacggattctacacgctggcacacaaaacgaggaaaaaatctaataaaaaccaaggaaacagtacataaaaagtaaacaaacatgtagatctcaattttagatgaattttgtaagttgaatggcccaatttggagttcgaatgaattagatatgaattttagaagttttgagccatttaaatgaatttctataattaataccaatttattgcacaattattaaatatttttccaaagg

SEQ ID NO: 56310 - DNA, 1501 bp, Oryza sativa
aaatttgacagatataattatagtacaaccgtagtgtgattacactgtaacttgtatgtaattacactgtaacttgcatgtaactacagtgtaacttttatgtaagtttcatgtaattttgaatggttagatctattacaagatttgttctggtgaggaagaaaaaaatcacagcacacacatgtgtgaaaggatttgttcccacgacctctattttatcgaaataacatgttactgagagatttttgaaagttatatacaagttacatgtaagttacagtgtaattacactacgaatgtactgtaattacatcagttaattttttggaggaaaatttatcaataaatatatagcaaattcgtaaaagtaaatgttaaagtttgattactctaggtttcctgctgacttaggaaaaaggtattagcaaacaatacgagttaggagtacaaaaggctaggcaattgattttttttatataaaaagtagtctagtttgattttgctttagttatactactaaattccaataatggggggaaatgggtggttcaaacgtggcaatgcaaactggctgtggctgaggcaatggataatcctatgatcctatcccttaccatcttctaacctagaagtgcacttggagttgcccaggtaatgaaaaacatgcaacacgtttcttatggaaattttccccttggcaaaattttgacatgatccgatagcttaattttcaacaaacaagcgtctttttcattgttcatttgtaagaagagattatgggtgtgtttgagaaggagtggattgagaagattgggaagatacgtaaaacgaggtgagccattaacacatgattaattgagtattaattattttaaacttcaaaaatggattaatatgattatttaaagcaacttttctatagaaattttttataaaaaacacaccgtttagtagttcagaaaacgtgcgcgcgaaaaacaaaactatctttctctctttctcctgcgctcaaacgcagcctatgtcgttgacatatcttccagctctactacgtagaacgaatttactgcttgtgttagtcgttaaaaaaaatttactgtttgtgtttgagtcttaaaaaaaagaatttactgcttgtgctattttttcttctttctttgtcgcgccgatcgtctttagttttcactacccgcacatgctgcgccacgatatagcggctatagctagcgtggctgcgtgaggccggctcgcgcactcgtgcggttgcacgtgccgcgccgcgcggtgccctgtcgcgctaacgccgtgcgcgcgcgtgcgtgcgctagctgcgccgccgccgtggagtggaagcggaataccagcctccgcgcccgcgggttttccactttttttccccttccgcgctgcgtccgtccaaagcccatgacgcgcgcgcggggccgcgacgcgacgcgatgcgttgcgcgcagccgcgccgggccgggcgcgcgttgatcga

SEQ ID NO: 56311 - DNA, 620 bp, Oryza sativa
gcaactgccatcgccaaacctctcctgctgtcggggcacgccgctggccagcgctgacgctcctctgcgcgccactggtcgcgtccactctgcccttgccctcccgccgtcgctgtcggacatcgcctgcccaccgttgtcgctaaaatgtgggatagagggagaagcgattagagatagaagtgaaggaggggatagagaggagagatatgagagctgacatttaggcctgagggcatttttgatatttcacatgatttatctctcctcttcaaccagaaattattactttaatacgtgcggtgtccaccagcaaatatcaaatttttaggagtattttttccccaaaagtcacttcgtgcgtatcctagagctaaaaccgttaagtcacgatgtcctgtagtaaaatttctctattctaaaaatgtttataatgtaagacggagaaagtagcaaagatgtttaggtgtgtttgatttgggtacacactgggagtgggagtccgggagtctggacccgtgagcccctcaaaccaaacgcctccaaaatatctgtttcatcccaattggcattttctcccacaaatcaaacacagggagtttcaatttacatcaggacca

SEQ ID NO: 56312 - DNA, 1501 bp, Oryza sativa
cctacacaattcgaatgtgtgggccacaaggaatagaagagaaagcaaaaccaaagcaagtgcagggccaggaatgctgatgggcaatcgatcgctatagggatggggtagcaatagatctactcccctctctctccctccacccctccacatggtttcttttttttttggcaccgcattactttcctattttagtaaatttatacacctcaagtttacacatataaagtttagagaccaaaagtttataagtcaaaagtttatatatccgattcaaatttgaatttgaattcaaatatttttttatatatagtatttctatacatctaaagtttatacacctaaagtttattgacctaaagtttataagtcaaaagtttacatacccgtttcaaatttgaatttgaattatatcctattcaaatttgaatttgaattatatcctattcaaatttgaatttgaattcaaatattatatatatagtatttctatacatctaaaatttatacacctacagtttatggacccaaagtttataaattaaaagtttacatacccgattcaaatttgaattcaaatattttctatatatagtatttctatacatctaaaaggtgtattatacacctaaagtttatagacccaaagtttataagtcaaaagtttacgtacccgattcaaatttaaatttgaattcaatttttttatatatagtatttctatatataaatttttctaaccttttatttttttaaaaaaaattgtgtggtgtataagagaagaaggggaggaggaaggagggagaagagggaggagtatagggggagggggaaggggagccgaactgattacccagcgcgatcactgacgatcgatcgcccattagaaggcccgtgcagggcggttaagatcgttcgagtgtccaatcaaagagttggatatttaatcaggcatgctgcatgcactcctacaggttgagtaacgtccaaggttaaccacaaaaaggcgagatctcgcttttgtatagtaatggaaaaaaggcaatttgcataggttgctcgtgccaaacaaaaactgtctttactcaacaaatcaaagctacaaacacgaacgaaatcaacataaagttgggacaaagtcccccgtattcacacaaaagtaaaaatgcaggtcctgttttaaccacacaaatacagtaaaaaaaatggtcgtgtttgttttacctatgtaactacgctactgctctgattattacaaccatccaccgcgtctgtagcactcccattcacatcgctacagctactccccaaccccacagacccgttggcgatgctcccgccatctctgtggccgccggtgcggctgctgctgctgctgctgtagaagcacaccaccttgcacttcaccacgccggcgcaggcgacgtacacgtggaaccccggcgccaccatcatcttcacgcttgccggctccagcttcccggcgcgcccggcggccgcg

SEQ ID NO: 56313 - DNA, 456 bp, Oryza sativa
tggggaatcaggggttttctctctttattcaacaatgatgagagagagaaagagagtgagtgtgtgtcctgctttttttaatatatatatatatatatatatatatatatatatatatatatatatatatatatatatatatatatatatatatatgaaagttgttttaaaaaattatattaatttatttattaaaatttaaataattaatactttttctctccatttaatattataagtcgtttgtcagtggccacgctgatatgtgggtctcatgctgactcatccgccacgtcagataaaaccggggtcaaaaccaccgaatgatctaaagtgaacggttttattagttgagggacacccggtatttctgtggttaggggacgattttgtaactcgatgataagttgagggaccttcagtatactttttcctttattctcttctcaaaccagt

SEQ ID NO: 56314 - DNA, 505 bp, Oryza sativa
gtctccgcggccggacgcgagggagatagtaatagagaagtgggtgggccttatgggctttcgattacatgggcctctttgaggcccatgtagttggggctccgtcgtaattgtgggccattacggttggcccggagtgggattccctcctcctcctccttgcggcccatatgtttgggctgcacagcgtacactggtgtgtacactggtttgagaagagaataaaggaaaaagtatactgaaggtccctcaacttatcatcgagttacaaaatcgtcccctaaccacagaaataccgggtgtccctcaactaataaaaccgttcactttagatcattcggtggttttgaccccggttttatctgacgtggcggatgagtcagcatgagacccacatatcagcgtggccactgacaaacgacttataatattaaatggagagaaaaagtattaattatttaaattttaataaataaattaatataattttttaaaacaactttca

SEQ ID NO: 56315 - DNA, 1141 bp, Oryza sativa
gtgcatctctctcctctctctttctcctgtgcaagaaaaagatccaagctttgagcaccgcatcaatcgcttttgttattccagcgagtttttgggttctttgtgtgatttggatggaaggtgatcggaacctctatctctctctctctctcatcttgtttgttttgtgggcgactgttcttgccttcttggttggggatgatcagacattcagaccatcagatgaatcgatttctttgtagagcagttcttgatttatttatttattttgcgctaggtagtagatcggaggggttcatatgattcttggatcttttggttgatttgatttgatctttgttcttcacatggatgaagcgagttttgtgtgtgtttgagcctttgccctttgcttctctgtctgcggaagaaaatactcgtcttttccccttcacttgttcaattttttctcagttttggtggttagaaagaaaatctttgtttgcaaacttgattttctttttggaatgctcatctgcaacgagttgcggatttttttgttttcttgctgctctctgaagagcaagtgcggatcttgcattctcggtcggatctctgcgtttctttgcaaccatcgattccactgctttgcttcttgtaggtttctttggttcgatggaactcgctttatgcatgttctttcacttctgttcttgtgaatccttcgatgtgactcctgcggtttttttcaactatattattttgttttatgtgctgttgatttcccttccagtttactaattcctactgcattgtttaatctttacaggtgggcttcaggactggtggtgataactggctgttggtaaggtgagggttttactttcaaatgtcatctgcaacaatttcatgttgctcaccaattttgttggactgtgtgtgggctgtttcttggtgcttatggttgtgggattgagtctcctgggtttgcttccacttagacactagcagtataatgcacataaagttgggcaaataagtttaatcatgcacataagttgaatttgatgcacatttttcattactttgatgcacataagttgggcaaaattcaagtgactgtcaagtcatattctgttgcctattgaacctgcaggaaaca

SEQ ID NO: 56316 - DNA, 733 bp, Oryza sativa
cactcagacattaactataggtctcatgtaaatacatactatagcatgtaatgagctgggtgcacaagcagtacagtggtcataagccacaacttggttttacaaaacacaaaatagatgtactagtagtagtagtagtagtagttcatagttttccatccgttgcttcatacgatcaggttcttcagagattcctacttcctagtcatgacatttttacaaaagacataagcaagctaagacttccattcttgctcaggaacttcatggattagtcctacactgcccccaaaactcagccctcaccacctgcaaaaacaacaatatggcgaaatgagctcaacgtataaatattcttaaaaatataaatgcatatacattgacaataacatgttcttgagaactgatttgtgggaactaaaatgaacatcaaggcaaaggtactggagagtgtgggtactccaatagcataagttgaagaatgagcagtcccatttctagttactaccagaaaaagtgagagtcaaggattttattcgtagaaagaaaaaggtagtaaaattcacaacatcacgcagtaagaaattgaagtgaagtttacaagttcattcttgcaatatacccttgtgttgttgtggtgccaccagcaggtcaacttcccctgcagtcacacaagcatttttccttataagattttatgggggtgaaggaaagtgtttcatataggctgcaa

SEQ ID NO: 56317 - DNA, 351 bp, Oryza sativa
gaagggcgccgctcttcatattatggtatttttagcattagtcattatttgtgataaggcctttcaaaatgcatatctataaatctatgccttttttaactgtactgaggaaatatgctctcgtcttatcacaacaaaattccttcagtttttctcgagtttcttctgaaaagttctgtttgctaattcctttagttgccacaccaaaattactgataggctttattgtttcatacagggaggtctcgttcccgttctcgctctccccactatcgaggtcgtccacggtcaaggtagatgaataatgtccatatatcaatcctcaagccattcaccttgtactcatgaatc

SEQ ID NO: 56318 - DNA, 1501 bp, Oryza sativa
tttcttgtacacaaggaagctatagatgatgcagacggtgccccaggaaagaaaaatactactccagttcagtcgcgtgccaagccaaggagagaagacaacacttgcaaccaaaactatgaacaagcttaggcaaaagctgcattatattgcatatggcccttttgttcctacctccgacatatctagtgctgtagccttgtatgcgtcgtgtgtttgctgcttcgtgtttcgtgaggaagcactgctttgcttctgaacacagcttaatactgtaataattatttctttcaaacaacagcagctgcttaattagcttctcaatcagtgttaatgggtatacatcacaacagtatatttagatgtaaagcatagggtagctaacaaacaaaaaaaaagatgccactaataattactgatccgtaagcactagcatgacatatataatccgctgccatcaccggacgttttttaagcggttacacctaattaatcgatcaactgctacactagctaagacgacgacgacataagttcttccagttgtaaacccatccaatccagcaataaaaaaagagataaaaaatagaaccagacacgaaattagaggggtctgcacccggtctcgtttgatcgtctcacaatcacaatctctaaacattgtcctctctaaactaaactaatgcgcatacataggcagcaggtaggacacgtcgcagtccatcgatttgtattgataggaaatttgttaagacgggttaacaagattccctaaaccaatgaactaatccactcctaacctccaaattgcgtgacaaaaccatacaaaaacaagagccatgttgtatgcacgcatggagctagatgttgttgctaatggcaagcaaaaaccagcagccaagccatatatacatgtatggttcgagtcatgacatagacggaagttaaactagtatattatctagggatccaatcaatttcaattgaattgtagaagtagtggttaggatgagagaggaggagtatcatgttgagagaaacagtaggggacccttaaatttcctcttcttcctcctcaggtatatggtcccatgtcaaatgtgtctgtgtcatggcatggccacctcatcatttgttttagtcctccatctacagctgatgattctctactactctaatcctccatcagtcaccattgtatctagctcagctactcatcaccacacacgcacagtagcttagcacatcacacacttaagttaactacgtaccagtactaattagcactgtgccactgctagtattagtccgttctgttgtcatctactactcttgtttgtgtttccacacacttcaccgggtctctttcaagaagagaggcttcttgaggagctagctttcatggcgagttcttcttgatgatgctttcatggatggatggatggataatctcaggctagaggatagaggtaggtagcgtgtgtttgtgtgacagagaaag

SEQ ID NO: 56319 - DNA, 1501 bp, Oryza sativa
aaccactactaccacattactgttctaggacggaggtaatacattcaggcatattatgtgcagcatcagcatcaagctcaagctattccttgatgctaccaaggcaactttacttgctcaaattttcatatacagatttcttttaagtctagttatctagcacttgggtcaagctaaaatgctagtattgcaaaacaaaaatacaagagagtagctatatttatggcgccatatttttcactaaaaaatagtcggtatgtttttatattgtaagtctctaaattacatatgtaattttattgtatagagtatgtaagtcccaaaattatatatgtaagtgtctaaattacatatgtaatttcagtgtatttaggatgtaagtacaaaaattacatatgtaagtgtctaaattacatatataattttaatatgtttaggatgtaatcacgataaaaagaagagggaagctcacaaatcacatgtccgtttggagaaaagaaagaagctagcaaagtagaaaataattactcacaaaatcacatgtccctttgagtattaataacaaagtaatcaagtcatcaagtcatccttgatatacacctcgacaaaaatcggcaatcagcgtgggaagctaatcatgaaaatcatgaaaatcaagggagatcctaccgccaggaaaacgactgtttttttcttaaaaaaatatgtgccatatatatagcaataccgaaatacaatgataaatgatatacgtatgcatatgtgagcccaatctcagacctcagctaatccaactcatatatacggctgtcaagatctatctagctaccgactcatgcatgattaccaagctagtaaatatatactctcacatcagagcaaaatattttcagacaaggagagcagtttaccttatatccattatccacttcccgtaattaaacatcacatgagaaacatgctaattacacccaaaaaaaacaaccaagctagtactcgtcactacacagtttcagactagtgtttactgtgaccaccaggatttcttccttttccatcatcagaaaaacacccaaaaaagagagccaaaagtaagaacagcactactagtcactagccaagctaaactaagagagaatcagtttcttcatttcatgttgttccatctatctgaagattctgaaagttggtgtctgtctttggctacaagagagacgtggccaccatccacaagaagaagcagaagccattgatgaggttggaagcagacgaggtggccatgaggctggagctcgcctccggcttcctcccgtcccccacgccgccggccaccttgcacaccgtcacccccggcggcgcgtgcgccgcgtccaccgcggcattgctgtagcacaagcccgggttgtcccacgacgcgaacctcctccccatcctctggtagaacgccggcgagaactgcagcgtccccgtcaggttgttcccgttcaggtacagcgcgccg

SEQ ID NO: 56320 - DNA, 1501 bp, Oryza sativa
catggcatcagcactaatccgcagctccgttttatgtgtgtgtgaaagattagttcccaacacacatgaacacaaccttaatatgtactactaccagagaatatcattgtaagttcaaaatcaacttatacaacttgtaacaaaatattaaaataaattttgtaaccagtaaaaaaattataaattgatttttttcttaaatatttagttgacatgtaataaacgggtagccgttcactcaaatgataaaaaaaaaaatttctcatactagaggcagttcaagaaccatagcataattacgcgtttaggggttgtttagttcatggtcacatgctaccatactttgctatacgtcaacaacttaggcagctttgattgagttagtaacgtgtttggtttatgtcacatttgtgataagtttctttttctaacaccttgatcttacatgccattgtctcaaaaattgtgcaaggtactagtagtggctttgcttactaaagtgtggtgttaattttgttaacttaaccttaagctttggtaagcttggtaagaaaactatgataacaatagacaatgtcagtatacaagccaaacacccttttagtttggtttggagttttttatttgtcatatcaaaaaggaaaactggttgtgctaaaaccacatgaaagttttggcactaaaattttagcagcatagaatttgaagttttgaactaatcgtatgtaaaaaaataataacaaatcaaacacctaggagcatataatactgttaaaagttaacaaaattttgataaaacaaaaaatggcggcttcaatggaatcaattcgttactctcacttcgcatgaggaaacaggtttcagtcagccgagcagcaagcatatgatatggacagacattttggggctgtttagttcccaaaaacttttccaaaaacttcacatcgaatattttggacatagatgtgtattaaatatagataaaaaaactaattacacagtttgtatgtaaatcacgagacctatctttttagcctaattaatccatgactagccataaatactatagtaactcacatgtccaaaaactactttcaatatatggtgaaacgttcgatgtgacaccaaaatcttttatttcactaactagataggttctgttggggggcgtcccggcctgccggccggctctcatcagatggatggatggatgtgaataagatacgattgaaatgaaacgaaaatactcccagtagtgtacagtacgcttgtgctcagtgccagcagagagcagggtgtagtacaagcaagccataagtacacatcatcgggcagagcagtgagtgacagtgagtcgacgtctggcatgacttgcgccttgaacgttttcattcacactctcccgtccgtaacattgcacgtatggttgcattgcaaactgcagattttaaatgtacacgaaaaaaaactttcattttttccctctcatcaaatatttaga

SEQ ID NO: 56321 - DNA, 1501 bp, Oryza sativa
  unsure (1)..(1501): unsure at all n locations
cgggcgcggggggcgggatggaattaataccattgcgnnnnnnnnnnnnnnnnnnnncggtgttgatgttgtagaggatgccctcgtacctgatctcgctcttggatgtcaaactgatgaggctcccgatgtacgagtccggcgaggccgccgccccgccgccgctggagccggccgcggcggggggccccgcggaggaggaggtcgacgacgacggtggggcttccgccgccatggccgccgcgggcgcgggtgtgggcgagggccgggagctagggttagggatgcgatgcgatgcgaaagagggagaaacgaaaccctaagcggctgatccgtttgggatgtgcgctttggtttggatggtgttttagcctattaaacgggtcgtttgggttagtttgggaattggacaggacgtggcttccatcggaggcccatatgttgccgttttcttgctaccaatgcaagaagatgcctgatcaaatttacctctacttcgatttagtttagtcccttttaaatggcttagactttagagagcccaaattacaaaacaacgaatgaatagtttgctttttcatgatttaatggtaggccacaatgaaaaataatgcccccaactgataacctctctaaaactctatctgacagcttcccatgtagccaatattttttttctcaatcatttcttatcattattattattgttgttgttgttcgttatgatagtgatataaataataattactatttgttgccttcttttccttgatcctttatttgatatttgtttagatatataattgtgcaattactcgtgtttttaaattaaaatattaggttgaaacgtgcaagcccttataaatgtcatgtcttattcaatggactatctttttttccctgattacacggtaggtacacatacaacaccgccctcacgcactccgctaatgtgtcctctaacatatagaagagacagaaaccaataatacatggttgagtttactaaagttgtattgaaagctcgttctactgcctatcttttatgttgttatccttgcacattaaaatttcggaggatcaaccgtcgtgtgtccaaacttcctaggcagttttatcccacttcgattctccaaccaggatgaaatatatgtgcgcactcaaaacgagatagtaagtcattagcatatgattaattaaaattttatcatttagaacttgaaaaatgaatttatttgatttctcatagcaacttctatataaaaactgttcgtacaaaataaatcgtttggcagtttggttcattcagccattatgtttagcagtagattgattatcttgtcaagttgcagaaaatcccaggtacgtcgtcctacgtagcaagcagatggattatcttatccaatccagccacgcctcgtcactcgccacccacactgcgcaagcgcaacgcatatgccaaatcgccatccttgcgatgtgatgcgatgcgatgcagctc

SEQ ID NO: 56322 - DNA, 1501 bp, Oryza sativa
gccattttttgttttatcaaaattttgttaacttttaacagtattatatgctcctaggtgtttgatttgttattatttttttacatacgattagttcaaaacttcaaattctatgctgctaaaattttagtgccaaaactttcatgtggttttagcacaaccagttttcctttttgatatgacaaataaaaaactccaaaccaaactaaaagggtgtttggcttgtatactgacattgtctattgttatcatagttttcttaccaagcttaccaaagcttaaggttaagttaacaaaattaacaccacactttagtaagcaaagccactactagtaccttgcacaatttttgagacaatggcatgtaagatcaaggtgttagaaaaagaaacttatcacaaatgtgacataaaccaaacacgttactaactcaatcaaagctgcctaagttgttgacgtatagcaaagtatggtagcatgtgaccatgaactaaacaacccctaaacgcgtaattatgctatggttcttgaactgcctctagtatgagaaatttttttttttatcatttgagtgaacggctacccgtttattacatgtcaactaaatatttaagaaaaaaatcaatttataatttttttactggttacaaaatttattttaatattttgttacaagttgtataagttgattttgaacttacaatgatattctctggtagtagtacatattaaggttgtgttcatgtgtgttgggaactaatctttcacacacacataaaacggagctgcggattagtgctgatgccatggttttgtagcggcagacgccagtccaaagcaatccttgctggactggttgatgaacggacactgcagtttctgatgccaaaattccaacacactttactgccacttttgttgcaaaggaacggagtttgttttacaagagaaaagcaaagcaacaaaattttagctggcttataaagtggaaatgcaaaatctgtgtgccaagcaaatgctcctccacgtgagcgatgataatgaacggactataatttccgaatgaaagggcccatcttttaacttaggcttatatttatcagccaaaatttaaaatttaacataaaatctgaagctaattttgaggtttttaatcgaagtttattttccagtcgtcgtttttagattgctaaaaatatgtatatgataattttatccgcaaattacttacggctccgggagaaaacattgtgagagatgaaaataaaacaaaaatgcagggggttgtttgtaatttggtattgtaactcctcgcgtggcgtgcttgaggctgtccgcgctctccgccttggtctcctctcctctcctcgctttccattccattcaaccatctcaatcaatctcaatcccaatcccaatcaatccctctctccatctggtgctctctatctgaggaatccgaatccgatcaggggaggcgaggcgcggcggtgatcggcga

SEQ ID NO: 56323 - DNA, 1501 bp, Oryza sativa
aagagagagaggggagggcagcagaaggggagcggcgaagccctgctggttcgctcacttcatcacaggtttgctctcatacctcttttgcatttgtactaatatgttatgtttgagtactatatgttgcgttttagttttagttccatatattttagcagatctgtagcacacagcacatatgtgtagatccagagcacataatataatagtatgaattgagacatagacaatagtgttaattgtaagatgtagtttagtttgatctggagaatgtaaccgaccatacagttcattcatgcttggatggagtacgaacgtcgggtggaaattgcaagcttagactggaggaacaatccattagggttacctaaatggtccgagcgtccaaagtgtgggtgcagagatcgctgccaggtggctacctcctttgcagaacaaacatttggaaggagatattttgtctgccacaatgtagacaacgatttcgttatatgtctaaccgtttccaaaatccgctatgatttgcacaaaatttctacccaaactgaataacattactatttttttcagggcaatccaacgatgtgtggatttactcgatggatcgacaatgtcactccatcatatcatggccaaaatataacagagtcagaaacacaagtagagtatcaacgattgaaggaccacgagaatacaatgcatattgaccgacctagaaggggccgataggttaccgcaggctagatttgtcgggatcaataaatttgtaccgtgtattgatggcacttcttatctatcttatcattacaatgtttaattatggtggtgaatttttgtatgcgtaagactaaaaaaataataaaattgtattttaccaatctgggagattttaatcttgtatagttttcaatataaaagatttgataacaattttctatttataaaaatatctatttctcaaataaaacacaatgtaaaatcgccctcccctagggtggcaagggggccgtctgcaaaattccaggccccccgccgcccatttgcaggcggccccccgcacagtgtaaaatcgccctcccccagggcggcaagggggccgcctgcaaatttcattgacggccgtcgcccgagagcaaacggccgtctgccacgtcacattcgccgccctctgggagggcgatttttaaaaatagccctcccagagagcggcgggcgactacttttgtcaatttttgaaatagaaaattatttttgtaaaacttttaataaaaaaattaaaaaaaaaattctaataggagaatagaaggccccacatatggtagtagaatcgaagcccaatacggcatcttgtttgttgctttaactaagaaggctgacacgccgcttcacctctccacgtctccacgccgtcgtcgtcgacctcaccggcggctgcctccctacccccacctactccggcggcggcgcggcggagaagcacatcacatcatggctcctc

SEQ ID NO: 56324 - DNA, 1501 bp, Oryza sativa
ctagttgctactagagcaacttttctcactatggttgcaccagaaagcttctgcttccttcttcgtcagagaatcagtcagtccttaagatatttcttttgattcatagtctcatcagttgtacaagacctaattataagccaaaacagcttaataacggtaaaaaaataatttatagataaaaaattatatctatgttcatatagactaaaaagataacgatggaaaaaaacacgatgaaaatattgtaaaattaattccaaaattaaaaaaaataaaaattcaaattttagcggccgatttttttaaagacaaatgagactgtcccagatgaaaactgaacctgtaacactactttaaagtgtgaattaggtggtgttcttttcttctgaagataaagatgaagtttaattttttttacacaaaatgaggtgttattaatgtatgattgattaaattttaattactacaaacttgaaaaatagattaatatgatattttagagcaacttttatatagaaagttttcacacgaaacacactgtttagcagtttgaaaagcgtggcatgaaaatctatatctcatccaactatttgatggtgttgttgtaatttgtaactagcgatacggtgagaatgaaggtactgatacagaaagtttattagatatggtatggaggtgctactcctaataaaacacaaatacgaaggggtggaactggaaaagtagagaatttcacacgtcaagcattctacacaacgctagtgtactgactttttcaaacccccccagcatggcactggcagaccagacactgcgcaatagtagtagcacactagcatgtactactacactcctaatctctctctctttctcgagtggaatccattgatccattgtgtagtgggagagagacttctctacgcggtcacgggttccccagcggaggagaaagatagatagagagagcaaagagcaaaaaaatctctcttttttcttcttgttgtttctgcagttacctttgtcttgccttcaatgccaccgctttactgccggatctgaggaaagctcccatccttgctgagttcttgtgctgcttcttccacaattcttccttttgttgagaattttgccttccatctgcttaatcggtgacaaaggtggtgggatcttgcttctcttcctgcaagaaaaggctcgtttttttgtttcgccgtttgctgcttgctcaggcaggaggaaggcgatgctgttcttgctgatttcagtcttcttcttccggtggtcgaggtgaggtttgttgctacttcaccttcgcttcgttgcgctctgcggagagaaagaaagcaaaggtggtggaaaagaagcgaaaattttgcttgcttcctctgcaaatctgaggaattttctcgcagaaagcctgaattccctctgaattccggtgcatggaaagatcgtcccctccatttccaagaagaagaagatactagtagcagctgca

SEQ ID NO: 56325 - DNA, 365 bp, Oryza sativa
taatatccttttcatagggcagcaggcatcaaatcaatggctcgaatgggaggcctgtatacgatcatgggccaggaattatagtcggaatagcatttagctgtccatggtctctggacctggaatagcatgatagttggacatgcccaaataaaacggagataaaatttaggacacttatggcaggctttttaacctgatacacggtgtgtttggtgtaaaaactttctatatgagagttggtgtaaaatgttatattaattcatgttgcaagtttgtaataaataaaaatgaggtggtcacacgttttgtcttataggttgggcgtacagcatatcctttttattttcatgttcattttcagg

SEQ ID NO: 56326 - DNA, 1501 bp, Oryza sativa
tagctgtccatggtctctggacctggaatagcatgatagttggacatgcccaaataaaacggagataaaatttaggacacttatggcaggctttttaacctgatacacggtgtgtttggtgtaaaaactttctatatgagagttggtgtaaaatgttatattaattcatgttgcaagtttgtaataaataaaaatgaggtggtcacacgttttgtcttataggttgggcgtacagcatatcctttttattttcatgttcattttcaggagattcagacaccatcaaagactagtgcccatgttcctccgcatagtgtaagcgggccttctctcagggcgggaagggggcagcctgcaaaattccaggccccccgccgcctatttgcaggcggccccccgcacagtgtaaaatcgccctcccccagggcggcaagggagccgcctgcaaatttccatgcccccctcgccgcccatttgcaggcggccccccgcacagtgtaaaatcgccctagcggagggcggcaagggggccgcctgcaaatttcattgagagcgaacggccgtctgccacgtcacatttgccgctctctgggagggcgatttttaaaaatagccctcccagagggcggcgccctcccagagagaatagccctcccagagggcggcgccctcccagagagcggcgggcgactacttctgtcaaattttgaaatagaaaattatttttgtaaaacttttaataaaaaaaattaaaaataaaaaaattcctcctattagagaccggcctgtcatattatgggcccttctaatatccttttcattagcccacaggcctcaaatccatggcctcaatgggaggcccgtatacgatcatgggccagtaattttagttcgattcgcattttgctgtccatggtccctggacctggactagcctgatatttggacatgaccaaataaaacggagataaaattttggatacttatggcacgctttttaaactgctacacggtgtgtttcgtgtaaaaactttttatatgaaagttgctctaaaatgtcagattaattcatttttcaagtttgtaataattaaaactcaagtaatcacacgttattaccatctcgttttgcgtaaaacacttaatttttattttcatcttcattttcaggagattcaaacaccatcaaagactagtgaccttttttttcctcttcttaattgcggccattttctctgatccgaaatatttctaaaaacatgaccctataaatcaacaaaaaaacaaaatcataattcaattaggactccatccaaaataataattgtgaactcttttaaaaatatataaaaaatccacatattattctgtgcacctcctccccgccccggcgatcggtgcatccccaagccccccgaaatattcatgcaaacaagaccctataatcaacaaaatacagaatcataatttgattaggaatccatccaaaataataacaggg

SEQ ID NO: 56327 - DNA, 342 bp, Oryza sativa
agtactatttctcttgattctgtctctcttctctcctggaatccaatccagcacaaccatcaccaacaagctttaagctaagctagatatatagcctagctggcctagatataacacgtacgcgtagtgtagtatatctgagaatataatgcgttgtctcgcaacacctgcaaagatagagagagagagagattattattccattccatcccatcagatcagctagctgctatataacaacctccatggctccccctgcacagcacagcacacaacaatataattaattagcagctgcatgcgtattgctcgttaattaagttgatcatatagaattaacca

SEQ ID NO: 56328 - DNA, 1003 bp, Oryza sativa
  unsure (1)..(1003): unsure at all n locations
gcgtcaaacattttgggatggaggtagtatatcagtaatttggatcatattataagactttctagcattacccacattcatatagatgttacccactttctagattcattaacatttatataaatgtggacaatgttagaaagtcttataacctgaaacggaggtagtaattatttgctctcacgatcttattggtctgttttagttttccccttctctttcaatgcatgcaagataaccttttcttctaaaaggctcaaatcaaaggccatgagccttttccttttcaattagctagtgcgagtttctttctttgatctctttgtctctctaagatattatactttttgcaatcaattaactcttgaggcagaaacaataatgggggtacggtttcataccatctttaatttctatcctgatcgatcatgtctgtgtgttgtgttttgcctgccaattcccggccccgtacgttacaaactcctaaaattaaagaccatcgcgtaaaacataatctgcagggatatattgatcatatatataactgttattattactggctatatattgtacatatatgctcgaatagagcatgaacatcaaatcctaagggaatctgggcagtattttctatctttgtcgggcagaactaaanatatatatattggacttccaattattatatttcaaaatgctctcgtccatcgagaatgaaccatgcacattaacaaagtaactattccatcgatcaatagcctagctagcttgcgtgttaattctcgaatatatgctctgcatgagtagtgaagatatatacccatatggcatcttgttgattttctctctttactacctgatgatcttgtttcccggtactatatatatacatgcccttacttttatgtttttgtatcatatatatcagtactaggatagtcatgtacacattaataattattgagataaaatgtgtgatagtaactgagtttgcattatttacaga

SEQ ID NO: 56329 - DNA, 1501 bp, Oryza sativa
ctcttcccccgccgccaccgccgccgccgccgcctctagattaaagcagagctacagccaggaggggcgcgcgccgccatggggcttggcaacgtcgccatcctcgtcggctccggtgagtccccctcccccccccttccgccgtctgctccctcctcctgaggtccacccgcgcacgcgcagccctagcttctcgtcgcccagccggttgactttcgagttcgagattgatactagatagatagatagatgctacttgcaaccatggcgcaggcgccaaaccaatcccactgccaaatcccatcttcttttttttttttgagaaatcccatcttcttgtattatttgctttagcagattccaatacatagattgatttagccttttagggccgggtttgtttagttcaactaagctttctcttcaaaccaggtggtttcataggaacttattaggtatcccactgctacatctgtcaaatccccccaacttattgcccatctaatatcatagggtgtatatacttaccggcttccccagtacataggcccttccactaaagaactaagtactagttttactcggtaccaatgtttatgctgtttgctgccctgcaggaattcttggatcagttcttgtaggtggtgatgcaaactccctagtgctggcgaggtactttctggtgctgccaaggtatggtaccttattgcccccatgccctaactatcaacccaaaatactactgctatatatgttataactcaccgtcacatgattcttttccccctcttagtttgtcaagaagcatggaaacgaagggaaagatacatcgtctaacaccgatgcacacaccgctcagctattatctcaggtcaaccatctcagacaggagatacaatctctaggctcaaggcctgttacagttgtcaccaatgctgctagatcaggtaagttcctgctgactagttactatgttttagttattgacttatgcgtgagacacagatcatacaaacataaattttcacatgacactatactttgtatacgccccaatgtcgacatctttgctaagaattaatgcgattttagagtgttagatatttctattaccttttgatttttttcagacttggtctgttgtttttatatctacatgttcgacagagctacaattgcattgtctgttcatatatagagtataccattttgcgattcagatgttcacatgttcttttctttttctttccttattattatttgtcatggtcttggctgggatactatgcactgctgattatcattatgttgttcactgcattataaaggttcttggacatgtgaaagtttttatagttattgctaataaactttcatcatgctcttttgcctttaaacatacacaattacatatggttacacacattctttctcaaatttccttaaacgacattcatgtaaatcctttttctgtaggacctggtacatttactataacagt

SEQ ID NO: 56330 - DNA, 1501 bp, Oryza sativa
attttcaggtcccagcagcatccgttcctccagctattggatcttcagagctagttgttaggagggtaaaggcttgcacctttcccagctttgtcatggtcgggacatgccccagtttgttgactttggtacctgtgtttccggttgcaggtttcttcgttgcctcaatctactgctcttccagttctgccgacaaccacacctgcagctgaaccatcacctagggcagaggcaccacaggtgtggtttcagtttgatgttgcactttgttgtttgcaatttcagtttcctcttgcgctttccatgattgaaacgagctgttgctggacttttgcaggaggaacagtggggttttgtgagcagaacatcatcttgtagggaaggatcaggtcgttttcaggagcagcggagtgttgtgaccagaacgtcgtctattagggaaggatctcctgaatcttcaaatggagcctcatcctcaactggagcaagcacaggaacgaacacaagcacgagcagatttggtgggctgaggctgcctggacttgggtttcttgcaagttcgacgagatagttgatgaggtgtttttatttaagttaaaagatggtgctgccaggagctctccattgctttacttgtagttttaggttgtactagtaggagagaagagataacactagcagtgatgtgatggaacaacacatatgcgtgcggggctgggctcctttgttcttgaggaggccaaatttttgtagaaaaaaaagagaggaaaacatgtgctcctatctatctatctatctatctatctatagctatgaatgcatcatccagggcaacaccttggtctttgatgtcgtgatttttaacttgaagtgccaagattactagtacttggttaattaaatttatgacgaggagtcaactggttggttgcctttgttactagtatcttgtatgacatgttgatatttcatccatcttaggaccatgatttgtttcggatttcttgattttgtttgggatttctgttaagatcccgctaccgtatctcgtatgatatatatgatttgtttgggatttctgttaagactagcaaaaaaaatacccgtgcgttacaatggacgagagaattttaattttacatgtgtgcatcccttgtaaaatgctttctttttcttccaaaaggccataaataaatttagatgatttattcagtcgaagttgtgaaggaagtgttctgcatatggttcatagtttggtggtcggatttaattctttggcgttgtgatactttatgctctggtaatttggtttgtttgaaggagctctccgaaatgagcttagtcaagtcacattatctactggtctccatctattagctaattgaccaccttctcacacatatcatcgtcaaaccattatacttgttcagaaataatactcgagatgtacccatctctattaaagaaagcatttcacattgtaagatgaagaagaacaatg

SEQ ID NO: 56331 - DNA, 1501 bp, Oryza sativa
tcgccggagatgaaaagccatcgattcaaggcaattcaaggctagggttcgtcaggtggaaggaagtcaggaaccgatcgatgccgtggctggaggaagacgacgcttccgacaggtgggcccggagcgcgtccacgcacgcagacgtaggctggtccaaagcaaggggaggagagaaccatatgggctagaagtggagaagaatagcaggccgagctgaattggaaagaattgggccgccctggatttagaagggaaagagaggaggggacctgggctagcagtgttgggcttaaaaaaaggttggagaggaagggagtgagcgactgggccggaactgggccggggacatggaaaagggatggagtgaagttcaacatgaatagtttcctctgataacttttcagggagaggatttttagatgagaatgaatattttgtatcgttttgaattcaaattttggcatatcggtagcgcgagcagtgccatctaaaccggaaaccaaaatatgtacgtgattagcactatatttagtgaagattagcgtgattagttatattttttttcttttcctgagtaattagtttgtatctacgagcctgttcagattggtgccaaaataaaccttaccaaaatttggcaatgccaaaattttggcaattttacaacgttgccaaaattttggtagaattggtttcataatgttgccaaaactctatacacattgccaatatttgataacaaactaaacgtagccacataatcaccaatttaccaaataatggtatggttaaaaatgtcatcaatctgaacaggccctacatacagttgcattttttaaaaacttctcgtatataattttaaggctttcaattaaaaagtaaaaacacaacccaaaaattctaaactttatatcccaaatcataaactttcaacaccaatttaaagacttccaactcaaattagtaaacttttaactcagattaaaaactttcaagtcaagatttgaaaactttcaaatcaagtttaaaatgttcaactcaaaattaagaaacttccaactcaaatttgaaaacttttgatacaaattttgaaactttcaactcaaactttaaaaaacttctcgacaaatttaaaaaatttaaatttcaagtcaagatttgaaatttcgaactcctaaagttcgactttcgactgatttttaaaaactttcaccttgatgtttatttattattttttatttaaaaaattattttatactatcgttaatgctaaacgttattagctcacattattcgggacgtgtgcgaagggaggattgcgcgccagctcagctcctagcgtagacgcgctgattagtagccctctacaatacctaaaaaggttattaaattggttaactttgatatatctggtcacaaaaaatataaacgttaaaagggtgtttctataaatattttttaactattaattcgtaccacatgtataagaaattagtga

SEQ ID NO: 56332 - DNA, 1501 bp, Oryza sativa
tctagcctttctgtttgtattgcatcatgcattttgcatatctgcaagtcgatctggaagctagttctcctccacatatgcatgcatgctttgcttctctggcctggccaccacacctttcaagacaaatctatggatatgtactatctttttttcttattttttttaatctaagcattttgagaagtttcaaaagttatcgatctcagaatttttaaaagcttaaccaaacattgtatgagttttggaatcggaaatataccgaacacaccgcgaattgtagaataggtatggtgaaaaattaatgagagatgaagcttgtaaaacgttaggccagctataagttttgccatgccagatcagctacagtaccatctgattctatcgtaacaatagaatctacattgtaccctagagtatgtaatttaattgtgcacaacaatattagtagctatagggcctgtttgggggagcttctagctgcatcaacttctcccagaatcaaaagctctcaaaatagttcagctgttggtccagattctaaaaagctatagttatagaatttataaaagaactaaaagccagaagctaggtaaccagcttttccaaactctcagagcctggttaccaaacagctgttcttaactctgccaaacatgcccatagttagcttcattattttactgctagcttcatttattttggacggggttagtacatatgtatctgtctcgaaatcgcctctgtaaatggggtcagtttcagcacttctatcgacatgaagaagatagaaagggccatgcgagagagagtgtgtgagaaagagaagattctaccgggcacaacaaagtgtgtaaatgcataaagaaaagattctactgggcacatcatagtaaggctattctcagctcaataactaggatggtgtccatagcattaaataagctgctacctaatatgaaaaatgatgtggcaagtgagtaaatgaggaaagagaagaaaacaaggtcttgcatgagacatggtttctacacaacattgaagacatcatgtgagataaatttaatttaagcatgaaaaagtggtgtttgtattgaaaaagtagtgtctaatactagtttattgatgatgtgaagtttatgaaaactaccgtgtagtgtcttgggttggtactgcctaaaggggccggctagctatataaactgtacagatgcagagaagcttgcacaactagtgcatccctgtcactgtttggctagcttaaccttcctgacatctatcctctggattgaacggcaggagatacctaagctagctagcaatctctatcgatctgtttgtttacatgttcagttaaaggttactgagaaatgcctagagtttttccggctagcttcataagttagtgggttagctgacctagattcaaagtctaatccttttatttatttgatattagatatcctaacgtttttagttagaggttattaatttgacatgg

SEQ ID NO: 56333 - DNA, 1501 bp, Oryza sativa
aacccgtgaaaacaatagcaaaagtaaaaaggcaaaagaatctaaataaattgacctaactccataaacatcataatagactaaaactcaattttgtttagaacaaatcctaaacatacttaggcgttcgttacttgaaggttgggaacccatctccccgcacgaaaaacggagcagtccattagcacgtgattaattaagtattagctatttttttaaaaaaatagattattttgattttttaaaacaactttcttatataaacttttaaaaaaaacgaaccgtttgacaatttaaaaagcgtgcacgcagaaaatgagaaaaatgggttgggaagtgaagttccgaacacacacaacaacgaaaaactacctatccccttcccctcctcgtcaacaaggacgctagagaaggggaaggaccgaaggagggaggctaggatggcgcccatactccagttgattgaaagcacctaatctacaaatagtccaaaacagacgatattctaaaactgatcctaaactccaaacttgtcgtggtcccgagttcatgacatctcagatgatgataatttttttttcattactctgaaatttctttcaattttggatgtctatttctaactgaaaaatgtgcacatgacgtaattaaaatgtggccacgccagcctagtgggctgacatccaagtctacatggcacatcttcagagccttatctccaagaaattcagaagtacgagggctgtgagagtgacttgtttgcaaccaagcctaagcccctgctaatgctgaactaacacaagaacaagaacataataggaggctagctaggccaacaaacaattttgtttcatttgtgagtctacctaacctagatcgccaccgcctccaaaaccataggatgattggcttagctagttaggcaggggattaattaattaattaattaatatttgttggaccaaccgaacatgcactcaaaatttgtggaggaaaaagaaaactattgccaacattatgcaagaagagaattctctggttgtgctatcaaactcgaagaagtggctgaatattttacaacagattaaatagtggaggggcagagcatgataatggataatttaaaaacacaaatttggtagccacacttaatacaaggtgagcccgttcatgacctacaaaatattgaagtgtttttttttccttttgtttcgttatatcaacatatatactctagagcttcaattaaataaaaatcacatggcagtctcatatcagatagaacaattgacccagtcttttgggttgtatgcttacaacttttatgacagctttagttaaaccagcttgtacaacatgccctgtttgaactaggctaaagaaacaccacccattagggatggtgggctagtttagaggaatggcaaggtggttaggaagcattacctaatggttaatcacttaaggttactaaccgtttaatagtactatttaacctata

SEQ ID NO: 56334 - DNA, 1501 bp, Oryza sativa
atgctggcgacggcgaagaaggcggcgccgaagctggagacggcgttcagctgcccgttctgcgaccacggcggcgcggtggagtgcagcatcgacatcaagcacatgatcgccgaggcctcctgcttcgtctgccaggcgcgctactccaccaccgcccacgcgctcaccgagcccatcgacgtctacagcgagtggatcgaccagtgcgagctcgccaaagccgccgccgccgccggcgacgacgacgacgacgaccaccaccaccaccaccgcaagaccaagcgccgcagctaagctaacttagctgacggcggcagaagagctagcagagatgtaaccgtgctgcaattgatttgtcggacaattttctctggctcgaatacagtaattattgtgttgtaacttggttttaccattgtaatcgctgtggatttgaataaaattcagtttgttgggatttgttgttcatctccggttccctgaacgtgtattaggagaagcacttgagtacgcatttgatgtaaacggaaaaaaagaagataatagttgtatgtgtgcaactagaaaaaataattatatactcccttcgttcctatcccaagccaaatttattcaagttattaaaccaaagattttcaaaaaaaaatatattaacatatagaacaccagattactttcattaaatctacgaccgaataatatatatatttataacttgaaaagatgcccgtgtgttgtaacgggtgaatgctattataatttttttattattgttatacggtttggctagggtgaaatccactgtgggaattcgcttagatattttttttctagaaaatcatgagctgcaattaggagttcaacattcatctcaagttagcatgcaagttttttaaaagggatttcttatatgacttcttttgtattttcaaaaggaaacgaacttaaaatccgactaaaatacgaatttgtattttcaaaagcgaacgaatttaaaatcagctcaaatacgaacgacgtaccaaaataccgcaaaaacaactttaatttttataatagtagagatatatctgttttgtactacaagagttgctacatttttttttgaacttgttgctacattgattaaacttgattgagaacaaaacgaaaacgttttataatacgcaacagaaggatcacgtacaattccagtttcaaataaaattcgaacgaaattctaggcccatttcgaattacagccctccaaaatttgccggtgaaatcatcttgggctgaatcttagtgggctaccagttgggctcaacacagcccctctctctctctctaccaactcaaaacaaaaaggaggagaagcagcaaacgcggccgcacccagcgtccaccaccaccccttccccctcctcgtctccccccggctccgatccggcgcgcctcgccgtcaacccacgcggcggcgcggcggcgagttcgccgaagccatgccgagctcgccgaa

SEQ ID NO: 56335 - DNA, 1501 bp, Oryza sativa
ctatatttttttatttctttttaactatataaatcatgcgcataattttgggatagtagatgcagactcatgctgttgctgacaatgctgcttgacctgctagcagtttcccaatcctggaaaagaggaggaagaaaggtagggtgacgtctaattgacacaaaggatcaagggaggtgatgatcagtgctgtttagctggatgatgctgaaatgaagcaactatcttagctagactagctttctgtttcatcacaggcaaataactttttggctactgatatgaataatgactatctgacaatcataatgcgtttgtggaatcatgcagcatgtagatgagagcgagggtgctgttttggatgatagagttggattacctaacaaagttcttgataaatactaaaaagctttttcagcagttacaggcaagtcaataacaccatgcatgacagattgacagttatgaatagcaaccactcctgcaagtacacaattcaatgttcaggaagactaatgctggtagtagtaaataaggagaagtgtttcttcagatcccaaattaaatctttttcagttctcaaacagtaatggcatgaatttctctactgagaagcaaaagcagacatcatgtagacatgtagtgacatccagaatgcatggatacttcatcagagtcgacagcctcaggttgcattagtactcctacttaatttactaatcactcacttccaagttcgacaaaaaatgaaaattgttctgcaggcattagtatatttgtacttgccaaataatcaatccaaaaggctattccaagtgttaaaataagtcagtggaatacatgattaggtgcctcttttcaaactttcaattatgaaacatactgtcctagagtagcaccagcgatgctggtccaactcagatgtattgtacacacattcaatcattcagtttttattacgcatataatgaaaagacgacgaaaatataagccacattgccgcgtccactaaagcagtactactaaattacacagggactaatcaaactgttagcaattgatcaggcagcaaattgtcagaactcagaaaacatcttatgcaaaaaggaaattaaagcacatacatcaaaaacaaattaagatgttgcatcaaaagtgtgtagaaaccaaaagaaaggcaaagattcgatactgatatgatcaaacacgagagtaggaaacaggagggaaagagagatgaacgagaaaagaaatcaaaagctgttcatccatgcatgcaattcatgcacaacaaccaggtgagtaagttgaaggtggtcgtagcagactagcagtagtagactagtagttaagtttaagctcgaggtgggctaatggcgaacagctacgtgctaacctaccattagcgaggtgtatataagctcacggagtccctgcagcatcttgcattgcctcatccatccatcaagttggtcatcgagctcgagctgaatctaaacct

SEQ ID NO: 56336 - DNA, 1501 bp, Oryza sativa
aagctgtaccctcccaggatgcaatgcattatgcatgcacgtcgttgcagctaaccacgtattgcactaatattctccatttagtaccgtctcgatcgatggatcgtcggttgcatccatgcatcatccattggaattcaattctccagctcatgatgtgaacatgtcacccggtggattaagcaatgattcatggaaggacagaggaaagctcatcagctaaaggttttaaggaaaacaaaacatattagatcgatgcaactagaaaccaccaaaaaggtataccgttttacagtagtatctattggtagtagaaacactacttcacgagatcggtaaaattaaattctcttaatcgaacaaattgcagctagcaaacatatttatacctgaatattcagagtttcagacatctcattttcagcatcaaccacaaattgcaggcagagtaccaaagctctttggttgcttcaactcgaccctaaaccagggcgttagaaaagggaaattgagttgttagcaggagagagagagagtgagttagttacattggaaggttcgcttgcaaaacacagtatcagatgccgcagaaaacgacggccattttgcacaaattgctctgcatcaagtccacgctgcgagtcgctgcagcagttcgtggtactggagcgcttgtccgttagcgaaacgagacgtttctgcgagtaccctagtactacaccacactcgccagcttctctcatccgattcgtcgatgatattttttgttttttaatatacgatgatattaactttaagattggttatttgttaaaaaaacttaatgtttgtatgtcttataataaaaaccgacgatgtaatttatttttattatccaaaaatttgttttattaaaaaatatgtaattaccatttatttgttgtgatttgtttttataattaaacgtattttaaatgtgacatatattttttatatatttgtataagatttttaaatgagaatgttgattaaacgtgtatttaaaagttaatgatttggtattaggaaaccagaaggagtagtactgagttagcaggcagataattacagctgacagattaaacaaatacagtgatccactgattagatgctaattgagctttcctcctgggaatgtgtgacagctagaggaataaggaatcgaagttgtcaaaagatgtgctttgacattggtcttgtagacagaggtctcatgtggataatcttgtaaattaattagtagttgttgagctttgctcatgtcacatgcatgatggagttatctgcatccatccatgcaaagcaaatcagcaaatgcatgatatattgttgcaagatgttgatctgaatgatggtaacacaatggcatattatttctctctctggattagcctgaactctgaacaaacaacatatgtcacagcttaatccattctctgaggttgacacattatgagtgacaaaactgtgacaaactgacagc

SEQ ID NO: 56337 - DNA, 1501 bp, Oryza sativa
ttcttggtgtttttgcagtgaatcgtactcactgccattgatgttgtatgtatgagttgaattcagattccatgatgtttctgaatattgcagctggtgtgatgccatgtaacatggtaatttgatagcctttgtattgtatcagatatatagttgcaaacactatgtcaaaaggagttcctctttttctctctcgctgtgctagtcactctgtttcttgttcatgaggaaaggaaaggaaagatacatatgtacttgatatttgcactatttcagcttaaatccaaccaggaacttagtttcaaagtgtagaaaaattctttgtacatgaaattgttactcaaatttgatttttgtgtgtatggtaagcagtagcttcatggcttaatgtttcaagcggcattaactagaagcctgaaatcatgaggaagataagttcaggaggcaataagccaatcattcagtagtttaatgttgcctaacagaattgcatgtccttacatactcattattttctgatgtcaatattactgacttgtttgtgtttatcttttataacaaaattctcatcatatttcagttgtctgcacccttgtataatatgggattaaagcactaaaattttcgtgagcaagatagggtgcctcatgagtcatgcctattagcatgttttagttgagtgctataacaagactggtgtgatgtgcacatctgcatacatttctgatctgatctgctagtacagtagcaattaccactaaacttgacacaataagttggtttatttgcaaaggcctggtctttgaaagtgcatttgttgatggtgaaaaggtactagaggtaatctgccacttgtcaatctacagagagtccacgagttagtagtatgtgcatttcacaaatgacatcactggagcgccaaggtctaatccaattccatcactgtcaccaaggaaaaagatgatcaaaaggttaggccccaacgttctgatgaaaaacaaattattagcatatctgtaacttattctacacaacatggttagtagcatctccccatttcttaaccctgattcctaaaaacaaaacaaaagttaaaatgccactacttgcaaatttgtgacaaccccttgatctgtggggacccatatcatgatattgagaatagatacagaaagaaagaagaaaaatattccaatcactctcacaaaaatggacaacagagtgaggaaataacacagccataataatggagacgtttaaattacgtcaggctgccacagtatatagtacacttagccacaggatcaaattaaaattcaggtttattttttaagaataaaattaaaagtgaggttttaaatctcggttatagctatttgaaaaagggtctagctatttgctcttatatagtacaatttagccgatacagctgtttgagaagaccaaccattaaatgtttatctgattagtaggcactaccaaaaaagagagacataaacgg

SEQ ID NO: 56338 - DNA, 276 bp, Oryza sativa
agagcttaatttagaaacttatcacaaacctcacacttacgcagtaataagattgcaataagaacatagtggatcatgttcagaagagaaggagaagacgaaatgaagcctatcattctgccgccgtcaactgcaagaacgggcagccgtccgatcggcatcggacggtcaccgacgtctctcaaggcggcgaacatctccatctttcttactacttttagccattagcttggtggattagtgagctcgctcctccttttggcacaaattctctcg

SEQ ID NO: 56339 - DNA, 1000 bp, Oryza sativa
aacaggatggcatgttgaaactctcactgtaagtacacgtagctagctcttctgataatgcaactcttaattacatatttacatatctggcttagcttaattaccagtactgccatctaaaggagaagagcaaataaattgtcaattcccttgagcgtgccaactgccaagcaactattcagcacgtactgcaatgatgacagaacagatatgtgtaaccaggccaattcaacctaatcatcttgccaaaccacctaacattcttctctcctctctcactcgtttggtggcacaaagaatggcatacatgtgtgcctttgctttctgttacgaaggcagcaaattaagggcaccagtgctactgctacacatcaaaattaaatgtgtgcaaaaagtgaacatagtgtagtccaagatttgcaagtgattccatctatgctactgttaaagagagggaagagcattcattattcaacagggatcatgaaatcttgacttgctctgctctgagtttatcaggtcgaaatctaatccagcttgttaaccatatctctggattgccatgtgtaagtaggctgagttttctatttgctttgtgatttttgacagatttttgtaataatttggttctagcttcagtgaaagcaaaggcgccgggattttctcattatgttaaaaaatgttgtaagtacgtgcatacctgcgtatctggatgtcctagcactgtgagtaaacactactagtagattatttggactttgtgagcaaattggatgcagttcagtaggatgtctcttccaagtccaaaggagcagtagtactagtacaagaacaagtcaaattggtactagctgccagtaaagtagaacgactagactggactggtttaggtatcatggaagcatcagcaactgttctttctgaactctacccatcttagcagctctcctgataattttctttaaaagctaataaaataaattaataatacaagcaggca

SEQ ID NO: 56340 - DNA, 1501 bp, Oryza sativa
aggatgtctcttccaagtccaaaggagcagtagtactagtacaagaacaagtcaaattggtactagctgccagtaaagtagaacgactagactggactggtttaggtatcatggaagcatcagcaactgttctttctgaactctacccatcttagcagctctcctgataattttctttaaaagctaataaaataaattaataatacaagcaggcatggaattaaaacacggttcaatcgttgacagcaacgcggcaaccaccgaccggtcgatcgagtgcgactccatcgtcattttggatgtcctcttggacatggacgcatatgtgttcatggctatgctaattgatgatatcttcaatacactacttcactccagctaacactggaactgtgtagtacacactgaatttatgtttatataccatgccagtgcagtgcaccgatataaaaactcaagtttttggaacagagaataaaataagataaaattcttccgacaaatattcgcataaatgaccatttttgaactttgaatggaagattatggttcctctcttctttttagtttatagctccacaaatggatgtgcattcatttatttctagttaagggttatctgattataggtgtggcaataagctttgctttgtagactggttttgcagccatgttaaccgtggacccctaattatgccggtcaaattggttcgatctgtcacaaactcacaaatcacaatgacattgttctttttaagattaaaagaatattaattctatataggttatatttacgtgtattagccggttgtatttgtactaatgtaatataatagcgatggaagaatcagaatggtatagtcattggacctatctgcttggagttgattgttgatggtttatggaaacataattttttgatgagttgtttggtctctattagtgttgttgctttgaagtgggactgggtcccacatttatttttttcccatcttgtaataaaaacctaaggctgtgttaagatgcagaggaggtgtaatattcccacttcttaaaaaacacagagatttttgcattttctctcttatataagagaaatctttcataattttctctaagtttaagtacctcacttatccatgtaggggtaaaaacaacacgagcattgtaccattctgagagttgatcaagatatatgagctaattgccacatgtaattgaaatttgattagacatatatatggattattacagagtctgatgtacatctttcctatcaccaaaagggatcgatcaacaaacattacatgacaagaacaattaatttgccgacgacgatgacgacaacaacaacaacgtgaacatgaaccgtaaaaacgaaaaaaaaaagagattatcttaccggaatatatctcctctaatcttattatgaacacataataaagggaattaaaaacgccgtgtaattaattaccatacgtcgccgatcacaaggccaagg

SEQ ID NO: 56341 - DNA, 1066 bp, Oryza sativa
tgcgtagctcgcttgaaaaccaagtaactgacaactgaatattgttcagaaaactctcaatcatgtgtagtggagtactagtgtgtatggtcactgaaatggcacttttaagaagatgttgctattgccttttgcttcactactcggctccatttatctgaaaagattaactaaagtcccttttctaatcatggctttcatgagccttaaacccaagtttttacagacaagtgacaggtcgatgaatcaggtcactgtaagagcccgtcaatgcattgtgcagagcgtgcagcatcagtgcaccttcagctgaggacattgtgttggttgtgatgtcaagcatgctgatttgaacctaatacacaaaaaagaagaattgttagaaagtttggagcatttgcaagagatggtacaaaggagggcaggcctaggatggtgaccggccaccagcaacgatgatctgtttgggagcacacacacacacattgagacatatggctgagaaagagaggtctggaaggggaggactccaagagtccaagtaacaggagggcactgatgataatgcaggcttggaaaatggaaagccatagccaagtgggtagcaaacaaccacctcttgttccactggaaaggcaaggcctgcagtgcagcagcagcatatctttgctactgaatactcatcctctcctaccctatccttcctagtgtccattatcttcactcacagaaatgcatattctttctacttctttttggccatgtatcccaactacttttcaatcatacatggaatcagaaatgtatggtaaatactaatatagactcatgaaatttgtgatgagtgaaatggtagaactgcagaaatgaggagaggcaggtcttgttgactgtgacaagagcgattgatatataaaccatgaaagataagctatatctgccaattttgttgtatccctgtgttttttttaactgactgactgacatatgaaagaaacagttaaacttccagctccaggcgatgcccatagctttgttcttgtcatgatcagttgaaaagatcgga

SEQ ID NO: 56342 - DNA, 205 bp, Oryza sativa
cgcataccgtatttgtagctatatactcctagtcctagatagagcttagctatagcatgatcgagtgagtgggcgcgtgcgtgctgccgctagaattaagtagccaccagcagctgagaaggcgccggcgccgcactatagcagtgcccgcagacagttgccggccgcggctagctgagctcaagtcgagatctccagagatcga

SEQ ID NO: 56343 - DNA, 1501 bp, Oryza sativa
gctagttagctaggactatgctaatgacacaagcttcataacatagcccctctctttgttaagcacccttttttaagcatcatacacatcatgtcgcgagtgcacgtagtgacaaaattaaaagtaactgctggagatgtaatggctattgtactgtatacaaccattaattctggatttttatattttagctttttaaaacttattttacaaacagaaatttagaaaaacttattctataaatgaaccctttttcttgacgccgaggttcaatgtttcaatgcgaatctcagccctcgtagcagttaagtcttgcagatgtgaagaggatcggtgtcaaagagatgtaaatttttttataaaaggattagaatgtaaaattttttcttacaactagaccctcgacaacaaggtcctatttgtaagaaaattatttacattttaaattttttcataaaatttattttacaaataggatgtacatctcggttgctagcggcaaagttgtcggcgccatcgtcgttggcgtcaataacgttggaccttgacattagggttactagcttagaaaaaagagtctatttttagaagtttgtctaagggtatatttataaaataaatttttagaaagtgtcaaaatgtaaaaaaaatccaggctgttaattaattaccagtcacacatgtgtaacatacattttgtggaaaatgaaaattgctcctgtcagaatatcatgcagatattgaatgtcaatgcctaatttccaaaatggcaacttatactgcttgttccaagaagcatggtacaagcccagtcctggtatgggttctatgaaacaacatgactatacacattggaccttcgatggcttgcaagaatggggagatcaatatggcttaacaaattcacggtctcaaataagccaaacgacatatttacaaaatgctgaaaattagacttcgatgaaaaaaacattaaaatcacctccaaatttaaagttgaaaatttaaattttggctaataactataagtataagtgaaaagataagactgtcagagtaagatatccctgcgcaaaaaaaatcagagtaagaaacccaaacattaggcaatattaattagcaacggaacatgtatgtgaggtgaggaagaacaagagaattgtcagatgactagatgagcaagcactcaacatgttgttaggattaattatggcatctacagagtacagacagagacagagcatacatttagggtgaaacattgttccagttttgctatagtagtctctcccttttgtcatacgatcttacatggttgtttcagactttcagctgccgcttttgcccttggataagaattttctaagtactttttcctcttgaaccgcaaccttaaaacctggttaatttctcgtccttctataatactggttaatttaattaatcctagaaaggccatttcaattcgacccaaatttttttctacacatctactggttaa

SEQ ID NO: 56344 - DNA, 1501 bp, Oryza sativa
taggacgaatgtatacaattagctagctaacatatctgatcggtgcctaccagtgtagatactccctaaggttagggttgcttgggctcggagcatccgggtctaccatcacctgtaggtaattagattagtacgtaagccacacaaaattaacatgcatccatgtaaaaaatataatttatagtctagttttatgataattaatgaaagtaattaaataacttctggtgggtctctgcatccaagatatgatccgtacgagtgtgtagaacgtcctcatgtcattgccaccgaccacgaccctgggctgttgggtcaccatggacggcttgagctcgcagccattggagacgatccttgcaccatagctgacactgaggttagtgatccggacgaatggatccagcacatcacccacaatcctgccaaccacaagaggatcgtccctgccgctgccggccatgtcaaattaataacctctaactaaaaacgttaggatatctaatatcaaataaataaaaggattagactttgaatctaggtcagctaacccactaacttatgaagctagccggaaaaactctaggcatttctcagtaacctttaactgaacatgtaaacaaacagatcgatagagattgctagctagcttaggtatctcctgccgttcaatccagaggatagatgtcaggaaggttaagctagccaaacagtgacagggatgcactagttgtgcaagcttctctgcatctgtacagtttatatagctagccggcccctttaggcagtaccaacccaagacactacacggtagttttcataaacttcacatcatcaataaactagtattagacactactttttcaatacaaacaccactttttcatgcttaaattaaatttatctcacatgatgtcttcaatgttgtgtagaaaccatgtctcatgcaagaccttgttttcttctctttcctcatttactcacttgccacatcatttttcatattaggtagcagcttatttaatgctatggacaccatcctagttattgagctgagaatagccttactatgatgtgcccagtagaatcttttctttatgcatttacacactttgttgtgcccggtagaatcttctctttctcacacactctctctcgcatggccctttctatcttcttcatgtcgatagaagtgctgaaactgaccccatttacagaggcgatttcgagacagatacatatgtactaaccccgtccaaaataaatgaagctagcagtaaaataatgaagctaactatgggcatgtttggcagagttaagaacagctgtttggtaaccaggctctgagagtttggaaaagctggttacctagcttctggcttttagttcttttataaattctataactatagctttttagaatctggaccaacagctgaactattttgagagcttttgattctgggagaagttgatgcagctagaagctcccccaaacagg

SEQ ID NO: 56345 - DNA, 1501 bp, Oryza sativa
atgcataggaaaagaaaaatgagctctaaggttgatgttgattttcctatcgaattctgttgaaatcatggtcgaacttttttcaatgctttttctccgttcaattcctacaattcaaagggacgaatagtaccaatccccatagaattcttgtacatatgttttttctccattattcctattaatcaaaggaggccagttttctattggtacatgtacgaatggttaaaaataaattctttttgggacagagatattagtatcaatattcggtagaaatagttcaaattattgatttataaattctattaattatgattttcttacacctcagtagaaagatattttattgttggtagtaggggtgaaaacggtacggaaacggacggaaacaacctttatcgttttcgtttccatatttttttcggaatcggaaaccccaaaaacgaaaacggaaacgaatattatcgaaaccgaaaacagagcgaaaacgaaccggcgcggatacggtaacgaaaatttatcggaatacaaaaacccctcaaactgagcttcaaacttttgtcaagttcaattctcaagtcttaacagtctacaattcatcataaaacacaattatatgaagtctaattgttaagtctcaacagcaaaatatattcttctataacttcgtataatttgcataacaaatattctaaaaaaaattacagcaaaataccatggtataaggtataaagtatacactattagcccgcagcccgcagcctctctcttcctccacgggccggcttccccttcccctcctccctcttcgggccgccggcccagcccttttgctcctccctcgccgagaagtctataatgcctccttcctctcaattcaaatattttttagggtagtaaatgatttcaaatgaaaaaaatgtcaataacaaagttgtataacttatcaagatcaacaacttttgttttggtcattttgctgtatgactttgtttcaataatttgaatttgaatttcaaattatgacaacttcaaacaacattttcaaatactaaatgatttcaaatgaaaaagtcatcaacaacaaagttgtataactcatcaatatctataacttttgttttgatcattttgctatatgactttgtttctataatttgaatttgaatttcaaataatgataacttcagacaatattttcaagtactaaatgatttcaactgaaaaggtcatcaacaataaagttgtataactcatcaatatctataacttttattttggtcattccttcatccgataaagtgatagtaacattgttcacaaaatttacatatatctcctatagtttataaactatataagagatatatacattttgtgaacgatcttataaatcactttatcggaggtccctaaactctcataaaccgttcaccggaggtccctcggcaatatttttgcccggttttgcggacgtggcatcctagtcagcaaaaaa

SEQ ID NO: 56346 - DNA, 1501 bp, Oryza sativa
gatgtttatggagttaggtcaatttatttagattcttttgcctttttacttttgctattgttttcacgggttcttcaatggagatcttgaaagacattgatcaggttgcagattatccaatcgacagtgtcggttttaggtgggtcactgatttgtttggtgatgccgttttagagatttgccaaatgatcaaagatggtggtcgatagaaagacttttgtgcggtccagagttgattagtgttatggctgtgcttgtgtacttgtatctcttgtggcattttaagatgtatgtagatcctctttgttctgtatcggtaccttatttctcatgtactagaactatcaaggttgtgatgatttcttatatttaatataaccaccattgtttccataaaaagaagtcaactggagtgataatccaaaagcagcctagctagttcctacaaatgagaggggaaacaaatgacacatcagaataaggaacatcgtcatcagacttaatcaagaacatgacaggttcagaatttatgtgatgcaagcctagcctagtttgctgatagatgcgagttagtaaattccatagaaatatatacatatccagggccccatccttttgtacatatcgatgtggtttaatagaaacccatacgatcgatggcgaaatcaagaggtagtctcaccatgatcaaagttggttgactcataatttgtgacctgaaatcgataaatttatgaatatatatattaattatcatccaccaatgcgatggaagatgagacactgttcgactgtcgattacctgtccccgatttaagaatcgaaatctccgtttgatcattgtcgtcgtcagagatatgatgatggatggactggcctgaaatggaagaaaagaacagcatctgaagcttccacactactgatgcttaatttccctgtgttcagttgctagtgatgtgagtggttagcttaattagcagctcgatcgcgttgatctctccaattcgcatgcacaccacaacaaccgatcgatcgatcgatcgagagcactcacgtaatacgtcgccttcgccgcgagaataatttagctatagctgcaagcatatataacgattcaatacagcgactcgcacctaacctaaccccgcaacaaccactaatcaaacacggcaagaaaccccagaaaaaataaataaataaataaacaaaaataaaaaagttcagatcagcagcatgtgatttttttaaccatttaatttctaaattttaaattgaatattctcaaaacttatttacaatgctgaacattttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataa

SEQ ID NO: 56347 - DNA, 1501 bp, Oryza sativa; identical to SEQ ID NO: 56145

SEQ ID NO: 56348 - DNA, 1501 bp, Oryza sativa
acataatgtgtgtatggtaggtgggacattgatagtatagtaagcaactattgtatgaattggctattagattggctatagatgaattagagctagcaatgggccataccaataagcagatctcactaaagcaaatacaaccttatagtgatgagtgatctctatctcatgtttatttgacaacgaaccgtaaaattacatctaagatcatagaaatgaacaaattagattacctacgtactaaaatctaatcagtaactatttccgctccactcccgtaattaggtaaccagcaacatcaacagttgaacacctaaaactaaagccagatctcgagcaacacaagcagacacgaactagcaaactgtgataccagcgactaaccgaaggagaccctgccgatccgcggggagccacgtccgccgcagcgcgcgtcgccgcccgacggagccgaacccggtgaagatcccgacgaaggccatcaccttgtgcctcccgcgcgacccggtggcgtgcgacgccgggagatccacggcggcgcccgccgccgccacggccccggcggacgcatccccgggccggcggtcccacgcgacggagacggagagcgggcgggaggagtccgggcagcgggcgcgcggcgcgctccccggcgaccaggagaaggagagcgcggcggcgaggaagcccgcgaggccgaagaggaggcaggcggcggagaaggccggggtggagaggatgcggcggagcgtggcgcggcgggaggtggtcgccgaggagaagaccttcggcgagctcggcatggcttcggcgaactcgccgccgcgccgccgcgtgggttgacggcgaggcgcgccggatcggagccggggggagacgaggagggggaaggggtggtggtggacgctgggtgcggccgcgtttgctgcttctcctcctttttgttttgagttggtagagagagagagaggggctgtgttgagcccaactggtagcccactaagattcagcccaagatgatttcaccggcaaattttggagggctgtaattcgaaatgggcctagaatttcgttcgaattttatttgaaactggaattgtacgtgatccttctgttgcgtattataaaacgttttcgttttgttctcaatcaagtttaatcaatgtagcaacaagttcaaaaaaaaatgtagcaactcttgtagtacaaaacagatatatctctactattataaaaattaaagttgtttttgcggtattttggtacgtcgttcgtatttgagctgattttaaattcgttcgcttttgaaaatacaaattcgtattttagtcggattttaagttcgtttccttttgaaaatacaaaagaagtcatataagaaatcccttttaaaaaacttgcatgctaacttgagatgaatgttgaactcctaattgcagctcatgattttctagaaaaaaaatatctaagcgaattcccacagtggatttcaccctagcca

SEQ ID NO: 56349 - DNA, 1501 bp, Oryza sativa
ttgctgctcacatctcaccaactgagtcctataacaaacctcactcatcaaatccaatgatccagaatcatctaatccaacgctttagatcgtcccacgttacccctccccctccgcacgcacccctcctctctcagatcaatttcaatcgcgccgccctcctctctcggtcactctcctccccctcaaccgccgccgcatccgccaccgctgcctccacgtccccgatccacgctgcgccgtcttctacgccggtcgagatctccgccgtcgtcgccacgcacagccacctgagctgccccctccgaaatcgccataccctgcacctgagtcaccgaggtccgcgccgccaaaactccgtcgcgccaaccctccatccgctatccccgtcgccatcggccacctcctctacggctgtccctaccacgaagactgcctcctcctcgcttgcatcgtacatttgaaggtttccgcctcctgattctatccccgatcccccaaatctctaaccccaactctttgcagttcaacggagaaggccggtgtcttcttggtccttccgttctgatctccattcctttactccaattcccattctctgattttttttctttgttatttgcgtgtgagggtgggcccaccagtgattcaagggtattcagacgtatacccaagatttttgaaaaaaaataagtatatatactccatacctcgtatatgtattaaaaaattaaagagaaggctaaaacttctcattttgggtcctgttttaccatttcttctctattggatctaaatttcccacttccttccctcccctttcctctcagcccacactcagcttgggccgcaactagttcatttcccctccccgcttaggcacagcaaacccaaatcgggcaaaccactgaggacgtgcgcggtgcggcggcggcgtctgggcggcggcgactgcaccggctgcggcggcggctgccggctgcgtcggcggcaggcggcaccgaggcgagtaggtagcgcgtcgggtaggggtgggcagaaaaagaccgaaccgaaaagaccgagaccgagaaattcggtcattaattcggtcctaggtagtgaaagaccgaattttgttcggtcaattcggttagtctcctcggttaaccgaatggaccgaaaagaccgaattatcaaaaaaaacgtctaaatgcaacatacaatccactatgtttaataggattaaactctaattttcacatccctacttcttctaggcatgcaacctaacaagagtctttactcataagtgcttacaaattttttttttgatttttgtgttgaaaattttcattatttctttgcatatatgaaaatgttcttgaatttcggtcaagactgagaccgagacggaatttgtcggtcctaacattttttttcgctgaaattcggtttttacttttcaaagaccgaagacggagactggaattttcggttagaccgaatgaccacccctagc

SEQ ID NO: 56350 - DNA, 1501 bp, Oryza sativa
aaattgttacgtcaacaaaatcagatgtatatactgctataggatccaaattggatggttttgtatagtttaggggtgaagatttctggtattgaggataatggatgtcaaacaaactcagtgtaaagttgagtgacggcaggtgaacttatacctttacttgggcatcgggttgcaggaacggaagaggaggaggaccaacaacgcttcctcctcaagctcatgccttccacaaggaccatcatcagcgtcatcggtcggtgttcgcgtccgagctacatagcggcaggcaggaggcggaggctgacacccatgacgacgggttcgctggaccaccacaaatttctaaggctctctgatcaagagcccgaggagtaggttctatgtgagttttatttttttatgtcacgccatccaaaactatactcaacactgagacctaatgtgatatgattttataaggttatggatgtgttatatccgatattttgatttatgggtgattttgaaattcgacgacatggaacataaaagtgaacattttctttatcccatgtaaatagttaatatgggcagattgtcgtgaaggccgcctacattaactgggtgccaatgcaaacatcgtaaaaatggcacaacacgtgtggtcaaataatttactcgggcagtacttctctatgtctgctcaggtaataaagtatttttcctttataaaataatctccataaacttaaaaatcttgtagaaatttgaatttagatccgattgacacggtgagcacttctacgtgatccttgcggtattccctagctttaaaacggcatgctaacaacttgtcatggctacctcttttttcatttggttcttcacgggcaccggaatttccgtatgccattagctgcagttggagcaaaaaacacccatgcaaatagcacatggccttagacgccatccaacgtctagagatggtgcaaaagcaaaggcaacttacctccaccgagctgagcctaagaaccgccctaaaacacaggctgctagggctggcagtaatcgaaagagcaaggaaaagacatgcctcaagaatcaccaacatcaaagaagagggcaccaataccaggttttttcacttaaaggttaacgcgaggagatgaaagaaccacatccattgttttcacacaaggcggatgggcggtgacgcacgaggaaaaagagcgaaatgatatttgatcacttctaggggataattggaagacctagtccaagacaacggagttgaattgggaagcccaagagattcagccctcgatggaccttgctgtccaatctgaaccattcactgaagaggggatttggaaagccataaatgcaatgcagtagacaaagctcctggacccgacggcttcacggtcaatttcttcaaaacctgctggggcatagtaaagcttcactccatccatgatcagagatgcaatgatctaaaccttctcaactcggctaatac

SEQ ID NO: 56351 - DNA, 1501 bp, Oryza sativa
gaagcgtaataccctactcctgtgttttggtggatctgcgtatgaaggagctacaaagtgtgagccaacctctccctcgttctaggttctgaatctggaaaagatcatcccctttctctatgggccaggtcctccttttatacttcaaggggataccacatgcacccctccctttccaaactggacttttcttctcttcataaatggacggagatttgcacggtcgtcctccgaacatcctcctgacgggacggcacacacctacctccacttctgcctgaggcgggcacgtcgtgggaaggtggctgtgtgctgacgacatgagcagtgtcagaccggtcacaaatcggtcattcttgtccaccacgcgtcggcttagcaacgtgcatgtttgcccttcttcaaacaacatcttgcttgtaatggttaggatgaagcctggcatatatcgatcggggctaacgtgtcatctctgggatgtaacacgctagttccagccggggacgagtgcctagaagctctcgtcttgacgggatggggcgaagcgggcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccctcggggagaccaagaggtgggcgcacacatcaccctcgggcccgacgtcccccgagggtgccaggccacgtgggcgatggcgtctgcctcaagcctctagtcatgatactcccggtcccatgtcaccgacagtagcccccggcgttatgccagggcgatcgcccttcttatgggaagcggccgggcgtgacgccactcctaaagcctggtgacaggtgggaccggtctccatggttgggcagaaacccaacggtctcaaaccatgtacaccggttatggtaatttagctgtcaataatgggcggtctcttcaagactgccacatcacctgagcggcgaacgaatctgggcgagccgatttgcttcgcctggagatacggtaatgtcgcttcggtcggcgagcgtaattaacgcgcgcacgatacgatctatctcgactgccgcaaccgcatatccacttcacgcgccgcaagcgggcgaatgggatcagtggaagcgtgggcgcgagaaacgagggggcgaaataatgggcgcgagaaacgaggagccgggcacagcgttggcaagggtataaaggcactgaggataggatttgtttccttcctttcgccatcattccccttgccttcgccgcttgcgccctaactccttcttccctgcgcccttctttcgccacacacgctcgctctccatcttctcttcgtccggcgcca

SEQ ID NO: 56352 - DNA, 648 bp, Oryza sativa
ggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtccaagataaaaaggtcttctaattccatgaatctttctagaactcttttctcttgaatagcagttaagagagtttgggattgcctggtattccaccaattcttaatccaaagttccagacatttgttaaaagagaaagagactccccaaggcaaaagtacgataaatacaagatataggaaagaaggcaatgctttcttttttttcatttttg

SEQ ID NO: 56353 - DNA, 363 bp, Oryza sativa
gtagtggtctctaacaaaatcccagagtgagaaccatggagagtagcttgtgttagaatcatgacattaatgaatttaactcaatgtctccgggcagttgttttaatattgtagcgttattatgttggtacttccgtgggtgaccaaaactaaagctaaatgtatcaggtaatattgattgtagtttgtccagaaattatttgtcagatcttttgctttgctaccctgttggcttctgccactgaaaaggatgggtgtctgaattcaagagaacaagagaagggaagaaaagaacaggatgggcatcttcacacgtatgtgcattaaattcttgtgattttcttgtccattttctgtttcaga

SEQ ID NO: 56354 - DNA, 189 bp, Oryza sativa
ctggaatggatcctacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactagg

SEQ ID NO: 56355 - DNA, 1501 bp, Oryza sativa
cacaaataacctatgaactagatcgaatgaagccgtattctggcatgttatctcatgcttctcaattcaatgacaaaaatcataaaataaagggtgaatagctaacattgtccctgaagtttcgcttcgggctcaatttagtacttgaggtttcaaatcgtccaaacaggtcctccaaattaatcatttgggttaatatagtccttggacccacaaaaagtgtcacgtgagcatgctaagtcatcttcgcatgcagcggtatgaatgaaatgatcattctgcccttatataccatatatgcgaggatgacttgctcctacaacgttagtttggacctagcaacgtagggctggcgttgaggtggcactccattttttagataagtttttgccacggtgtaataaattttctaaatgggttaaattattaaaaattcaactttatgaaaggagagaaataatttgattaatgattcaaagactagaaacattattttagtggaacatcgaattgcattataccactggtacgacagaatcgctggcaacaaaatcctctagtttaggaggaataccgtcccaactgatctcagttagctgagaacagttacaaccataagcagccaaaggatgtgccactttgttacaactacggggacagtgatgaaagctaaaagtattaaacgaatttacacaaaactgcattatatagaagacctcctgctgcatccaacctgtggctcgtccagagcatcaatggtcagtttccagttgctctcatcatgccttttccgtgctgctgcttctatacctgctctgagagctaagacttcatagtggaaagcgtccatgagatgtgtgattcttccggctccagattcaatcaatgagccagcatcatccctaataacatatccccatccaccattccccgtttgtggtgtatatgctccatccacattgatctttaacatctccacatcgggattcctccatttctgtgttgatcttgtattttgattcagtgtttcttggtttaattcagcaaacttcgtcgcttgtttcatcacgatcaagcttaggctagaaacgtcccttctgctctcaccttctttgattcgatttcactcatgccaccacgtatacatcagtaggactgcagttaactgggaatcgtattccaattccattatactcttcagtacctcccatgcagatttttgctctgacaatttgagacgagttccttccatattcacttccctccacggcttctttacttaattgcatttgaaaaaaaaaagatgcccccatcctcatcaaaacgttggcatatcacacatgtcaatttccatcccctttctactcaacctcattcgcaatgctaagctattgtgtgcgagcagccataagaagtgcttcatcttatttggacatttgagattccatagtttcttccattctttctgaccaccctcattgctacttgtcgttgaagccag

SEQ ID NO: 56356 - DNA, 334 bp, Oryza sativa
cgcaatggtattaattccatcccgccccccgcgcccgctccccctctcatttcctcagattcgcttgattcagcgctagatttggttcccccgtgaggtgaatctcagcccccaacctagctacgtgttattcaatttgaaatttctgggatgcaacaatgttgaccttcgcgactagtttttcttaaaagattttttaagccacctgatgcttattctcgtatccgtacaactcaagtgttgactacgctttgctttacttccagcactgttagacgctttgttcatcccaatgtttgttttacacctgtctgtccatttgttgttctctagt

SEQ ID NO: 56357 - DNA, 1501 bp, Oryza sativa
catttcaaactgcttcttttggctgcaactgctataaatttttaaaactagctgtacatgtctctatcgagtacggttaatgctatttatgtattgtctcataaaactacatgaccttaattgtttctagtctttgaatcattaatccaagttatctttcttcttccataaagccgaatcattaacaatttgaccccatttgaaaaacatattacaggaatagactacgacaaaaacttattgaaaaaaacggatcgtgacctcaatgctagccctaatggcattgccgtgttggtgcttacctctatgccatcatgttgctatgtctgaattgacatggcaggaggtcagcgccaacctatatgatgctgaccccgacaaaccccttccctttacacacatatcactagcatgcccattgacgctaaagtttgaatgttggaaaagatagtgatagatttatactttgtgatttggtgaattgtgatactaggtatgttagtggggagttcgaatgttgatattcttctgttatttatgattataatgcattggatttgtttggtaaggttgagaggaaaattatactaggaagaaaaataactattgaccaattttgttgaagtgtaggttgcttttcataactttagatgatatttaacctttggaattagtcaaaaatgtaaattattatatgtatttgaattttttttgaagtttgttggttgtactggactcattggattttaccacttgtcaacacctatcgacaaacattccatggtccatgtgttggtgcagtaacacgtgcaaatttatgatgagcgaaaatgatcaaacttactgtgccaaaagttttgggtgtgcgcaaatgacgcatactccctagagaagctaagccacaacggaagaaagggacgtccaagaagccaatggaggttatttcaaacgtaatgaggttatttcatcactatgttttttcatggtggctaatacattgccatatttgaaggtatccaaaccacctccgtttctaggtgactttgcagagtggataggtatagaggtctactcgaatatgttgggcgtctatgcaagcattagctttggttcaaggagcattttgaatggcactatgacgcaacactccgattggaggaagagcaaaaaaaaaaggaagaaggactaagattataaggagagggaagattgtgaggccaaaagagagaggaagcaggtgagggtacacagtgcgaaggaagccagattgaaggctgcaaggaaggatatgtacatgtcgcatgttttaatttgaatcccctaaggcatgtactaatgtttttttatgaagcatctcatgtgaaactatctctgcacacaccatacaccatagttacattcggttttgagcccgaaaccgtagttcgaggttagaacaattatttcgtcaagcatacatcatgtgtttgtaatgtagcggcaattttcaaaatcttgtcct

SEQ ID NO: 56358 - DNA, 574 bp, Oryza sativa
tatatatagtcagatttatctttttatcagcgagttcgtttctaagcgatcttatgagcaatttagttgtaaaatagtcgttgaaatcaaagagttggggtaatcgatatgtaaaatgcgtattttccatgttagaattgatgtttaagataattagtagtgtggtacttttgttttactttaagagagtaactgagtatgtctacgtaaagacatgttagaatagatgaaaccaagtttgttatttaactcaacaatgtagtaagttgtagccaattggttgttatagttttattcattttgcataaatgcatgtagatatcgattctttagttattcactaaaattatggttctcgtgtgcaacattgacaccaagaattaaaaattgctcttttatcactcgagctgtattttagacgtgctcaagggtcatactggcttttcctacactaagctattagtccttttgtttatatcatgatcttccatatgactttataacttaattaaatatttttatgaactataattcaaaaacatagcttgttgtacaccacaactaagaaacgtca

SEQ ID NO: 56359 - DNA, 1501 bp, Oryza sativa
gtgaagtggatatgcggttgcggcagtcgagatagatcgtatcgtgcgcgcgttaattacgctcgccgaccgaagcgacattaccgtatctccaggcgaagcaaatcggctcgcccagattcgttcgccgctcaggtgatgtggcagtcttgaagagaccgcccattattgacagctaaattaccataaccggtgtacatggtttgagaccgttgggtttctgcccaaccatggagaccggtcccacctgtcaccaggctttaggagtggcgtcacgcccggccgcttcccataagaagggcgatcgccctggcataacgccgggggctactgtcggtgacatgggaccgggagtatcatgactagaggcttgaggcagacgccatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcccgcttcgccccatcccgtcaagacgagagcttctaggcactcgtccccggctggaactagcgtgttacatcccagagatgacacgttagccccgatcgatatatgccaggcttcatcctaaccattacaagcaagatgttgtttgaagaagggcaaacatgcacgttgctaagccgacgcgtggtggacaagaatgaccgatttgtgaccggtctgacactgctcatgtcgtcagcacacagccaccttcccacgacgtgcccgcctcaggcagaagtggaggtaggtgtgtgccgtcccgtcaggaggatgttcggaggacgaccgtgcaaatctccgtccatttatgaagagaagaaaagtccagtttggaaagggaggggtgcatgtggtatccccttgaagtataaaaggaggacctggcccatagagaaaggggatgatcttttccagattcagaacctagaacgagggagaggttggctcacactttgtagctccttcatacgcagatccaccaaaacacaggagtagggtattacgcttctcagcggcctgaacctgtatacatcgcttgtgtttcatgctcttttgagaggccgcgatcttcccacatacacggagagcttgagatctcaccctgagcccccggccgaaccggcaaaggggggcctgtgcggtctcccggtgaggagcaccgcgctccgtcatctggcgcgccaggtagggggctcagcgtgtgttttctgagctctcgcgcttttccgtgtgcgtcaagtttttcttgatcagcctca

SEQ ID NO: 56360 - DNA, 1501 bp, Oryza sativa
ccgacattccatatttcatccgattacctagcgtggtggatctgcaacggaatggatgtatatatggcaaaacatttggtctatggttgtcattttttttcttgcttatcaagtttggcaggtcaacaatcttatgcgcttcagcgttggtagtttctattttctccaacggtttcttcaagctatttttggacataattacacttggaacaacatcctacaaatgcaagcaaagttgatctggttagataaaaagtcaacttctgtccaagaactgaaggaaatgattacggcatggaaactgccaaatgtaattcttgtgcaaattgcaagccaacttcatatgtgcttttgtgtttcctgaaaaccatgaacagatataagataaaattttacgaactagccgaggtcttcacgctatcttcgctgtaaaatagagttatactagtatatttcttacacggttgaggcagaccaatttactgcagtatagtgagaaaatctggacccatcgaacatagcggtgttaatctttcttgtttttctccaattgatgttgtggaggtggtagaatagtctaaattgatacaatctaaattctacatgatcaaagatgtaaattcttttttcccttggaatatagtactgttttgctagttctttttgctgagcattgtggctttactaaattttaataatataattgatgacttgcaacaaatatgttgagattttagaccaatggggctttaataggagcctcaaattacatagctagcttcactgttctctccactcaactgcaataaatggataaataatccaataatagtagagttgataaaaatacggtttgcgagttatctagtgttctctttcttaacaagataactatgtatgctttttaacagatgcaagctgggacagcgagcgagcatgaaggcggctcccttgttcacaagtttatgagtgatgggggaaatcatccattctgtggcagatatggcccatccgatggcagctatcgtgacaggatcaatccttggaactctttgaatgtagcgaaaatcatttctgtagttgtaaattgaattcctattgcgcatatgaaagaggattaactcaaacatatatgatgaactggggatgaacgtatctttggtgtgaactcattatcatctagcgagtaatatctattggctattgctagctcatgcctgcaaggaagtttctaaagacggacacgattaaaggttgaagatatgctcgccagctacacattaaccgatcatttttttcaggaaagcattaacttacattgattcatttgatatttttggatttgcaaaataatttctttccacatcatggcgattgttgcaatatgatctcccactataaatccaccatattcccctttctttgatttcacatcaatctaaccatctctcatcaatttacaggtgcattcttgctagaaagtggtgaactgcaaaggcca

SEQ ID NO: 56361 - DNA, 1501 bp, Oryza sativa
tatcaaataaatataattttcaagtttgtaattattaaaactcaattaattatacattaatatcacctcattttacgtaaaacacttaatttttatctttatctatatgaattttaaacaccacctcaattgagtatttttaggagagaggaaatacgtctcaaattttgtgagtgtacgtatagcattaggtggttagaaccgtggagctgagacttgcacgtcaggttcctaaaatttgcacgtgactgttcaaatagacgttaaaaaggctttttgagcagtgaccatgtggcacgttgacccaatttaagttggtatgtgatagtatatgaaaacgtagatcaattataaaaaatcataatcatagatggtctcaaatggcagtattgtcgtaggctttctagaccttacattatattatatttgagggatgaagtgaataattcaagtcatcaaacaaacataatgaaacatccaacgcctcgagagaagaatattggagacattgctaggcctttagcctgccagtcaacttcagcctgagatgtgcccgtcaaaccactcgaaggcggtgaccacatgtgttacacattcaggagacttgacaaaaatggctaaagatctacatcatctcaaatattcttaactcatactcatgtgaatctagttcccaggatgtgcactagattcacactttcatctcaagcatgattatacatagcaaacacaaataagatgaaagcgattataaactacatctactttagttacattggccgaccggccaaataaatatatagaacagcggaagcttgtctacccaatccacaagcacacagactaggggtttaccccattaagttcaagtcctagaagaagcagttgattacccgcatcactcaaagactaagtctaaaacctgcaagcaaaagattaattcaatagcaagagtcaatacatggcaagcaccaagacaagcctaacaccctatttgcaaggcatataattgtggagattatggatatcccatatctacacggcgaagatatttggactgaatataggataccgaatatagatagaatatcttatgtgtatcctgggtttgtttcctaacttgtacgtcaaggaaacaccctaagatttagtcggtcacgactgtatttgatctgtatctgtgtattctgttagggatatagattatcttttgtaacccggactccttcccatatataaggggggtccgggcgcctctaggggcatatgttgattttccccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagttttgacagttggcgcgccaggtaggggttgcgtcaagcttttcgccgattagtgcaa

SEQ ID NO: 56362 - DNA, 1501 bp, Oryza sativa
attttataacactacctaggtgatactaccttatactgaggaaacttctaaaattcataactcccaaataaaaagagttaaaatagaaattatttcacctaaattcatattataccagtacatattcactgtgcacaaatcatcattttagagcattttggatttttcgcatatttcggtgtttaattgcataacgtgtactttgtatagatgattgcttaaatggtgaagaagtgatttaggtgctgacattttcctgattcaaggcaagtcccacctccctctctttgatcactttgaacctatgttttggaggttattgaaaatgtttgtaaatcttgcatgtcgattgtacactaataaattaaaatttttgttaaacttgttagacaaactcctattgtttgcattcaccttgaccccacatatatccatatccctcattcctaaccttaggaacaatatgactataccactttatatatgagttttggagtcactaggttactataatgcttagccatgcttagaatggtattccttgtcattatgggctcattacaaacatgaagattgatttttaaataatctggacagaactttaatacttgtgattttgataaataaaatgatggaaaacatgaattttaggtttgggcctcaagtggtgcacatatggtgattagttgtgtaccgatagggggagagtgtgcccaaaccggcctaaggacttcactcaatgtcagttcatttcatatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacgtgtatggcttagaatggagtaacacgtatcgtactagtgtaaggctaaatcatgaattttggaaaagctttgttgcgggtaataaatcgggtacttatgtatcgcgtgccatgctcttgcatgattattatttcgcatcatgtaggtaaagtgtataaactctgcagagttaaaactaatcgattagccgtgctcgcggtcatgagtggcgtgtggatatgtattgagtatagacttgtgtttattcttctaaatgttgaaatttatcttcaaattgtgatgagatttgagaatgatctccttctgccatggaaggcaatgaggtgcatatttatacatgattaatgcctaccttgatgcccaatatgtcaagtactagcttgctgaaatttatttgaaagtaaacctgatttagaaatgttttatgcaaataaaacttactttatgctaaaaagaaccatattatgccttccttgatta

SEQ ID NO: 56363 - DNA, 1501 bp, Oryza sativa
agtgacattgcattctttagtaggtcacaagacaaacatctcaagtcaaaaattccatgacgattccacaagcacaaacatatcaagtccacaaattttcgatatttctgcaagcacaaacatgtcaagcccacaccaagtagctgcactaattcaaacacaagtatgagttccggttttgcactaatttaacttaacccccctaacttatcgtttacattgtcgtggtacatcaggagcccattgattagttctcttcctaggacatatcatggttgcgatagctgaggtgcatctattatccatgaagcaccaagctcttattggtcatcttcctccctctcctcccctcttcctaggttccctccacatcttcgtcgttctcctcctcctccatcccttggctgtcttagctttcgggtgtgcatccactcaactaagaagctggtgacattgctggaaggacagcttgaacgtgtacctcggcaatgtctatgatcatgtagccaaggcaagatattaactttttatctatattagacatagttcctttaatacctattgtatttaagaatttacatgcttaagctaaaaggacgatagctatatgttagggttaaaacatgcagtgagataatttgagaccataagtattacttttctggataatttaagatcataagtaatacttttctggtggcatatggaacaatggtttggtttgaaccttttcttataagacttgcttgtgacttttttctttgtactccctccgtcccattataagtgcaaccataagtatccgtgctcaacgtttgaccatctgtcttatttaaaaaatttatgaaaaaattttaaaggttaagtcacgcataaagtactattcatactttatcatctaataacaataaaaatactaatcacaaaaatatttcaaataagacggatggtcaaaattgggcactgaaattcacaactgcgcttattatgggatggagggagtactaagtttgcgacaagtatgaggataagttaaataatttgtttctttttaaccgtgtctaattgctttttttggctgcaacagctataaattaaaaataaccgcatgtacctatctccatcgagtacagtcaatggtgttttcacggtcaaatcagcctataattatgaaaggaggaattgcaggactgctctggcttcaacgacaagtagcaatgagggtggtcagaaagaatggaagaaactatggaatctcaaatgtccaaataagatgaagcacttcttatggctgctcgcacacaatagcttagcattgcgaatgaggttgagtagaaaggggatggaaattgacatgtgtgatatgccaacgttttgatgaggatgggggcatcttttttttttcaaatgcaattaagtaaagaagccgtggagggaagtgaatatggaaggaactcgtctcaaattgtcagagcaaaaatctgcatgggaggtactgaag

SEQ ID NO: 56364 - DNA, 318 bp, Oryza sativa
atctcttcctacctcccttcttccctacttgttctagaagcgccggtgggcacccttgtcgatctcttcctacctcccttctttcctgcttgttctagaagcttctggtgccttctaccacttgcatctatttagttttccctcttccaactctcccaaaatatactaacttgcactggtagattaccaattgagttggtgttaagattgctgattgggttgctaacagcatgcaggatgaatataatatttacgacaataacttaagtttctgaagcgacaaatcaagctcatccttgtgctgctgctttccacagt

SEQ ID NO: 56365 - DNA, 1501 bp, Oryza sativa
cgcccccgcattgtcaaactcgccacaatagttgggtgcagagaatatggttacaagctggcgcttagcaaagaattcatagccatcctccacaacctgtcagagaagatcccagcacaaagcagtgagtggtaaataaagacaatcgctcaataataacaataatagttcactacagcagagattcactgagaaaagatgcatgtatttatttcagcttatatccaaaaacaaattggaataaaccaacatatttaattttccttacactagaaaagggaggaatcagtatttgtaacaagtaattgcatggagtagattgaattatagaagaaatttgactgaaattgatttagaatattttaaccaaatctgtaatgctgaatttcattggcctcaacaaaacgaatggagcagacaatagacaaggatgagaacaaaatgatcatctaatgcatccaatatcaatgggaagttcaccccaagcaagggcatgtatgtagttagaggtttgaacatgatttgcagcacaatacaaaatatctcatgcaatgttgacgccgataagagaattactgtgtggtgattgcctaagtgtagtatacaaactacacacagatgtacaatagaaattctccatttctttttcaataaactacagaaccataagttaggggatttttaataaaatggagaacatgcttttgttgtataactcaagagatggatgaaaatcatttaatcagatattgaacagttcttgatacagcagataaatactttagaaacatcaactcatgtcacaattaaatatgcactttcaagtccaatgaaatgataacgaactcacaggggaaagaccactgttacttgcttgaaaatcgtacaaaaaaattaccatcaaaacatacctggtgagccctgcagatcagatctagatcatgtgtctggagaaactcagcgaccttatcagctccaaaagtgtatgatacacccctgtcattctcaccccaaccttcgatttctttatctgggtctgaccacaacagatcacacaggagaccatggtctggaacatcaactgggcgggcaatgttgcgaatctggtccatgttctttaggtcaggagataaacccccatgcatgcataggatcttgtcatcaataagtgcagccacagggaggcagttgaaacaatcagtaaaaaccttccaaatacgaacattaaacctccttttgcattcatcaaagaatccgtagattcggttgatagatgcgcactcatggtttcccctaaggaggaagaagttctctgggtacttaatcttatacgcaaggagaagacatatagtttctatactctgtttcccacggtcaacataatcacctagaaacaagtagtttgcctctggtgggaagcccccatactcaaataaccgaagaagatcagaatactggccatggatatctcctgtcaatgagtaagtaggcagaatgatgg

SEQ ID NO: 56366 - DNA, 1501 bp, Oryza sativa
aaatgatgtgttggatatgagagatggaaagttctgctttattagtgtcctcctaagcataatgaaacaactagaatgtctatgcctatataaaaaaaaccttttcctttcagtacacttctatatttcgttgctgtctgatgaagaaatatcctcagtgattagttgttgtgagaaggacgacctagttagtaatagtgtttttatggtgcacactacttattttaaaagataatactgtacatagttgtaagaagtttgatgagcactgcatgatgatcacatcgaatttcttattgagtcaagcttggtgtgagtgagtgagtgaatggcaatcatggatcccacatgtgccagttccatcggcaagtgtaaaattgctggcatactgtttgccatagttcagttttgcactttctgcctcttaactttttattttcttatttgcatatctgtatcaattgtgtgcttttggtatttgtttttcatatggattgtgccccataccaattgttttgtgactgaggtttactgtggaatatgccctaattcatgcttgtgttctcttaattttagcttggttctgactccagggatctcaactatcctgtccaggatcaagaccaaacccgtcagccatcatgcaggttagttgtctctgacccatatcaccatgctactcactactgtggttttcttttcttttttgtgctgcccaactgatgcagatctgtttggaatatgatgtatttggtgctggaacacttgagttcacgtttgaatagatgttttttcctttttgatcttgaatcatcaattatctgggactgcttttgtattgagtttttcggtagtaattatagcctctggtttgttatcaatttacaggggtgtgcacaccctgctacgtggcatcatatacttttagtgattcaaaactgagttatgtgttcaggttagtgattccctcttaggacaatttggaatgggcatactaaggttttttacttttgggaaattgatgttaacatgaagtcaatacttgtgataggaccaattggatctatcagtctgcttgtgagaacagactgtgttctgtatggtctacttctttgattgattgatattttcaatataagtatttgacatagtagttcacttgaagacgataatacctctgtcaagcaatcaaaatttctagatatttgatatttacattatcttttcattttcgtattattaccattggttaggtccttatctgtcatgtgatagtcttagagctcacctgctattgtatacttcagatcagataccttgatgttcattttccattcatttactgattttggagatctctactgaatattgctagggtttgttttgtttttgcattaagctttattcagtttaaatatgttgtaccttttcaatgaactttggtaatatccttttgtattttgaccatgatgttgatatgataaatcatcttctttaaagg

SEQ ID NO: 56367 - DNA, 1501 bp, Oryza sativa
cttgttcggcacggcagcgagttggcgtctgcgagcaagtggagtagcaggtatggagtcgcaacacgatgtgtaggcgcataagagaagggtaataatagagcccacttcctactattagcttatcttaaagccaatatatataataaattagctataaaattggctacaattttctttttatctctatatctctcagttatacatttaatgcatttgtcttggaccttgtgataagctagctcttgcatgaaagccagtatccttaatttttcactatctctcttctacactaaatttatagtaggtttaaagctcactattatacttgctctaagcagtgaaggggatcagaggctcggagcgcgtgcaagtgggagcgacgtcgcgctactagtgacgctcattttctttttaccggtggttagcatccctattagtttccttgattttaatcgctaaaactgaaaatcgctgcccattttacctgaacggaaggaggaacaagatatttgagttaattttagggctttttggtcttttagtgtacgatttttttttaacatgctaacgtgatgggagttctaagatttggaaatctctaacgggtaggaaaaggagcaagttatagtgctatttttgttttggtaccgggacaaaacctgtgctaccaatattttctccttaagaaaggctcttttttgcattttgacgaacactgaagaaacattgtaggatgtcattagccaaatcaaaattttaagtaggtctcacttgattgattctactctagatatgcctaatatgcaaattggtgattctaataattctcataaattaatgtcattcattttttattttaaattcaaccaaatgtatcactacattgagtgatcatgttgtttgatgaaattttgtcattctgaactaagcaagcgagattattatttagctaagaagctaacttgttgttttgcatgaaatgcatgggccatgcattactgtgcacatcatatctagccaaccatatatatgactcacatgcagtctgctatgtatatgtgtgtgcccaatatatactggtgcatgagccggcaaacaaagactcgagcggcatgtgagcagcttatacgcgagcgctcgtacgtggccttatacctggtatacgtatacatgtacatatatatcagataattttccctggactcaaagcaacggcaagcaaggactagtgcttgggccgcatatgggccggcggagttgcgctgcatgctcgttgtacgtacgcggctggataaccacgcgtatacgcgtacatgaggaggatttctcgccaacggcaagatactgatgcggagataacgtcagataactcagtcctatctggtcatctcgatgattcaaacaagagtaatccgcagcaactaaacccggaagagtcggatcgatctaacgctcggccgcggtggcgccgagggattcgcagtgtgggttagggctc

SEQ ID NO: 56368 - DNA, 1501 bp, Oryza sativa
aggagatcgacgacgccatccgcctctccggccggcggccgccgccggcaagggtttgacggggacgaggcggaagagaggaggactactttgcaaaatagcaggaccgatagaactagtaggggttattttgcaaaaataagagaattggtatagagtatagacatgaatcagggggcattttgtaaaacaacaggatagctcgaaccttgccgtccgagacgccaactccggaagcaagagcagaggagacttgctctctccgaagtttctgtttaattacgcatctaattgacatttttttctcctactttggtctctgcaaatgcatccacttccatcatgagttttggttttaatctaattctaatatatttaaggttatttttatcctattttctacttagtaagtttcacttcttcaccaccgatcagctaaaacatacttattcttaaatacccatagcttatgacaacaatataaatgcatgttttagttattgaagattcttttctatacatataatgatttttcgaagatattcttgctaagatttcttagtcaaccatatgtttttgttgtgttttttcatataactctattcgttattattagtcacatagtaggacttttaatatagatagaagatcatcaaacgagcaaaacacaacgttgggtcctctttcaaatgaattgtaaaatatattgcatttaatgtaaagtgattatagccgggtgagaggatcctccaccataatgttatcactattacagttactgatacgtgagtctcactcttctattgtgctatacgtcagtgtttgtaatgttagtatcattatggtagagtatgtgaacctgttatagcctcggtttactgtggaggtttagtccattatatagtctatatagtgaaatctactattttacaattgtcccttgtttaaatgatattttctaaacataatgtcttttaaagatttagcacaatgcatatgatttctacggagcgagctcttctgacgtaaagtcagatagacatggccaatgacatgtcgtaaagcctcatccgatttctacgtacgatcctacattgtgaacagatggtgaatgatatgaattgcttcactatgaaacagacaataaatgtcacgggctaaggctcccatcggatggcctaataagctaaagaaaaagccaaatttaaaaattcaaacttaattttgagattgattttgagatattttcaacgtagttttttttagtattagcctttaagtcaccaagaatatatatatatatatataaatataagttttacctataaatttatttttattccctaataagccgttttggtttattaggaaaaaagccaaattatgggccttaagagagaaccattacgccgtacaagcatcgtttgtaaaagaatcgtacttatagcatctctcatctagcatcggggtctccaattcgtaggtacggcccctaactttc

SEQ ID NO: 56369 - DNA, 1501 bp, Oryza sativa
tagtcttatcatacttttgtgtaaacaagataacaaactaagcttagacaaagttagataagaaaatagagtgtatgatatgtgtaccaagtgattaagagttagacaaaataaaattatggcagaaaccaaacactatccactaaaaagtggtttgcctaaagttagatgcgataaatttagttgccaaccaaacagcccttcttctagcgggccacagcgagattcatgaacagtacaggactaccagcttgttactgtcctcacatatgatgaatctaactggaagtcgccaagtcggccaagggccaagggttatctttcttgcagctttcacaacttcggtaatgccgtacttgaccggttgatcgaggacgtgcatgcatgatgtagctaagctagctagccacacatcgcacagggatgcagcaattgaagcagctgctgcaacttgcagggtcgcgttcgctactgtatctattgcggtggtcatcagggtggcgtattagtggggagcagctcgagatgcattttcatctctcaagggattcgagggatgaaaacactttcccggaagcagctccatcgacgataatgtacaacataacgtgatcaataacatgtagaacttataccatgaatttatatgtcaatggcaatgtccctctgactagacgggagagagagaatcttgataacttgggctgggactgggagaggagagacgtggggagggagggaaatgatgcatgaacttcagaactaggatggttaagagcagataagtactggttttgctacattgccatggaagcttcttgtttcgttctgctagccaacttgctggagtacttgcaaggccgaccttatgatgatggagatattggttctgactttttgagttggacggggaatcgagctgaggctgctgagcgtgcaaataaaacagctatattcattcacacagatacaggactttgaagcatttatctatgatagttttggccgtttatcagtccctttctgaagctagtacatcaaatattaaaaaaaaaagctagtacatcaagtaaatgctactacctctgacccaaaataagttcatttatgggttttttattcaatgtttgactgttttatttgaaatatatatatatatatatatatatatatatatatatatatatatatatatatatatatatatatatatatatatatattaaaaaataagacacgtataaaatattattcatgttttatcatctaataacaataaaaatactaatcataaaaaaaatttaaataagacggacggtcaaacgttagacataaaaacccacaaatgaatttattttgggacgaagggaatattaggctgtagcaacaggattagtgtacacgatctacgacaagttgtcacagtaataatgggcacaatcttgatacatataataacatatgtaccagtttcccttgcattccatggaaagcagttgct

SEQ ID NO: 56370 - DNA, 1501 bp, Oryza sativa
gtgctccatacaactttgccattgtagtcaagaagggccaaggtgccgtccttctggaaggtgagcctggaaccctttccgttcaccggagcatcgcggttcgccgtccaagcgaccgtcttctccgacgacctggagaaccagatggagaaggtgaatgcgttggtggccaccctgtagaatccgcaggagaagtcgccattgggggacactaggatggtggtggtgtcatcctgggttgaaatggatgaacgtctagcaatgaaggcttgggttgaaatggatgaacgtctagcaaggaagggttttctatgatttgcaagagcaattgttggcatgagaaggaagaatattgtggtgaaaatgtagacgcctctcatggctatgacaacatagaaagcaattgcctatgatcatctaacgcaaatgggaaccaatgtgctgtagtccattatatatctagtttccagttgggtcaaaaataaaaggctcgcgagcaaattcggtcagcttcacgacaactttgacggggctcgtgttacaacttgattgggctcgtgtttgctgtatagttcctccctttttttttctggctagttgctacatatgatatacttgatgtactagcttagggaaagggacctaaaattaagccaaccctttgtttcgtcgagcatagcaaatgttagggcatacacatgaatttcacaggattttcatagtttatttcatcaaaattcacgtgaaattcctcaattccaaaggatgcctttgcagccaaaatagtatcagtcgttaggtcttgttcttttcggcttattgattgtggattatttggtggtacacttcctaagtttctaaactttcttcatcggtatttcttagaaagcttttttataacaattttttgaacttcataacatttaattcattcgtatatgtatttaaataattgttgtaaactcagaatcagccatcaactgattcaagcgggacctcaaatccgatcaatcttcgtttacgaagaacaacgagttaggtacttgctagtggctattactttgccgccctaccatttctttgttgcttcacttatcactttccatggccacgtgcccacatcgttgacaagaagtcaacaaggaccgggtggccatcaggcaatagtagtagcaatccttttctctccacgctaaaattaaaagtttaaagaaattaaaatgatgtgacagaaaagttgaaagtttacttgtgtaggaaagttcgatgtgacgaaaaagttgaaagtttaaagaaaaaaagttggaacctaaacagtacccaaatgagaaatccccattgggtgtaacactatggccatgtttagggaggaaagatttggagatgcagctggtctcactagctcgtgagaatatgaaaaactaggtattcagtttctcgtttttaattaaatttttagattttataattatagattctcaagatctgaatgataatctaa

SEQ ID NO: 56371 - DNA, 1501 bp, Oryza sativa
gccattgataagcaaagccttcgggaaacattcaccttttcccttccgatatgcaaaagcttcgcagccatcatcgttcaagcaaatctgtttgcagactggcaatgcgacagatggggtgtagttgaagtcatacccatagaagtcagtcttggggatctccacgaatatgaatttttgctctgtattgttgtttgcgttatgatcccctttgactgtgatgttttccttgtgcctgcacccttggctccagtaactaggttcagtcatctcgaaaccttcgaggcaggaacactgaaggcttggcatgtatgtgcagaagctgtttatgccacacagaccatgtatctcacagagtcgagggaatgccagccaagagactgaccatttaccattcgttgcgtttaagctatatagccttaggttaccatcataatcgagtgtcaacctcctcatgacatccttatcaccaagatcagacgcttcaaattgaagcttgtcactagctaagaacatgccttcctgattgagaatcccatattggctgctgttataagtagtcctaccattctcccacgaccgctcataaggattaggccaatatatgctgctagtcttagggccattgtatatgatactcaatatgttgttactgtcaaagaagaaggtgtacaagcctgagtaaggcaagcccctggcagatgcagataccagctttgtatctcgagtcatcggctgcaatgggaggagcgtgtcggtcggtgaatcgaagctcttccagaggcgatgaccggctggatccatgacgacgaggttgccgctgtcgtcaagctctgcacggctagcgccagtggccgtggtgttggtgctccacacaaccgtgccgttgtaatcaacaagggccaggctcccgtccttccggaaggtgagcttggagcccttgccgttcaccggagcgtcgcggttcgccgtccacgcgacggtcttctccgacgacctggagaaccagatggagaaggtgaaggcgttggtggccaccttgtagaagccacatgagaagtggccattgggggacacaaggatggtggtggtgtcatcttgggtggagattgaggaaccccttgcaagggagcttctctgatcttctgcaagagcaatggtgagcgcgagaaggaaggagatcgatgtggtgaaaatgctgacgcctctcatggccacggcaagcaactgctttccatggaatgcaagggaaactggtacatatgttattatatgtatcaagattgtgcccattattactgtgacaacttgtcgtagatcgtgtacactaatcctgttgctacagcctaatattcccttcgtcccaaaataaattcatttgtgggtttttatgtctaacgtttgaccgtccgtcttatttaaattttttttatgattagtatttttattgttattagatgataaaacatgaataatattttatacgtgtcttattttttaa

SEQ ID NO: 56372 - DNA, 1501 bp, Oryza sativa
tttatgctaaaaagaaccatattatgccttccttgattattgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttggggaaaatcaacatatgcccctagaggcgcccggaccccccttatatatgggaaggagtccgggttacaaaagataatctatatccctaacggaatacacagatacagatcaaatacagtcgtgaccgactaaatcttagggtgtttccttgacgtacaagttaggaaacaaacccaggatacacataagatattctatctatattcggtatcctatattcagtccaaatatcttcgccgtgtagatatgggatatccataatctccacagtagcccccgagacctttgcagtcaaccatcatagccttctcaaagataataatccgagtgcttcaaacttttcgtgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaagtaatagcataattgtgcatcatatgacaaaagcatacgcggcgcctaaagaggcattccagccgactgctttttagccataataaaaggaatccgagtggttaacactctaaaaggttcatgaatgaacacaactgacaggcatgcgagtataatactctaaagattacccaccaaatattataaaaattatggtaaatagtcatagcctaggctattagacttattcattaccataatgaaaacaggtatataacataccaaggaaatgactatgataaaaacaggtcattccaagttaacccagacagcttttgtagcctaaaaaagcttacaaaaacagtataacacctttctgtcgggcaccttttaatttgcatagcaataattccaaagaattatatgaccgcataaaaaggattttatcagcattgggcaacactattgtgcgcataaattgccaaagcaaaaaatgcctaagtccctaaggaacacaatgggccacgctgttaaaaatattgggctgaggtactgttcaggcctaggcccatttgcacctccgatacccttaacaagaaaacccgagatccaagcgacgcttcgtcttccccgccggaactctcgccattttccccactccttgctacagtaaagagctgcgccggcaaactagggttcaccattccactcaaatccgccttcgaaaagttcatcaaaatccttcccgcgatccaccgcctcaattcctcccctctcccaagccatccctcgaatcaaatcagcgcattcgggtagaatcaa

SEQ ID NO: 56373 - DNA, 1501 bp, Oryza sativa
gaagcgtaataccctactcctgtgttttggtggatctgcgtatgaaggagctacaaagtgtgagccaacctctccctcgttctaggttctgaatctggaaaagatcatcccctttctctatgggccaggtcctccttttatacttcaaggggataccacatgcacccctccctttccaaactggacttttcttctcttcataaatggacggagatttgcacggtcgtcctccgaacatcctcctgacgggacggcacacacctacctccacttctgcctgaggcgggcacgtcgtgggaaggtggctgtgtgctgacgacatgagcagtgtcagaccggtcacaaatcggtcattcttgtccaccacgcgtcggcttagcaacgtgcatgtttgcccttcttcaaacaacatcttgcttgtaatggttaggatgaagcctggcatatatcgatcggggctaacgtgtcatctctgggatgtaacacgctagttccagccggggacgagtgcctagaagctctcgtcttgacgggatggggcgaagcgggcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtaaaaacccaaggggtcggggcgcctcggccctcgggggcgaggcaggagtggtccgaccccccccctcggggagaccaagaggtgggcgcacacatcaccctcgggcccgacgtcccccgagggtgccaggccacgtgggcgatggcgtctgcctcaagcctctagtcatgatactcccggtcccatgtcaccgacagtagcccccggcgttatgccagggcgatcgcccttcttatgggaagcggccgggcgtgacgccactcctaaagcctggtgacaggtgggaccggtctccatggttgggcagaaacccaacggtctcaaaccatgtacaccggttatggtaatttagctgtcaataatgggcggtctcttcaagactgccacatcacctgagcggcgaacgaatctgggcgagccgatttgcttcgcctggagatacggtaatgtcgcttcggtcggcgagcgtaattaacgcgcgcacgatacgatctatctcgactgccgcaaccgcatatccacttcacgcgccgcaagcgggcgaatgggatcagtggaagcgtgggcgcgagaaacgagggggcgaaataatgggcgcgagaaacgaggagccgggcacagcgttggcaagggtataaaggcactgaggataggatttgtttccttcctttcgccatcattccccttgccttcgccgcttgcgccctaactccttcttccctgcgcccttctttcgccacacacgctcgctctccatcttctcttcgtccggcgcca

SEQ ID NO: 56374 - DNA, 1501 bp, Oryza sativa
ataaatgtcaaatccgatgactcctttttcttattcatgtaaaaaggattagttgccaccatatatgatgctaaggtatgtcaaaactgtaggggcatgtttcttcctaatatgtgaagtagatttttaactatcaagcaaccttgtggctgtgctttctcatgttatactatgctaagcagttgcattgcagtttaagatgtatcattttatacccaaatctttggaaatttgtgaacatgatgtcaatcttttccttttaaattaatataagggataagaggaagaaaccagggctggcagtcttttttttgtttaccaatttttccactatgtgcaagtgcaaaagcatttcattgtcttttcagagttcacgaaagaactgggctatctatttggtagcaggacaggaagtaggaacattctttacacctataactgtttagtaaggaaatttgagggtgcctctccctcatgagtgaacaccattatttccagtgaaaaggggtaaaaagtgatttaccattatacctaactctgccatttccacagtgtgctgcctgtaataatctccatgtcacattaaacatgcgcgcgtgcacaccagtaaagtgtctactcaccttccaggattgctaggaacttaattttacgggcaatgaaaaccagaaacctggtgcatacaaattctgagtctccatgtgcgattgaagaatatttattttcttaagtgattgcaaacatagtcctttacattacaacttagttgtgattcatgccccgtaatggaactgaattaacctcttttaaaagaggatgaatgattaaactgtttttcaatacattattataccttttcttgctcttttgggtattataaataattgtggtttctgaacttattaggtattttttatctgacagtattcagggtctatttcaaatcatcatgtaacatcggaattcaagttatatcacagcctgtgctagaatgaagtcctttcgtactcaacatttaccaatataagtgcatacatatcctgacttgtgatactttttaccaataacaaacgggtagggcgccgcgaagcgcgcctaaagttctagtatatataacaagagagtgtgaagtttttattggattaatcgcttaacttcctatatgtattgaaagttcgataaattcatgttgattttggtttgagtttaggcatggaaagtatggggaattctagtgtcacatgcattgcttaattagctccagctttccaaacatcatgatcaatgtattgggatctcttttcttttgacgaaatggacacatcgacatatacatagaccaatgtatagtcctaaactcctaatgaagcatatgaatgcattcatgcataattaggcagggtcccatgtagctaattcagaagaggtgagaataagatgttgatttaggaagcttacggtgcttcaggacaaaaacttgatgttcattaacatcgtgcaa

SEQ ID NO: 56375 - DNA, 1501 bp, Oryza sativa
aactatttaattaccttacttaattttacctctattttgatcttccaaggaataatctctaattgactttaattccactaattagtattctccggccttagctagctagctgaccggcaggtttagcattttagctatcttaagctgcagcaggtagtagcatatatatgccatccgtcacacgtaaatgggtgcgtaggctaacggctcagctcagccgtgatcccgcggacgtttccggcgtttcggcgcggcgcgtgagggcgagcccgagacgtacgacgttgagacggcccggcgtgtcgcgagcgtttacaagtaaaacccgtagtaaatactccatccgtttttttagtggataacattattaacgttttaatactattttcatctaaaataagtgctgtcatgagaatccgtgttcaatgtttaaccgtccatcttattttaaaaaaattactctctccatctatttttgatagtcatatttttaaatctgaaaattttatttttgataggcatatttcaatccaacaacctatcatcttaatgattttctcgaatttaatgcatgactcttcattcttccacacatgattggctacatgggctttgagaaatgtaaatattaatgaatcgcttgtttacgaggaatgactagtagcatgcttaaatgaatgataagtagaactacttatccttggtctgtgtatcaagatgaaatataactatcaaaagtagatggagggagtataaaaaaataaaaaaaagtcacacataaagaactattcatattttatcatctgctaacaataaaaatacaaatcataaaaaaaattaataagacgaacggtcaaacgttggatataaatagtgtaaaactgcacttattttgggaaggagggagtacatgtttaactattcgtcttatttaaaatatttatataaatttataaaatatacatcatggttaaaatattttgtatgataaaacaactcacaataaaataaattataattacgtaaattttttaaataaaaaagtaattagatgtgtgaaaaaaaacggaggtagtaataggcgttcgatcgagtcgtcgttacggcgtgcgtgacggcgcgcgcctcagctcacctaaccccgggtcgccgtcgcgggccacccggccacacgcggtgcgcgcgtccgatccatctcctctccgtttctctcagctactctcgcctgtacacacactcgcgggtagggagccggagcgagttggctttgttgtgttgagccctttcctgggcctataaattcggcatcacgcccaacgcatcccctccccagaagaatcccagctaccaaatcgaacctaccaactcattcccgatcgatcgatcttaaaaaaaaactaatcgtaacttttctctctctctcctatctttagaactagcaggtagcaactgcttcgagtgtagtctggtgaacgtacgatctttcgttcgttcatcaaga

SEQ ID NO: 56376 - DNA, 347 bp, Oryza sativa
aattcgattgctgctacgatggaatcagtaatacataacttaactcattagtaatccatataagagtttcataacttagcatcaaattcggcattttctagttgtgtgtttctcctggatttctgcagaagtagtatagtagcaatagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaacaaacattacactgtagcttgctcaccactgccggcca

SEQ ID NO: 56377 - DNA, 977 bp, Oryza sativa
ggtgtagacgccgatctccatggtcttcttggcgccgatgagcttcagcagcaggttcaggaattgcccctcgtccgccgacgtcgtcatcaggttcctgcaagaacaacatcgatccctcccaatcgaatcaaatcgatgtcgccgagctccgattcggggcccaagaggaggaggaggggattcgtggcgtaccatgggtggttggcggtgacctcgcggagctccttcatgcactcgtgctcgcgcgggtacacgctcgtctccaggatgtactgcggaaacgaagcaccgagtcagccagtcaggcaaggtcagccacggcggcggaggttttccggcgaggaggggatggccggagacggcgggttacctggtagagatcgtcgctcttgaggaggctcttgtggccgacctccgagtgccgcgtcttctgctcgccgccgctgctcccattcgcctgctccgtcgtcgccgccgccgccgccgacgccgcctcggccatgtcgtgagatctgtgtagcagcttgcttcgatctctcgctcgccggggatcgccggattgacttcgccgacgaggcaacgacgcctcgcgcggtttatatagcgcggcggaagagtgggagaagagcatgtgaactgcagaaaaaaaaattaaaaaatgcgtggaaaaaatctctgaggagagaaggggaccgtggaagagtcgcgccgacaggtgggcccggagtgtcagtgggaggggagggcgggtacagtacggtacagagttgggttggtgaggtggttttgggtcgctgagggtggtgggtggtggacggcgattgggccgtgggcctgattgctcatttactctcctccacgtcttcttcgccggggaggaggaggtgcaccgccaggtgcgtggaccgcgtccatgcggtctcgcggcggctcgcctcggtgagacacataaggagaccggaggagaaggttgg

SEQ ID NO: 56378 - DNA, 1501 bp, Oryza sativa
gtaatctgtgcagttagttatttttttagcctatatttaatattttatgcaggtgttcgaacgttcgatgtgatagggtgaaaaattttgaggtgtgatctaaacacggacttagtcgtcagtcgtgttctgaagggaaccgtatcctctgacgttacacagtaatgtcacgatgcgacattccttcgatccacaccatccattctaaatcaatggtcgtagattatttgacatgcaattaatcaaactaattagtagattgtgtggctataattttccctagatcagatattgcattttcaagaggcaaacatcgttgaccggtggaagaatcggcatatgatgataattatgtttcacttacttgttagatgcagcgatttgcacattatcctggaggaagtgaatcctgtgcatcaattttgtgctgccatcctccgtcaaaacggggcaattctgaatctacaagcggatgggttaatgtttaatgaagatgaagagactgctttagtgctaacaaaacaaaatccttcccacctattaagtacatatacctacataatctgctagttagtttgattagttagatgccaattagtatgtggccgttgatttagaatgaatggtgtggatcgaaggaatgtcacgcggtgaacttactgtataatgtcagaggatatggttccgttctgaagaacagtgggctcgctttccctgaccacatcgttgacgattaggaagtcaacaaggaaagaccaccttgttcagcacggtgatactacgttttggtgttaacctgaacatagctaggcaatactaacacgtccttactatgttgctaatggtcatgggttagtggctaggacttgaagatgctgaaccaataatacatcaaagtgatatcaagacctggatcaaccggtcaaggacggcactactgaaagcaagccgctaccgtgcaaagatgatcctggtggagctcctcctgtcgtcctgtgatcctgtccatgcagctcactcaggcttgttcttgtttactgctagattttggccctccaattctttggcacttttcaccgacgttttctagatatttgaatttgtgccaaattttaccaacaccatgtattaggtaatagcaactttaccatataaaatttggtaatgcctaaagatgccgaaacttttgaattaccaaaattatggtagagaatcaaaccaaaatagccatcaggccgagccaaatcttctcatttcgcagcaaatggtccgggagacccggacagtgtcgagaaagcaacacagtattaatcgcaggaaaaagtacgccgaaggtccctcaacttgtcatcgaatcacaaaatcgtcccccaaccacaaaatcggatacaacgcatccctcaacttacaaaaccgtgcaaactaggtccctcagtggttttgaccccggttttgtcccacgtggcggctgagtcagcgtgggacccacgtgggccccgca

SEQ ID NO: 56379 - DNA, 1501 bp, Oryza sativa
gcctgccggtacagttttactcgtcagcatccccctttttttttttttgaaactgtcagcatcctctctccggatactccgccacctgtgtgtatcttttttcccttggagaaaccgttttgctgataccagcaactgcccggccatacaataataatatcatgtccagatactcctatacaattacaaaatagcttgagaatgaatagttctgctatcaattattcaaaaatagagggtgtaataaacatagagttgtatttatcttggactctcaggctctcagcttaccattttatatattagtttaatttgaaatactctgaaatattaaaatacgcaatgtaccgggcggacgactggtattattactgatcttgctcaaaatggtcatcgtaatttcagaacgaactgatcgttcaaacgttcctcatgttgcgcgtgtgctgcaactactgcacggtaaaagtgataggaatcggtcggaaacagtattaatgtttttattatttttacaaaaacgaattgaaataattggaaattttcatatttatatattaaactattcagtatcaacttcaattcgacgtcaatagaaattagaaaagcataattatacacagtaataggcgttcaagatattattgttattatttagttttgtggaaatggtatcaacgtgatcggaaaattttgtacatgttttcaccctgcgggatatctcaattccttctcctccctctaccgccatatcagcacacgttttagagcaccaatcataacccataaatccgtgggctactcacttatttaatttatatgtgaattcgtgacctgactcactcacatactatcaaaaatttgtctcagtcacccatctccttctttcctggtccgataagggtttatcctacggttcgacggttatcacgatagtcgtgcggttactgaggtataccgtgatttaaaaatatgataaagttaccgcaggttttaactgcgcggtttggtaaacctgttcctcctcaccaaccttctcctccggtctccttatgtgtctcaccgaggcgagccgccgcgagaccgcatggacgcggtccacgcacctggcggtgcacctcctcctccccggcgaagaagacgtggaggagagtaaatgagcaatcaggcccacggcccaatcgccgtccaccacccaccaccctcagcgacccaaaaccacctcaccaacccaactctgtaccgtactgtacccgccctcccctcccactgacactccgggcccacctgtcggcgcgactcttccacggtccccttctctcctcagagattttttccacgcattttttaatttttttttctgcagttcacatgctcttctcccactcttccgccgcgctatataaaccgcgcgaggcgtcgttgcctcgtcggcgaagtcaatccggcgatccccggcgagcgagagatcgaagcaagctgctacacagatctcacgaca

SEQ ID NO: 56380 - DNA, 1021 bp, Oryza sativa
tgcaattagttcttgtgtctggtcgattaaaatttgcttctgtaactggctcatcgtacttaagcccttcttttgagcagtagtaatcttttgtacgaatattcttcgtgccaatgaagtaagactgtttacccttgcggacactaaaaccaattctatgtccatagtcacaatacagtttgtatgcctcttcctcactatggacaacacaaccaagaagctcattggcaacatccttgaggctcaaagcatttccaccatcttccccattttcagtttcttcgccattgtccttcctttgaggcctttcttcttcagaatctcggctactgtccatttctaatcaagaagtgagcataagtctttgcataaacagcatcagagatagctccacacaacttctgcaacaaaaggagagaattgttccacttaaaatccacaggtggtacaaaaataaacacaaaatcgatagaaaggagaaatctacagcatatgcgtcgtaataaaatcccctactttatataagatgtcaaatgcaacgtggtcaattatgctggcagtactagttggtactaccgtactagttgttagagtgatcactcatccactaaactgaagccccatgcaacatgtctcatatcctaggatgttgactatcaattatattggcattcctggctgagaaaagaaaggaaaattttcatatatactacggaaagctccatggtttcactcataatcagactggtaacaaagctatggagtatgcaaatgctggaatctaaacaacatcgtgaaactgggatacaatacagaacaaacaaaaggaccacattccttagcactggtttcatctacaacatcaagcaatcctacttgcttcagaagttcagagtagatttttttttcttcccaaaaaaaaaagcaacatcaattcctcactccaagcagctctacctctaactaacgcaagagtaagagcactagcaattccactaagcgtccctcaccggcttacccc

SEQ ID NO: 56381 - DNA, 1501 bp, Oryza sativa
ttttattatctatagtactttaaacacaactttttattttttatatttgcaaaaaaaaatttaaataagacgagtggtcaaacgttataatcaaaaacttaaaatcttttatattgtgggacggaggagggagtatataatagatatgataaatagatgtcaattgtcctgcatacctcgtagatgtactagaggactaaaggtccattcagcatgccccggccgatctggttctctagctcgcaccacacactacattgcctaacctcgatgacaggcttcgtagctagcacaaggagtgccacatactccctccatcccaacaaaaacaaaccctagtttccgtgtccaatgtttgaccatccgtcttatttaaaaaaattataaaaaaattaaaaagataagtcacgcataaagtattcatcatgttttatcatctaacaacaatgaaaatactaattataaaaaattttcatataagacggagagtcaaatgttggcacgcaaacccgtggtttacctttttttttggatggagggagtaaatgatagtgtaaatcatcatataattaagtacaccccctctcatctttcccttaattaatttctatcctaatctcgtttgcggacacctgaggcaacgtttatgtatgctaagtcaacgttgacatagagttaatcagcgatcgatcactggttgcagatgctagcggcaatatggcaatactgttaggctgcgttcgggagttatagttccctaatcttttccctcatttttcgcgtgtacgcttttcaaatggctagacggcgtgttttttcaataaggaagttgctttaaaaaattatattaatctattttttttaaaaaaataacaaatacttaattaatcatacaataatagatgcttcattttgcgtgctgggacaatccctctggaacacagccttagttatatgcagcacagggcagggccacgggacatctatatatgtatatgctcaaaaacatgagttttatgtccaaacaagaaggaaatatttgcattgacaaacacaagacccccgaagaaattaggatgactcccacacgggagtggattctaatccctcaaggggatatcccctcgtatatctttttttttcaaattcgatgtaaatagttgtgaaaaattctaaaaacaattgacaatgtagagtataatgatacctattagtccaccaaaattcatgttcaaattcgatctacacatcgagaaacaaaaaagacaaatttagatataaacagtgcactactattcatacgctgaatttgtcctttttatatctcgacatgtgagttgagtttgaacttaagattttgtgaagttgtatatatgtgttgtatgaatgttgtcaaattttttcagaatttttgataaccgtttagatggttttagagcaaacgaggaaacatcccctcgagggattagaatggtttcccctcccacacccacgatgcaac

SEQ ID NO: 56382 - DNA, 1501 bp, Oryza sativa
ttccaacctactccctccgtttcacaatgtatgtctttctagcattgcccacatacatatagatgttaatgaatctacacacatacatatgtctaaattcattaacatctaaataaacgtgggcaatgctagaaagtcttacattgtgaaacggaggaagtagaacttttggataaactagactatggtggttaacaactaaaactggattagttatggactattgactggtttgtcaatagatgggtgataaaatgctttgtacaactaaaacatatttttgggctgggcttggggtgcaagcaggttattttggtagtcacaccccggctaatataaggaccggtcttcgggcctctgttgcaaggcatcttcgtgcaaccacaagtctagtgggtaaggcctgactagaagtttagatcttctcaaaacaaagaccattggttggaagcgtgtggggcctggattaaggccaattttcactcggtgcaaggggggacctgtctcgtcctgggggatccggcatcctttaccttgtcggggaccggcgggcggcgaaacctcagcgggttctcctgttttgggtagacctagatggatagtcttgtcacgacctctattcgagtactgtgatagtacccggtgcgtggtaacgtgtgttgaggttgtgtcttgtgggtaaagttgtacacctctgatcagagttaaaaattattcgaatagccgcgccctcggttatgggcaagctgagcaatgtacccaaagttagttttgttttataaaaccttgggagggtgaaatcatgatggtgtagtcatgtggagattagcctgggttaagacaggttcgcaggctcatgcgaccttgatgatatgaaaatattggcttagaacaggatcgtgttttagaatgagctttaacctgattaaaatgtttaaactatggctttatgcaaaataaaccctattaggccatttccttgtttaccctatgcattattgttgcatttccggtgtgacttgctgagtacggtggtggtactcagtcttgctcacaaaaataatccagaggatggacctgaggaagatgaaggcttggatctctagttcgctccgccatcaagtgcctgttctgtagtcttccgctgttttatttgtttatctttgagtgtgagggcctaagtcgcccatgtaataaagtacttgctttacatttccgcaagtgtggcttgtaataatcaacaatgtctatgtgtacctcgccttctgggacgaggattaatgcactgagcgtttggaaatggtgtatatttccgggcgtgacaagttggtatcagagccaccttgaccgtaggatgagcaagtggtctaagccttaggatgatattttttttttagaaaatagttctttaattgtggaaactttttttattctatcttcaccctctcttgctttgcaaaattgtttactaattctttgttctgtttttttgaaaaataga

SEQ ID NO: 56383 - DNA, 1501 bp, Oryza sativa
agtgttattttgtcatgcctaggaccagcgtatgaagcagaggataatggagaagaaggtagaaggcagcaatggaaaaaaaaaaatcttccttcttcttctccatctttttcctccgagcaagtcgtcctctacggcgaccccaagctcgtcggcaaaccgaggacacgatcgatttccatgtgaactggccgctcttatttaccagactttggaaatgatcacatgaatatattttgagataatctattctattttgtacaagttcaacgattttacatcgacattgtctctttctataatttaccggcgactttatcgaaaatacgtcattgggttgggtattcttttcaaaaatacccaaaataccctcatggacatacaaggttaacaattgatttatcatattagaactttcaaataatatgaaaacttttatgtggccttctttacacaacatgaaaatttagtatatttaatatctttacaaaactaaattttcataaaactaaatagacctttttagaccttttgatttgggataaatcaattgttaaccttgaaaattttgtaaatttttttggtatatttacaaaactaaatataccaaaaacaaattccataaaacttccacgttgtgtaaggaggccacataaaaattttcttatttttttgaaacttctaacgggataaatcaattgttaatcttatatgtctctaaggctgagttcggatgggggagatgggaacccaacttctgcgtacggaaaacggagcagtccattaacgcgtgattaattaagtattagctttttttttcaaaaagggattaatttgatttttttaaacaacttttgtatagaaactttttacaaaaaatgcaccgtttagcagtttgaaaagcgtgcacgcggaaaacgaagggaaggggatgggaaaaggtgcatgcgaacacagcctaagggtattttgggtatttttgaaaagaaggtctgacccaatggcgtattgtagaacaattgataaagtcgccggtatattatagaaagagacaatgtctatggtaaatcgttgaactcaaataaactcagtggtatagaatagattctcttgaaaattagagaccccaacactagtacagttcctcttatttgtacagacccctactctagtacaaaccccatacatgcttgcgttttgtgggacgtcacaacgaagtcatctcaaacagggcaaaaagatgcctactcgcacaaacatgttagatgtgcatagagcccgtcacggatgacacctattagtgacgggacccaacttgaggcctgatatagagaaccaatgatatctttgtgggccttaacagaagcccatcaccgatgtccatcattcgtgacgggctccaacttgaggcccgattgagataactattaggtctgtcaccgatgtccatcatccgtgacaggctccatcttgaggccggattgagataactattagaccc

SEQ ID NO: 56384 - DNA, 1501 bp, Oryza sativa; identical to SEQ ID NO: 56383

SEQ ID NO: 56385 - DNA, 1501 bp, Oryza sativa
gtgtactaggtgacatagctgagacgtgtactgagaagaaactgtggcggtttatgtgtacgtggctgttagttctatggttttgagattacagcgacgaagcgcgacacgtattgaagttggtggtggaaaaacagtgtaaggtggtgtttggatacaggtgtccactaatttaaaagtattaaatataaactatttacaaaactaattatataaatgaaagctaatttacgagacaaactttttaagcctaattagtttactgtaacatcacataggctaattatggattaattaggctcactagattcatctcgcgaattagtccaaaattatgaatagattttattatagtctacgtttaatatttataaaagttttagtcccatataaatagggtctactatagaattagagatcagatgaattgttcaaaatgaactgttgcagagagcagacccgaaagcccgatcctctgcatattagtgcagaggttcactatccatgtgagtattacagtagaccaacgcaatgaacaatgttaatttactgtagatacagaaccattaacactctgtcgcactatttttttgatcgggtggctgccaactcacctaatgtatggtactcctaacatatatactagtgttatctgactaatatcttagtctttaatcatgaatgcctaatatacttcttagtacgatgaaaaatcgtatgattcagttatgtaatgaagcaaaattatttttttatcgacattctccaaaatgtacggtgtccttgtgcctttagctcggtgactaaaattcttggatacaaccctatgattatagtacttgcgtaattaaagacaagctagtttgatatatttgttcttattatgatattaatatcatcagatatattttctctactagcataatgcacatacgttacaacggattttttaaattaaaaatagcccattatatataattttattaaagtcttaaaaatatgttatctacttagggtttgtttgtttgagatgtggcttttggaaaagtagctatgagttgtgggcctgtggctttataaaagcaacggtggaatatggtccctgccttttgaaaaagctcgtttggtttaacaactgtagcttttgaaataactagtcctgctgacaaacgggcctcacatgtcatacacacgttgaaaaaaacgagaagaggaagagatggagatggccatcgccatcgccgttggcctcggcggcagcagcggggaggcagacgtgcgcggtggagtcggtgcggctggagcagcggcggccaccatgcctgacgggcgaagggggcggtggccccgggagaaggaggcagtggtgttgccaccgccgttgaccacctcacctctctcgtctcccacctccacggccgacgggcgaaggggcggcggcaccgggagaggagggcatcagccggagatggcggtggcggattggagggggaaacgcggc

SEQ ID NO: 56386 - DNA, 1501 bp, Oryza sativa
gctcctccatcgacagtggcaatggtggccccaggttcttggaaacctaggtcatcatcgccatcatcgatgtcctcggcgggggccttctgcctggcctcacttcgccgacggccggaaggaaccgccggggacttgccttcccggcgctcctgcctcctctcctcctcccacttccttgtccgctctgccaagcttttgactgcgcgacagtccgcaaggtcatggagggaggtgttgtggacggtgcaccacttgccggtagggcgctccctgctgggaacgctggcctccttctttttgtcgctcgcaggcctcccctttcgggtggcccgcgaagcgccctcgacggcgaggacatgaccctcgccgtcggaacggactgacctctttttcctcctcctgtctcgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacctgacagaaccgctgaatgtacgatcgaagcgactcatcgtcccttcgctgtacggcgtgcaagtccgcttcctcaccggggcgcggatacgtgccttggaagttcatggtgaactactggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcgggattgacgctgccatcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacgacgcggagccggtggtagcagcaccagaggccttggtggcggaggaccggccaccagcatctaggcgccgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccat

SEQ ID NO: 56387 - DNA, 362 bp, Oryza sativa
attcctgcagccctaatcgcacggtgggtatgttactgtactgcccagatcggtgaccgtacaagccggagcgggtcggatggcatcggtcttatccgcaaaccaaccaaccgactcccccctgcgtcgtttggctggtgtgccgctcacgttctcgcttgtcctctttcgctgctgctgaccccagcagccacgaccgcagggagcatgggatcttcagtgccgtcccatgtgtacaatgaatatgcctggcctaaataaagcctgaaaatcacattgcaaagcaagtcaaattaacacagtagtaagcaggtgcggtgagagattgtcttggactgattttgtgtggtgtcttgtgggtt

SEQ ID NO: 56388 - DNA, 1501 bp, Oryza sativa
acagtggtagtaacattatgagtgtggggaggggcaaatcgttcggtttctcgagcgctactctcctactctcgatcgatggaatgagatgactgaagaatgacaaatctgtttttacagcaatagagatactaatggtaggagtacacctagcattctaccatgatgtatagttcacatgaatgtttatgtgtatgaatgaaagtattgtaaaattgtatattaaaatgcgccaccagtaccgacgtaatttaccctgaaaaatgtgaggaaaaactagaaaaaacacaaaaatggcatatgcgctttgtgtcttgagttacattttgggcaaatccatgattttgttaatgttattattccacctggactctctaaagccccataacaagatataacatggtatatactccctccgtctctaaatatttgacgccgttgacttttttaaacatgtttgaccatatgcctatttaaaaaatttaattaattattaattctttttctatcatttgattaattgttaaatatactactactactcaagttttaaataatattcagaaaagtttttgaataagatgaacggtcaaatatcttttaaaaaatcaacggcttgaaaatattttaccacgtaagggaaaacgaaaaccagaacgtatcaaggaaccattaccttcttttaagatcaatgatatcatgtgggaatattgcttttccatgtactgctaaacttttctttgagaggtgcacttctaaacttgatgtacgcaatcatctgatggtgtgggtacatgtaccatgtatgcatactactttttcatacccgtagaaaagtggagtaatacagatgcctttctcattttcttttcttttccttttgtcctcagaagagagagacaagaactacccccggttatggaatccgtgtctccgccggcccatgtattcttttgggcccgagcctgcagttatttcgctcgccccacgcgttggaccaccaaaaccacccacacaaaccaacccggaaaaagaaaacgcccccgtctatttcccttcggttttatactttttcgccctaatttcttcttcgctttgctcgggcgaaaaaaaaaagagagaaaaaggtgggaaaaatataattcgtgaggcgccggaacacgtccacttcgtcggcggcgaccaccccggagcataccggcggcgagggggaggaggagaaagctccccgaggaggaagaaggccgaagctgcctcaggtcgccggaaccctaggattccccggcggaggtggaggcgcggagagggggcgtcctccagatgcggccgtccgggatttgaatggggggcagatctccggggcgaaggaggcttctagaagcgggctgagttgaaaacctagggttaggtttggtggggttggagctttcgtgcttggtaaccgggatgggtcggagctcgggaggtggaggaggaggaggaggaggggaaggggaggggt

SEQ ID NO: 56389 - DNA, 1501 bp, Oryza sativa
caaaggatatccaccggacatacccacaagatgtcactcactcctattggacatgcccacttctcttggtttaggacttgagaaaactcatcacacttggttagacaagcccacaaaatgcacctacatgcatatgaactaatatggcacaagatcatccacaagctcgcttcatagacccctcttgatagtacggcgcctatctagcaaatccagtctacaccaaacaccaagaccgggaaaagactaagaaaacattcttagctacattatacctttgccttgcgccatccatcttggggtcaagcttgagccgagatcaacacttgtgaccatccggttgaaccatgtttatgctgaggtcttgtccatcctttgtcaagactttattctcatcacaagcttgacttcattcttgccaacatgacgatgtccttggcttggtgaccactaacccatggtgtcattcattagcctcatcgtagtgtgacctattccttttcacacctcaagggagaacattagtctcaacaaatcagttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaatatggatctagaacatgcacaataaatgtataggatttgctccccctaaatatatgcatacaaataaatatacaagagatgcaagtgtatgcacaattagagaatgaccaatgggggtttatcctatacatatagagaaggcatatgtagtaatgatgtagagcaacataaaacatataccttcatgatctccatgttctcaatgtaaatgagactaaataagataacatttgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaatatcttttaatcttttctctctttggtgatggataataacccgatataaacaatatagagagatgagatgaaaaatgatttcaaatcaagatagaaattttataataaacaaaatatagaataagctccccctcaagatgtgcatacatatggatatgaaggaacgcatatgcacataatcaataaagatcaaataggaagctcatactatattttggatccacaagagagaccaagttagaatatgtgaagtttaatacatacctctcatcatttttacttccatatccaaatgagactagtcaaagaaag

SEQ ID NO: 56390 - DNA, 770 bp, Oryza sativa
ttgcaagttattagttggttaggctgtaaataacttggtgattctcacattaacagacaaccactcagattttcaataatatttccatttgttactcatgctctgaagataatcaaaattttaaatatcctcatccatttattctcagagaactaatgattcaaaaactgccaacaccaatatagctccggtttagcaaatctctgtttttttacagatcacaaatacctaacagtaaatttataagtctgtgtattcatctaactggtataaattttgaaattatctgtccaaaattcttcaagttgcgttaccacattttgatgcatatgtatatggaatatgctgtctgatatatcactcaacatgattgttttttgaaaaatagttcatcagtatgatgttctttactgataacagtgccatgttattaagggttgttttggttttaagccaaattatgccctaccaaattgttggcattttgaaaagttatttggcaaagtttggcttgccaccaaagttggtcaagttttggcactaccaatatattgacatggtaacaaatcaaaacacccctaattgtgttcatcctaaccaagtgagttagcccttctagttagctaggagaaagcaatagaagcattcagttcgatatttcctatgttccttgccttttttgtgtgttagcacattccacaatgttatcatcctcatgatgttacccttcaacaagattgtagcacttaaatatcttggttgtggcacta

SEQ ID NO: 56391 - DNA, 1501 bp, Oryza sativa
taagatagacaaaatgatagatcaattgattaagagaaacatgtggatatataccaacgataacatataattggttagaacacgtggtaggttttcttataaaatttgtagaacccagtttaatttatttcttttgtgaaatccatacattagaaatcacttgtaatcgttggacctatgtcgatctcttgagcatgtgctaactgctaagggtgcgactgtggcaaatgtgtgcatttgtgtctttcatttaatcgtaaaacatactttggcaaaaatggatatcctggtaagttgcaacaattaaaagtgattgaaatggtcatgtagcggttgtcggtgctagaatttagttactgttaagaataacttagatttaaattcaaattatataattttttatatagtgttatgaatcaactgaatgtcggttcgtgttcctatttgttactgcaatgttcctttattttacaaccacgatgttttctgatttattttcaatgttttttcttatttatcattaattgcaatgtttataatggattattttattaattaatgtatttaatatgtcgaacctttgaaaaatcacatctaaaccatatgcatgccaaaagtttcagtccaaaattttaaaatcgatttttcttcaaattagtattggaaaccattactagaaaaagcattttttagacatggggtttttttttcaggtggacatgacccttggagccaaataaccgccaacaaaaatttaaaccggggtgatgctcgttgtttattttcgcaggcggaccacttatccggtccgcctacaaaaataccctttatttttgcaagcagacctttgcgaaaattggcgtggaatataaatagaggcgacattgggacgattttttctaagtccgatttctccctcgcttctcctctcctctcccgttcctccccttccccctaacctccacctcttatctcctctcccctcccctcacctcacctcctctccctggccgccggccggaggcggctactgggcggtggcggcacaccccgacgcggtggtgcgcggcgtgtgctcgcccgatggcagctcccctccctccctcccagatctagccggagggggaggggggaggccggtagcggcgcggggtggatagcggcggggcgcggcgtgtgctcgcctagcgatggctcccctccctccctcccagatctggccagaggggggagggggaggccagtggccagcggcgcaggttggacggcggcggggcgcgtccgtgcggcggcatgcagcggcggattgtaggatcaaggaggccgactagagggggggtgaataggcggttttaaaacttaatggcacttaaacaaaactaacctaagttgctaggcaaggtgaggtgcaaggttaactaagtaactaagttaagttttgcaaacctaagtgatatgggctcaaatatgtctctatgaatgtaaatagcacaaatgtaaa

SEQ ID NO: 56392 - DNA, 1501 bp, Oryza sativa
gtaaactctacctgatcaacagaatataacaggtattggttaactatgttaagaaggtaatataactgtactggcaatccatagttcatgcaggattgaattcacattgcatccaatgatgaccgcaggcacaccacgaggaatccatcaaacgaaacagaaaaggaggttacaccattaatagaagcacttagaacggcgctgttcacatagctgcatcattctaagaaatgattccataaccagataggactccagtaccaaaagattaatttaacatagatggataaaaataatgtagattatctcagcaggtgtcatattgcaagcaatgcaacctaaagcataaaacaattgcctgttgtgaaagaatgttatataatatcagttactctatatggttcaaatcccttgatccagagctagatatgagtccatcacctattagtaataattatttaggcaatctcagtttaaacttcagaaaattctttgcagacgaaatatacgcatattattaattcacaatggaaaaaaaagcaaagtagtagttacctataacatcattaacagctacagcaaaatctgaaggtgtgatcgatgctacattattgacatgcagcctgcatgcgtatcgtggtcatctgtctattttacatgcacttgtagctggataaacttacagtgtctgatgcttcacaatttaagtctgagggaaggtgctgaaactcaaggatcagtaccttgatgggtaaaaccggaaagatctagaacatctggaattaagcagaccaagaagagtgcacactgcacagctatatacaaatacaatcaagttcaaattacagatactgatatctacactacataatgcaagattatgtgctctttgaatacttgaagccttgtaggtagttgtatgtttagtttctcaaagcataactgcagcagtacaaatcatagaatatggtaagaggcagaaagcatgacttgcatttctcaacttcctatgggtgaataacatcaaagatgccaaattcaaagggtgtgagctttccgtctttctcggctatgtctcttataataacaataacaatcatatgatagaacttcactttgacctttattatatggtcataaagacccttcagcaaaatgattgttactgctatcggcattttctgttgtttttcttttggaatcaatcttgtgtgacaccattgtattgtttcatgtcttgccactataatagtcttggcatagcactggatctcatgagtctttgagccgcaaattcatgaacataagttctttccattcaaccgttggctgaggcaaagatacaggtatgttttttccagtgcttgctactactgtttgcaggatgcaaatcctaattagcattggtttatgtttctgtaaattagttgttaagttctatagaactttcaatcatactgaatttacagttcttacttttagtgatcagcttataataaat

SEQ ID NO: 56393 - DNA, 1501 bp, Oryza sativa
agtccagtctttggttttctcagtttggtctttggtcttgaccgagtagaccgaagtgaagaaacttcaacaaaatcagacaaacaaattgaacgaaaaaaaaccacaaatcgactaccacatataaatgaattagagcgaaaaaaatgatctatgatgttctgtgttttgttgtagggatgccagagtggctggggagacacctgtcatcacggggaggacagtagcattatgccttttagcacagggaggctagggaattatttgtcgttgtggaccacagcggaggagtcggactggacctcgcaaaggcaaagcgccttgactggtggtggaggcgtacgtagttggagatagcagcgccgccaatgcacgccgcaagtagcagccttgcaggccatgggatctcatgatgccttgacatgaggcctagcgccctgacataggtaggagtggcaatttccaccagagtcgaggacgggaaatttggtcccatgggtggattgggacagggccccgaggtaatatggggtggggatggcgacatgatttggaatcataccatgcacctatgttggcccgatagccctattagaggagttcacatacatttggagaaactctaatcgtgttatcatcttgttcccttaccattgccgcatgccaagtggatacacgactcagcttctgctatgctcggtgactccgtttcattgtcgcacccaattagaggtgggcactcggtttatttggtgttctataagttcagtttctcaaaatttctacctgaatatcctcattagaaaataaaaccgagaacaataaacctcattcaatttttgttttataccgaactttatggtataaaacggttagtatgcacacacgtacaaatgtgcgggaattattaaattgactcctgcaggaacatattttttcaggtctattatttagttgactttcatttagttttgaatgtacaagaacttattaggatgatgatgaatcatgccatttaccatttccgtaggtgatatagtatggatatagctgccaattatgtctcttttcttttgaatggtagtaattaatttgtttataatgaacaagacagtttttatctaggaaattaaagtttttccaaagacaaaatagaaaagatattgttataattaatgtgttcattagtactcattattatttcatacttataaacacatttacccaattatatattggtggtcgttctcctttgatagacacttcgaacatctatcccttgcagacagagtaaacatttcacaaacagttggtatgcaatgatatctctcatgctttttttatccttttatcaatgcatgttattgattttgtttactgttcttgcaattgatatcaagaggatgattttgtatctcttgatttgactgcatatatgttctttttacataaacttgatttgattatttttgtttgtttggattgtgttctaacatgaagt

SEQ ID NO: 56394 - DNA, 376 bp, Oryza sativa
tcgaattcctgcagccaaacgtatgatttcctgatccccatgcataatcaaagtagcaaaccatttattgatcgcgttgcacgtacacagcaatcagaacatatactacctctatattttaatgtatgacgctgtagaccttttgtctaatgtttgataaatcgttttattcaaaaaaattatgtaattaccatttattttattgtgacttggttcattatcaaatgttctttaaacatgacataaatatttttcatatttgcactaaaaaattgaataaaacgaatggtcaaacattggttaaaagtcaacggcgtcatgcattaaaatatggagggagtatcaactgcatttccgaacactccaaactacagag

SEQ ID NO: 56395 - DNA, 1501 bp, Oryza sativa
tgctgtctccggaggccgaactagactggacttggaattaacattagagcgtgtgaagttatgagcgtatccgacgaagtgatgttctcatcacacaatgacctaatagtctagtgaataaagtcgagcacacataagggtatattttatccggcctctatatccaaccagatatatgcagccatttaaattagtaacttagccccacaaatgacctaacctgaaattcgttcatatgaagatttaaactctcctatgaatatttgaactcagggccttggggtgctactcagatcattacaaccactaggctacatgcaatttcataacttttgtcgacttagtcacataatttgaaaagagtaagaaattgttcggcatcaccttgaaacggatcatgatctcctggaggactgcttttggctgaaacaatacgtttaagagaacaaaatgactgagttgagattttcagacgctgccatatcctacctatgttaacaaagttttgggaacaaattcaagtagcaatgtatcacattgctatcatagcatggctaatcaagaaaaaaggggagtaaattcaactggaggaaattttacctctcattagcattaacacaatacatgtttatgccagccatcagcccaccgtatgctgggccttggaacgacgcatgctaggccacagcccactatatgctgggcctctacttagctatgacgaaataatttgttagggcattcccaacccaatgactagaatggtgtccatagcattaaataagctgccacctaagatgaaaaatgacgtgacaagtgaataaatgagaaaagagaagaaaatcatgtcttacatgagacatgatttctacacaacatacaagacattatgtgagataagtaacattaaatttaagtatggaatagtagtgtttgtattggaagagtagtgtctagtacgagttttttgatgatgtggagtttatgaaaactatgtctagtgtcttgggttgggaatgcccataggaatggttcgccaactcagcatatactcccctgtcctattttattttaagtgcaaacatgagtttccacgctcaactttaatcgttcattttatttttaaaaaattataattagttttttttgttgttatgagatgataaaacatgaatagtaatttacttatgtttttaaatttttttaaaatttttttaaataagacggacgatcaaaagttaggcgcgaaaaaatagactggagggagtaccaaaaaccgcaaattgcaccacatcgggtctacgtcatcaacttgcttgtgactaacggtactttcttttcttttcttttttttttgtcacaaaaggtaatcccagacatgagttttaacggcgcccttccgtcagaaggtcatctcagaacacagtttttatgagatttggcaagttcttgacggaagtactttgtcaaggaatgacagaaaccgtggtagtgatggcct

SEQ ID NO: 56396 - DNA, 455 bp, Oryza sativa
agagggatgctgcgaggcggtgggggaggcgcgcggtcgcgaccaccgacggcggcggtgcggattcgttcagcgatttcgccagggcgccgtcgaggagctaccagcacgacgaccgggacctcacgcccgtagaggtaagcggggtttatttatctgtttatagtctgttccactgttattttgcactatcattcaacatagtccgattgctgatgctatcgttggaattgctggacactttttttttttaacgaacaagatggacacttttgtgggcaggtgggatgggaggttaattgaccgatcagttaattgtctatatttgtttatttacctatttacagttagatttaatggtcgatgtttatcctacatgagctgtttcgtcatgttgaaattatgtgtaatcaactaatcattatctagagttacttgattaactgagactttcc

SEQ ID NO: 56397 - DNA, 1501 bp, Oryza sativa
ctagtcggcctccttgatcctacaatccgccgctgcatgccgccgcacggacgcgccccgccgccgtccaacctgcgccgctggccactggcctccccctcccccctctggccagatctgggagggagggaggggagccatcgctaggcgagcacacgccgcgccccgccgctatccaccccgcgccgctaccggcctcccccctccccctccggctagatctgggagggagggaggggagctgccatcgggcgagcacacgccgcgcaccaccgcgtcggggtgtgccgccaccgcccagtagccgcctccggccggcggccagggagaggaggtgaggtgaggggaggggagaggagataagaggtggaggttagggggaaggggaggaacgggagaggagaggagaagcgagggagaaatcggacttagaaaaaatcgtcccaatgtcgcctctatttatattccacgccaattttcgcaaaggtctgcttgcaaaaataaagggtatttttgtaggcggaccggataagtggtccgcctgcgaaaataaacaacgagcatcaccccggtttaaatttttgttggcggttatttggctccaagggtcatgtccacctgaaaaaaaaaccccatgtctaaaaaatgctttttctagtaatggtttccaatactaatttgaagaaaaatcgattttaaaattttggactgaaacttttggcatgcatatggtttagatgtgatttttcaaaggttcgacatattaaatacattaattaataaaataatccattataaacattgcaattaatgataaataagaaaaaacattgaaaataaatcagaaaacatcgtggttgtaaaataaaggaacattgcagtaacaaataggaacacgaaccgacattcagttgattcataacactatataaaaaattatataatttgaatttaaatctaagttattcttaacagtaactaaattctagcaccgacaaccgctacatgaccatttcaatcacttttaattgttgcaacttaccaggatatccatttttgccaaagtatgttttacgattaaatgaaagacacaaatgcacacatttgccacagtcgcacccttagcagttagcacatgctcaagagatcgacataggtccaacgattacaagtgatttctaatgtatggatttcacaaaagaaataaattaaactgggttctacaaattttataagaaaacctaccacgtgttctaaccaattatatgttatcgttggtatatatccacatgtttctcttaatcaattgatctatcattttgtctatcttatctacatatgtctgccgtgtattttcaattttcaccccaagaattagaaattagtacattaatcagagggggcaaaaggcccagtattgtcaatcatggtgggtctagattataactgtatatattgactaatcaaaataattatatgtaaaatactaatgcatctatac

SEQ ID NO: 56398 - DNA, 168 bp, Oryza sativa
tattcagtgatcgagagattaagaattgacaggccatgttatgtttaattccgagctctgcaacgtgcatgcatgcgtcgacgtctcgactattaattactttattgtatttgcatcacattttggccggtatgtatatacatctgcatgttccggcgtgtacgtaga

SEQ ID NO: 56399 - DNA, 1501 bp, Oryza sativa
agctgcgggaccatcgcgggacaggtaaatttttgcaattccttcctatgcatgtatataaacgtaaattattgaaaaaataagtatattcgtaatttttttctaagtatagttagcatattatgacactgctaagcatgttatgataccaatgaactttttttttatacgccgcttattgaatcatgcgatttttcattgtactaagaattatattaggcattcatggttaaagactaagatattagtgagataacatttacttctactcatccttttggtattccctaaaatgacttgtacaacaatatcatcatatttaatcttcaaaacatacttatttctcttagccaaatggttctgtatctacagtaccgttcattgcattgatcaactgtgacgcagaggatccggattttgggtctgctctctgcaacggttcattttgaaccattcattccatatctacttctctagttatactgttttttcaccacaaacttcaatacgtttcatgctttgccgctgtaatctcaaaaccatagagctaacacccacctacacataaatcgcctcaatttctttgtacgtgtctcagctatgtcacctagtacacatgctcaggagcaagacagcagtgtttcccgaatttttttgagaattaatattatttttatggaaaatcgcaaaagtagtggccaacgggggaaaatcgcgaaagtaggtccctgtcgaacgggtgcaattcgatagggcacctatcgaacgacgggcagtcgacaaaaccctgtcgaacggctggcgttcgacacgctcacctgtcgaacggagggagttcgacagggcccaccacccggcgccgcgaggcctgtcgaaccgggggcgttcgacatggccctccaccgaccctgtcgaacaatgggcgttcgacaggccggtttaaagccccgtccacccaggccgcgagttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctctagcagtgaagttaaggtatacattagtaatccataagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttatgtgttaaaataggtacaaaggtgttatattttatttggattattaaactagttgtttgttactaatagttgtaaattagtacacgacaatgtagtataagttgtaatagggtaattatgaatgattaaatgattaaacgtgagactattttttcattttcatcaagga

SEQ ID NO: 56400 - DNA, 1501 bp, Oryza sativa
ccaatggctgccccaccgtagagcccctgcctcacacatcaagaaaccactatgcatggatactgcctccgctcagctatctaatccgctaggtctatacccattcgagaagtacggttgtacgagggtcgtttcatgcttaacttcatggctcggtccttaattgaccagggacggcactagccttttccggacaccacccaagtcctccagccgccccagtcgaaaacagttgttttactttattttcctttcacaaatcatgtcatcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcatcattgcatgcaattttattggtaaacaaaataatttcgcaattgggatcaacatgttcaaagaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaacctacatagcatttatgggatacatatatatttggctaatcagtggtttagtctatcaagtggctatggaaggattatggctaagcatgcatctatctacataggacggttatttactagaggttctgttgttagatggatttaggatcaatcaaatagttatagtgaatcatttgtattattattttattgatggaagctttactttaattatgaacatattttacttgtcacaataaattataaaaggttaataattatccatgctttgtatgttagagttgttcaggttaatcatattatgggtacagattatcccatcacataattttacaatgaataatcctaatttacagttgaactataattataattatatgaggtcaagatttataactagtatttatctaatatacatgtttgtcatactctccctcttaatttaatttatgcaacacgcaaattaatactataccgtaccactataatgggatgtatagtatatgtgtaagcaacaatatcttattattggatcatatatttgagtagttgctttttactgtaagctatacaatacatgttaaagataattatgctactgtacaatatccatttttattcattggcacactatttaggttaactattatctaatcatttgatattaattaatttata

SEQ ID NO: 56401 - DNA, 295 bp, Oryza sativa
tgaagaaaagataaatacaagagttttatgcttttggaatagcttcaacggggccgttcggtggccataggccgtgccatcaatagtgtgaaaaagaatctgatagtagctagctgcggcagctagaatcctgattatagtccatgagagtaaggataataacttagccagcagccggctaaaagtcactgccatgtcacttagccatgctctaaaaactcacctgtataatgggttggctataagttgactgatacattacctaattaaaacatctaagcaattaatatatgca

SEQ ID NO: 56402 - DNA, 1501 bp, Oryza sativa; identical to SEQ ID NO: 56360

SEQ ID NO: 56403 - DNA, 179 bp, Oryza sativa
cggcacctacccatagcccaacgtcctcctccctgaagccacccacgtcgctttcttcatcatcttcccctctctattgcggtttgcgacaaggcccacgagcaagaatgggattgagcgagggtggcgacggtaacctgaggcctggcggagtgcgacgatgccaacattgtcgaagg

SEQ ID NO: 56404 - DNA, 1501 bp, Oryza sativa
tatggattgcatgtttgagaagcatcatccctttggtcccagaacgtatttgggaagattgtttgcccacaggatcatatttatatgacctataggctttggttacaaaaacagaggagtgaaaaaaaaaacttgctgattcagatccaagaaccggttcagagcaaattttccgctggtttttcagacaaaaagagttttttttttcatagagactttagggtagaagatgcctgaatttttctctgatatttatgggtattctacatctaatatttgcatagagtagtactacgtactttggatttataatctcttttttggaaaacggtttgtgctggttgtcttgtctgaaccctgcttataaccaggaggaatccaggacaataacatctctctacgatacattggcagatcaaatgtggaaaaaacattaccatatgtgtagcgtggttcacatgccgacacagcctccatgagctggaatagaggacaatgtcatttatgcaaggaaactgaagtaaaaataaataaatgtagcttaggtatgggttagaaattaaagatgttcaccattcgtttcaactcccaagtcccaaccattcataggctactctgtctttttgtgaagtaattacatgaatacactgcatactctctttcggtgaaaaacaaccatgcatttccaaataaatggaggcaataaatacattccaaatccaccagacaatttgagaggcaattacttaaattgaagaaatagatggtcaccgaaaatgtgagtcaaaatctgggtacaatgtgacagcaccaagtgccaaaattttgtaccttcctgacagttaacacattcaccaaacctgcaagacatccaaccaatccaaccttattgtcctacactgtgggggcaaatcgctcacatgcctgcataattgcaaaccatattgattgcaacagcccatgtcaaggaaagatagcccctatgcctttattattgttccatacacttgtaagtgacagccatgacatgatcaccaaaaaagggaaagcaagtcaataacaccaggtacctatcctctctgttcttggcatgcctccattcttgtgccattcccattcatcgtctttcttgcaggtcttcagaagcaggcagcaagaacagctgcaaccatgagtggaggttcaggcttccctggcttccacaaacacggctacgatcgcgactacgcgcgaccgctgttccgtgtgtcgtcgttctccgacaatggcggtggcgaggagcaggagcactatacgccatcgccgccacgagggagaagcatgagccgcacgacgtccacggcaccacgcctctcgccatcggtgagcaagctcagcatgaagaagctgcagcaagttgtgaacgagaagtccctggaggatgaaggtatagatatgccaacctgttttgatttctggtagtgtcctctggtgtttctggtggttgattgatgggtgttgt

SEQ ID NO: 56405 - DNA, 424 bp, Oryza sativa
gataaggaggcaggcagtaaaaaaaaatatctccctggatctggcccagtagagttcttttggtaaatcctagtactccgctagactttctagtttctagtttctacaggtaccacagatcgattgtttgagtcaggagattaaacaagtcttggttatctttctgaagtgttactgaggatgcccatatcaagagtcataaatcatgtggaagcatcaagcatgggagatctttactagttttaagcatactaactagaactaccatcaaactccttacggcaagaacacatgtaaagctccatagtccataaaaatcagtctgaaacataaaaaccaggctatataaccacggaagacaaaaaaaaaaaaaaaaaaaaaaaacttttgcgcgtgttcagagcctgaaacttcagaccaagca

SEQ ID NO: 56406 - DNA, 1501 bp, Oryza sativa
tggttcatcaaaattataggcaacacaatttttttaattgtccatcatgacatccttcttccattattattccattatatgataataaaactttttatggtgtttggtagctacttagatattcagaaatgaaacaatgtaaaccattcattaagatatgataaggtacgaaataaagctattctagttttatctcattattcattgtcgaggtacctatttaggttacgacaaatgacatacgattagattttacacatcgaacaatagattcactctcactttgttaacgggcctccgggccggaagtttcaaaaaagaaaaaccaatcccaccaaatcaaaatttaaattttttcaattcataataatcccattaataacaagggtggtggtagataaaagatcccacccattttcattttcatgaaagaattaattcctccaattaacatccctcccaatacatacaaccactccaccagtccatcatcagtactagtactaaacttggaaaaaaaaacaagaaaaaggtgagcaaaacatttttctaaacagaaagcaaccaaccgcagtccacagcacacgtgggactctgaacaacttctcctctcttctcttctcttctcttctcttctcttctcttccatgccaaaattggattttttattttggtctgcctctttctttcccccaccttgacctgtagttgccgccggccggtcatcctccctgagctcaccttaatcttgcctgacctccaagaaaagtagctaaacgctgctagctaccgtggcctccctctctctcgcttcgcttcccctgaggcttcacctactcgtcgtcgtctccgatgccttcgtcctccccaccgctccgaggtagtcctactaacaaaggccgtacctttgccttcccctcttcagtcttctttcttccccgtggaggcttcccttgctttgtgagttcttgtttcgatctcttgccctggaagtgaagtttttgattgggtagtttgtgggtggttattgagagagagagagagagagagagagagagagaggcgtagagcagttgcggcaaaatcggtggtgttttggtagagaggttcttgattttggattatgcggttgcggcggttggaggatggatccctagcttaatcgatgaatttcttgggggccgggaattcgatcttttattatccctgaaatttctgtgtagtgtttcttgttttcagatatatttttcagtactctctttcttggtttttgaggtaggtagtccgccgtcaattcttatcatggaattcctcggtagaaacacccaaattccaatttgttttgtgatcgaatttaacagcaatctcaattaattgttagaatactgaacccggttaaactcttcttggaacctccctgaataacccaacattttgtttttttgcaggccttccactgttcagtgtctcacctctgaactctgaagctccactaatgtga

SEQ ID NO: 56407 - DNA, 526 bp, Oryza sativa
ttttacttactaaatatagttactttgggtcttgaattataaattttgtggtaaataatctaatgatgaattatgtattttctatataatatagtatgagaggatggaaggatgtatggcgtaagtacgtgtactggtgcacgtaaatgatacggatttaaagtgggtccaccgtatttaaagttgtaaatgatacggatttaaagtggctccaccgtatttaaagttttcctttttaagaattattagatattcctcaaatttattaaaatgccacatgacgacttaagagcgtttgtaggagtttcacgtggcggcttgagagcgtttgtagaaagtttaatggacttttagtatataatagatagataacgttagtattcatctctggcgccttgttttagtatcagctctcttaatcatcgacacaaaaaaatatttagtttttcgtcaactgtaggttctgtcatgagctttctttacagagcacaaatgatgtgtagactaacagtcttgtcatttcagt

SEQ ID NO: 56408 - DNA, 1501 bp, Oryza sativa
aaatatatagaacagcggaagcttgtctacccaatccacaagcacaccgactaggggtttaccccattaagttcaagtactagaagaagcagtcgattacccgcatcactcaaagactaagtctaaaacctgcaagcaaaagattaattcaatagcaagagtcagtacattattagggcaagcaccaagacaagcctaacaccctacttgcaaggcatataatcaaggaagacataatatggttctttttagcataaagcaagttttatttgcataaaacatttccaaatcaggtttactttcaaataaatttcaacaagctagtacttgtcatattgggcatcaaaataggcattaatcatgtataaatatgcacctcattgccttccatggcagcaaggagcaaggagatcattctcaaatctctttaaattgatttaaaggtaaatttcagcatttaggagaataaacacaagtctatactcaatagatatccacacgccgctcatgaccgcgagcacaacgaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttactccatcctaagccatacacgttatatgacctagaaccgttaagtggcgggctcacgccttaaacttaacgccgtggtggcggacacaacgggaacccacccacgtggcacaataccgttgtattggacagacttagtgacctaaactaccacgtcggggtaaataggaagttcctctgagttatccgaattcatacgcaccggtctaccagaatgtaaggctaaaccataaataatttactaagcttgagctatcccatactagcacatgtggttgtactgtatacgaaatgaactgacattgagtgaagtccttaggtcggtttgggtgcactctccccctatcggtacacaactaatcaccatatgtgcaccagttgaggcccaaacctaaaatccatgttttccatcattttatttatgaaaatcacaagtattaaagttctgtccagattatttcaaaatcaatttttcatatttgtaatgaacccataatgacaaggaagaccattctaagcatggctaagcattataataacctagtgactccaaaattcatatataacgtggtatagtcatattgttcctaaggataggaatgatggatatggatatatgtggggttaaggtgataatgtaaataataggagtttgtctaacaagtttaacacaattttaatttgttaatgtacaatcgacatgcaggatttgcaaacattttcaataacctccaaaacataggttcaaacattttcaataacctccaaaacataggttcaaagtgatcaaagagagggaggtgggacttgc

SEQ ID NO: 56409 - DNA, 1501 bp, Oryza sativa
ggttgtcatcgtcattgatcacattttttctctgccgacgtttcatacttcatcggattacctagcgtggtggatctgcaatggaatcgatatatatagggcaaaagcatcgggtctatggttgtcatttttttattgcttatcaagtttggcaggtcaacaatcttctgtgcttcagcgttgggagtttctattttctccaactgtttcttcaagctatttttggacttaattatacttggaacaacatcctacaaatgcatgcaaagttgatctggttaggtataaaagtcaccttctgtccaagaactgaaggaaatgatcgcggcacggaaactcccaaatgtaattcttgtgcaatttgcaagccaactttatatgtgcttatgtgcttcccaaaatccatgaacagatacaagataaaattttacgaactagccgaggttttcatgcaatcttcactgtaaaatagagttatactagtatacttcttttatggttggggcagaccaatcaatatagtgagaaaatctgtacccatcgaacatagcggtgttaatctttcttgtttttctccaattgatgttatggatgtggtagaatagtctaaattgacacaatctaaattctgcacgatcaaagatgtaaattcttttttccctcggaatattgtactgtttctctagttcttttggctgagcattgtggctttactaaattttaataatataattgatgacctgcaataaatatctcgagataattttggaccaaaggggctttaataggagcctaatattacattgctagcttcaatgttctctccactcaactgcatagatggataaacaatccaataaatgtagagttgataaaaatatggtttccgagtaatctagtgttctctttcttaacaagatagccatgtgtgctttttaacagatgcaagctgtgatggcgagcggagcatgaaggcggctcccttgttcacaagtttatgagtgatgggggaaatcatccattctgtggatatggcccatccgatggcagctatcgtgacaggatcaatccttggaactctttgaatgtagcaaaaatcgtttctgtagttgtaaattgaattccaattgcacatatcaaagaggattaactcaaacatatatgatgaactgggcatgaatgtatatttggtgtgaactcattatcatctagcgagtaatatctattggctattgacaggcacgattaaaggttgacagatatgcttgccagctacacattaaccgagcattttttgtcaggaaagcattaacttgcattgattcatttgatatttttggatttgcgaaataatttctttccacaacatggcgattgttgcaatccgatctcccactataaatccaccatattcccctttccttgatttcacatcaatctaaccatctctcctcaatctacaggtgcattcttgctagaaagtagtgaactgcgtaggcca

SEQ ID NO: 56410 - DNA, 1501 bp, Oryza sativa
atgatccagggcttccttcaatctcctttttagggcagttagtctcgtatactgagaatcgatgtatattaggcaaaaacattgggtttatggttttcatttttttattgcttatgaagtttgtcaggtcaacaatcttctgtccttcagcgttgggagtttctattttctccaacggtttcttcaagctattttggacttaattacacttggaacaacatcctacaaatgcaagcaaagttgatctggttaggtataaaagtcatcttctgtccaagaactgaaggaaatgatcgcggcacggaaattcccaaatgtaattcttgtgtaaattgcaagccaactttatatgtgcttctgtgcttcctgaaatccactaacagatttgagataaaattttacgaactagtcgaggttttcatgcaatcttcgctgtaaaatagagttatactagtattcttcttatatgtttgaggcaaaccaatttactgcaatatagtgagaaaatatggacccatcgaacatagcggtgttaatctttcttgtttttctccaattgatgttgtggaggtggtagaatagtctaaattgacacaatctaaattatgcacgatcaatgatgtaaattcttttttccatcggaatattgtactgtttctctagttcttttagctgagtattgtggctttactaaaatttaattatataattgatgacctgcaataaatatgtggagattttggaccaaaggggctttaataggagcctcaaattacgtagctagcttcactgttctctccactcaactgcaataaatggataaacattccaacaaaagtagagttgataaaaatacggtttgcgagtaatctagtgttctctttcttaacaagataactatgtatgctttttaacagatgcaagctgggatggtgagcgagcatgaaggcggctcccttgtttacaagtttattagtgaagggggaaatcatccattctgtggcggatatggcccatccgatggcagctatcgtcaatccttggaactctttgaatgtagcgaaaatcatttctgtagctgtaaattgaattccttttgcgcatatgaaagaggattaactcaaacatatatgatgaactggggatgaacatatctttggtgtgaactcattatcatctagcgagtaatatctattagctattgctagctcatgcctgcaaggaaatttctaaagacggacacgattaaaggttgaagatatgctcgccagctacacattaaccgggcattttttttcaggaaagcattaacttacatttattcatttgatatttttggatttgcaaaataattcctttccacatcatggcgattgttgcaaatatgatctcccactataaacccaccatattcccctttccttgatttcacatcaatctaaccatctctcctcaatctacaggtgcattctagctagaaagtagtgaactgcgaaggcca

SEQ ID NO: 56411 - DNA, 1501 bp, Oryza sativa
tcgctccgccatcaagtgcctgttctgtagtcttccgctgttttatttgtttatctttgagtgtgagggcctaagtcgcccatgtaataaagtacttgctttacatttccgcaagtgtggcttgtaataatcaacaatgtctatgtgtacctcgccttctgggacgaggattaatgcactgagcgtttggaaatggtgtatatttccgggcgtgacaagttggtatcagagccaccttgaccgtaggatgagcaagtggtctaagccttaggatgatattttttttttagaaaatagttctttaattgtggaaactttttttattctatcttcaccctctcttgctttgcaaaattgtttactaattctttgttctgtttttttgaaaaatagatgaccagccttggcccctacaatggcgtctcacttaaggggttagttctgcagcttcgccacttgatcgttgagctgggctacaccgaagaagtccagtttgttggtaccactgtgccagacgaaggagaaaaagagttggcatccccccgatggtcagtcaaggccaccttgctctccaccaaccctagcttggaatcattggagctaacgggagggactgacaccttcatcgacgcatgccaagaagtggtgcttctgggcattggcaggctgcttcaacgacactggacacgtctgcaacacactccattccgctatcatcctactcgcagtttggcggaggactatgccaccttcagggatgccgagcacgagaacgacaccacgatcgatcacctggccaagatggtgcaggcgtatgatgatgctcgtgtcgactactacaagatggcgaagagaggttttattcaagcttctagtaggattctacggctaaggaggaagaacctgtgtgtgaagttggagatggctagcctgaagcgggaattgcgtaacctcgagctcggacatggtcaggttggagaaggaagctctgttgtggggtctaagcgttgccgtgttggaccgtccttgaagatcacgacacgcaagcgagatggccttcctccgatggtgcacgatgctcaagcgtcagccagggtgattgtccagaactacttggagcgaaggggattgactgtggctcttgccaatgaagatgactccaacgacaactcctatgacggtgatgatgagtcagagccgacagtggacgacaacgcaacaaaggacgagtagacgcgtagtcttagtacgcgtctatttttatcatttatcttctacttgagtttgttgccttgtgtgctttttggtatggactatatcgacccgttgtgatatagctgtacctttgtggtgcttaagcaacttgaactctatgtaaccaacatcacatcaataaaatttaaataagttggtttaatagctcgtgttcttgtcctaatatctcccttctttcttttcctctcatcttggttactacagatggtaaacacaaggagtattg

SEQ ID NO: 56412 - DNA, 1501 bp, Oryza sativa
cgaaatggaggggggagaccaagaagaggaacattagcttatcgtaagaacaagtagtgttcattgttttttctttaatatgagatgtgtctgatttctaaagggctaaatatgtcataaacgtttaggaataaatttcttctttcgttgttaataatggaaacttagcctctttcataccatacatactgtctaagcaaagccccaataccactctatcttaatttgaagaactatattatattatacaagtttaattctttctatgaattggcaaatgccaagtaaaggttgagcataaatactactacctttgtcccaatatataacaacttttgactataaatttggacacacagttatctagatttatagctaaaaatacttatattttaggatggagggagtagctagcccctatgctgcaaggcactagatataaaaggttcccactgtttactacatcgatcctatctacacatgtaccagaaaagtaataactttatggttttgggaggagaggtcttgatcaagagctctaaccctagctgcgtattagctgctttgtaccagtctcatatttatattccgttctagatgtttgtaccagttatctccggttaggtggtcgatacatacggaagattgcctatgcatccgcttgagttttcgttccgtacgcaacttctatgaacttgacacttgcaccattgttgatacgcccctcttaagttctcatcatttctttctcttgcacccagaaaaggttaattacctgtttaattattaataattcaaaattggacaatatgataatgatagaaatggttgttctagaatgtacatgtttcagactatatacagatactccctatgtagaagtcgttttggacagcgacacggtctccaaaacataattttaacttcttgttactataaaaatatttattgaaaagtgatatatgtataattttataaaagtatttttcaagacatctattcctataatctttacattttcaaactcaacaacttgggagttattcatgatttatattttcaatgtttgacttaaatattattataaacgacatggaggtagtacatgtgttgtgtctgttccgtgcaagcacagactcgcaagcattgtttgtgtagaaagcaagcaataaatccaattaattgtaacaagaaatgttctggtcaacaattaataccagccatgttcatgttatttgttttcttacttctgttttcgtcaaaggtgttttgctgtttgctttgcccttcattgttttttttttttggaaatgtatcgtttcaaaagaatatctgaattttgtgaattataatacgtatttttgaaaatctttgttgttgttctggtattttcgaaaattgaaaaaaatgtaacattgatttttttttaggattcttatgaacttcaatgaattcattgagtctggcacttaattacaaattagttgagaattttgcaata

SEQ ID NO: 56413 - DNA, 1501 bp, Oryza sativa
gtatttttatcaactctactattattggattatttatccatttattgcagttgagtggagagaacagtgaagctagctatgtaatttgaggctcctattaaagccccattggtctaaaatctcaacatatttgttgcaagtcatcaattatattattaaaatttagtaaagccacaatgctcagcaaaaagaactagcaaaacagtactatattccaagggaaaaaagaatttacatctttgatcatgtagaatttagattgtatcaatttagactattctaccacctccacaacatcaattggagaaaaacaagaaagattaacaccgctatgttcgatgggtccagattttctcactatactgcagtaaattggtctgcctcaaccgtgtaagaaatatactagtataactctattttacagcgaagatagcgtgaagacctcggctagttcgtaaaattttatcttatatctgttcatggttttcaggaaacacaaaagcacatatgaagttggcttgcaatttgcacaagaattacatttggcagtttccatgccgtaatcatttccttcagttcttggacagaagttgactttttatctaaccagatcaactttgcttgcatttgtaggatgttgttccaagtgtaattatgtccaaaaatagcttgaagaaaccgttggagaaaatagaaactaccaacgctgaagcgcataagattgttgacctgccaaacttgataagcaagaaaaaaaatgacaaccatagaccaaatgttttgccatatatacatccattccgttgcagatccaccacgctaggtaatcggatgaaatatggaatgtcggtagagaaaaaatgtgctcaatgacgatgacaacccaagtcctggtgttattatgaactggcatccatggtatccgtggatctagtaagataactctcgcacaacatttttgtgtcggatgcagaaaaagtccgctatttcgaacttgttatgtgggttcttgtttccaagaattttcatatagatacaagtttcacttagatgattgagcaagctacagggcaatcaattatttgaccagccaaatttgataagcaataacaaaaatgacaaccatagaccagatgtttttgccatatatgcgcccaataatgccactgcagatccaccacgctaggtaatcagacgagatgtggaacaccgacagagaaaaaaatgtgttcaatgataatgacaacccaagtcctggtgttcataaaatattattctgcaattggcatccatggtatccgtgggtaggaaaagataactctcgcacaacatgtttgtgtcaaatgaagaaaaagtccgctatttggaacttgttatgtggattcatgttttctagaactttcatatagataccattttcacttagatgattgagcaagctacagggcaatcatgtcgtcagttaccctcggtttaagagtctaactgctctaaaaaggag

SEQ ID NO: 56414 - DNA, 1501 bp, Oryza sativa
actaagatctagataaacaactgaaccattagggcctagtgctagctagaggaagttaaaataggaaccatacatcttaaaatatatcaacaaggccaatgtcaagccccacaaaactatttggtcatccatctgaagactagtcatgaacctggaagtgaacaaataaattaactcatataggatatattccaccttagttacctttataagcattctcttaattaaatactagagtaaacttatgcataaatagttaaggagcttattacatgtgtaaggtaaactaaaattctaacatatcaacatcacctcaggttaagaagagtctaaatataaaagttttaaaaacatttacatacatttaggaaaggaaaataattcttgctaattatttaaaataatctgtgcaagataaaatcattgaaaaattcatgtaggctctaattaacatatacaacacacagtaatttcggtataatttaataactaaatttgatacctcaaataaataagttaaaccagacaaataatagactaattataactcctaattggctaaaaccataccttgttgaaaagtgcatttaactgcatggaagtgtataggggaaataatttattaaaatactaggttaattatcatgactaaatataatttttctagaatttatcttctctgtttaggtctcctaaaaatccaaactagtttccaaagaacccatattcctctaatttctgtgagtaatctatccataatttttgaggcaaccaaagaaaatggaatctaggtatcttcatctaccttcagaaaaatccacactaaattatcctacccacaaattaaataattgaattactaaagtgggagagagaaataatcctgaaaatcattcaaatcttttgttcacccacgtttctgcccaaccctctcaccctagcttagtttgccacgacctggacccacttggcagccactctggctcatcctcaccctgtgcaaatcttccagccgaccatagacagccgagagagagagagagagattggcgccggctgtgtacgacgcgtggcctcgacgtggcagcgccgaaccgaggcttcacctccacccagctgtgtcgccactcttcacccaccatcccagtgccgatccaaccgagggaggaagctccagctctccctctctacctctctttcgtcgccggccgccaagaagagggacattgccaaccgtcgtcgagccctctccatctctaactcatactcgttccattctcatatcgccatgccgaacaactttggttttgatcccattccatttcatcttctacagcagcgggaacgccgccatgtcatggtcgctctagagcgcgctctgtgcaccgccgcagcgacatcatcgccgttcccgcttatctggaccaagccggaccaagctgtcgcgccagcgtcttcgcctcgacctcctctccatttcccctcaagaatctcgaaggat

SEQ ID NO: 56415 - DNA, 1483 bp, Oryza sativa
tcgcgaactaacttaaatataaccatcacttgctaatactttatccaattatctagtagttcttgcgttctctcgtgagaatctcatcgcgtgatgatttcgggcagtggaccggtgtcgcgcatgtgcgcgttaataaccatttgatagccacgaatcaattagaacatgtacaatagcaggctataaaccagctataaccacatatcgagaagaaaagagaagagagaagaaagcggactatagatttatagccggctgcaacacggactccaatacgttatgagtatataagagataggaccgaatattaatgatgtagtatatttttatagataactattatataaatgggctattagattgactataaatgatttggagcccagttggctatactattgaacttgctcttaacaagtactacaactgcagcgtttgaaccgatctcgcctcgctctaataacacttcatcttccgagttccgattgtccggggttggtgagttggtctgttggtggccggggcgcgggcgcgcttacctgttctccctcgcgtggagctctttgactacgcccgccagctgcgcgtgtgtataaccttgcttgcttgcctctcacagccgaagtcgcaggcgcagtcaggagctatcgggaaaacgggatttcccccagctttccaaggttcgcgggtcaatctcgcagtgatactccggcggcggcaatggacgccggcgaaatcatcgtggcccagccatcgccgcggctgtataaggtatgtgaaacttcatgagcgagctcgccgtcgacccaagcttagggagatatagggattgatattatcggtgcagcagtgcgtgattagttgtttagtttagcttgcttcttaatttgagggctttcatttggagtttataatctgattgtttggattgcttttgtgcagagtttgactttccggaggatcgcgacgaaggaaaggaccattccccaggatgaagagatgaaggtaagcacctcttgatcacgtttgaactcgtcctctgttgttaattagtcattaacttgcgtagttgtagtccgtagtaatagaaaaacttggcgggcggggtgcgatgtgtgatgatctgctgcaagaactgagaaatttttgcgtcaaaaaggaactgagaaatttttggataatggatcacataactcgtcttctaaactctaataaatggatgtatacgaccattttgtgcattcgttttagtaaaaaaagcagctacacattgttttcttgtttttgctagtactttaatatagtatacatgctatattgttggtttattacggattccatttttcaggtgtcctatggtaataattttcgcaagtgtttttttttgaattcatcactgcagacaacaagaaatatgatttaatggtcaaattgattaccctgcaaattgtgttgtgacaataaaatgatattctcaatt

SEQ ID NO: 56416 - DNA, 451 bp, Oryza sativa
attatacttcctgatgataacctcctgtgctcaagccctcaactgtaacatttccaagaatgaacagatgaaatattagcatctccatgttttcttttgatttctttaaacattttaccctttcgatcgcactaactataaatgcaatcttactatcaacagtttctccactggtttacgataccaccaaacctttatgggatgcgatacaagactttaaaaaccagtatcaacagtctgaatatgaaaatggatggcattttacagaagggctctgaattaggtcttctaccaatcgatcaggagatcctgaatgaaaggtctgaaatctctttggaagtgatacctgatgattacattgtgggtgacattgaaaatgaagcaaacaaattgattgatatattgacagacaggaaaagtgcgaagacacttgttgccatagttggtggta

SEQ ID NO: 56417 - DNA, 1501 bp, Oryza sativa
aggttcagaatacatctataatatgactgactgctccaccagtcaatccaatccatcagcatatttatttcaattatagaaaatataatttaatgcaaagtgatacatatagattgcaattacgaaaatataacaagagttgatcaaaggtgttggacttgcctgagatacccaaaattgaagaacgaataaaccaacgaagatttccagaaatccaagataaacgcccaactgaaagaaacaataaaacacaactaaatacaagaatatttatatgaatgcgatgcacatgatatatttaacatgaatgcacatactagatctatataggttatggacttacttttattaaactttcattttaaggaagattagttattttacttagaagaaaatttgcttctcaagagaaaaatatatttaatagccacaagttatattgatttatatagaaatatacatctttactttctttgatcaataaagtagttcataagatatattttgaaggagatacttctattaggattatgatatgcaaagttaagttgtatttgtatgtacttaaattaccaatctgataaaatgaatagaccagtgactgtaataatatatcaagattttcaagaatttattttaaagagtttaaaccaatttaaatattctataataatttcttttttatccaagctctacttcttaatttctttagagtgtgtttggataataggaaatgggggatagaattgggattgagaaataaatgaagggttaggattaaatgaaagagggagaataaatggttaggatttaaagatgggtggaaaatcatttccctttcccatttgccaaacactatcttagtttccaccatctacagcccattagcaaaagcccaacaaaacacaacccacctaacccaccttcttgattcttcctcttctctctctctctctctcttttttttcctcgttctcttctcctccctcacgctctctcccaggccgcgccatcaacgccgccgcgctcccccgctccggtcgccggactccaactccggtaaccctccagtacccgctgccgccgcgaatcggttcccctggctcccacgagcctgctcctgctaaccctagccatccgcctcctgctgctgcagcccccatggagatggccggtggaaaacacagcacaactggtggctgcaccctatccccattggtgaacaccccagtgtccaattcttcctctcattcttcctctctcttctgctcctctgatatgatatttgtgctctcctgtgtggtgtgtgtggtaatatactgtggattatggtgtatgggtgatgtttgtgaatttttcctaaataactctcgtgatggtgatatactcatgactgcccttgctggctcttcttgactaattgttttactatggctaaatgatgcctagatgctatgaatggataaaatacccacatacacaagcatacgcttttgcaata

SEQ ID NO: 56418 - DNA, 1501 bp, Oryza sativa
gaggaagcttgagaccatgtcggctatcatcagggatgctgagcagacagttgtgcagtatgaaaccacaagggattggttgaagcagttgagaggaatagcttatgaggcagaaaacataattgaccgctgcaggattgaacaagagaggctccaaatgttccaaccacaggttatatttctcaaatcttcatcaattttgttttaaccccgggaacatatttctccaaattgttattttcctttctgcttttgttgataattatttttagcttatttagatttgtaatttcattgaagaccatttccaatgcttgtccaaaaaaaaaaatgcttgcatacaatgtatttgaatattgtgagctttgagcctttgagggctcactgttgtctaaggatactcaaatatgccaacataatgtgtatagcctcaacttttagatggggttggaggcaacgggcattattcagcttgtctcggtccttctaggaatgctccaatcaatcaccacaaatgtatgatggacttttggacacatttcagactcagtccagtttcttattgcagatatataggaaactagtgtgttatttctgctgaaattttaacagatattagtatcagtattcagtacactctttttttttagtttctataaatctatgaatggttattaagacatgtaagaccacgaactgtgtactgaatatacatgtgtctagcaaaaacaaccattcactctatcgtaaccaacattctctacaactaatacttaataacactccaatagttcctgtggtagcgaactaatatttaatcaaaggcaatttgggctgcatatcctaaatataccttaacatatatgtgtactgctaacatctgcttctgtggccacatgttgttgatagtttggatgacagaaagattatttgaaatattaccagaccttagctggtagttcaggtttgctatttttatttgattcgtcttttttttttggtagaactactgtgttttttctttaagggataaaactactgtttttggtcctttaaaatgataaaatcattagcattaagactacataaaaaagaaagtatgaaatcacttcttaatcagtatgacatctaccagtcctagtcagtagaactggtagtgctcttttcctttttcctgtcaagaggccaagatcactggaattggcatatgaaccgcgagtaaagatagtaccttatcttaatttgcattgcataaatttatatgttattcaccaggaaatagcctaatgtgcttatcttgctgattccagtctcaaggagaaaattctgtagtacatttttcatattatcttcatattttgcactatctagttattcaaccatgaattaaatttacaatctctgtgcaggagtgcaatccttcatcgctttttaagtgctgcagagatgtcgctgttgactacattatagcaaatgatatacatgaactaaatcaggaact

SEQ ID NO: 56419 - DNA, 1501 bp, Oryza sativa
atcctagcggggcttcagctccactccacaggcaaaactcaactggggtctgagccttggtcctctaactccatcttcagctcagaagcactacacttctgaaaagggggaaaaatagcaaggctgagtacaaccaccgtactcagcaagccacaccaacggtgcagacgtgcaaggggatacaaggaggggtttgaggctatttgcataaaggcagttgtaaaacattttattgagcaagacagtaaaactgttgagtaattacagtaatattgaatctccactgatcaacgctacaccacgttgaacaggcccaaccaacccacctgaactacagtgtattgagtcaatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggagagctacactacaagcccagccgttgcccacgctggcttgtggtaagtacgataagttcttccagggcatcccgcgaaccggtccttaactgccatgggtgcgaccagcaaaaccatgcacccacagcccaccattcagacgcattttagttggataattacgaccatgaagcatggccagatgtctcgagcacgcagctcattctgatactaaaaggtctaaaactgtaattaccccatcaactgagctagtggtaattaagcatggctaagcatatagtactagctaggtcatcaaagtaacacaagctaggcgatttattacccaaggttgacaaagaacagatatcaagtaaacatggcacaagcgagcagataggtaatacccggatcccatgtaattagcaaaacatgcatatttatttgtaaacggtaaaaaatttataaattgggatcaacatgctcaaggggagtgtgtgacttgccttgcttcttcacttggatcttctgaactcttatccttgcgaacgcgatcttccgaaacgacgggaactacacgctggcacgcaaaacgaggaaaaactctaataaaaaccaagaaaacagtacataaaaactaaacaaacatgtagagctcatttttagatgaattttgcaagttgaatggctcaattcggagttcgaatgaattagatatgaattttagaagttttgagccatttaaatgaatttctataattattcacgaattattgcgcaattattatttatttttacaaaggaaatggacctcg

SEQ ID NO: 56420 - DNA, 629 bp, Oryza sativa
aaaattttgttaaatttgttagacaaactcctattatttgcattatcgccttaaccccacatatatccatatccctcattcctaaccttaggaatcatattctattactattactacttggaatatgagttatattgtcactagtttactatattgcttagccatgcttagaatggttttacttatcacttggactcatattaacataaaaaatgattttattaagattctgaacagagttgaataaatgaagtatttgacaaataaaatgatggaaaatgaattttagatttggggcacatatgatgaacaaaaatcaatctccaaaacaccacacgtggaacggagcctaaatcattaggtttagaaacaattctccaacacagactgtttgagtgagaagacctcgattaaacagccaaaaggacggacagccatttatcggttactccgaccaaaaaaataaaataaatcaggaaacagtctctgcttgcttgcgtaagctgacgacagccacgacccaatcttcgctgcggttgactttaaattaaaacgacgtggacgccaacaagctctcgtttcctccgatcgactagccggcgttggaagccacgccaccgccgccgcca

SEQ ID NO: 56421 - DNA, 1501 bp, Oryza sativa
atgtattttttaagtagttaagatatttaaaaataaaataatgagcaagttagacagtggttggacaagtttgtcttgttttccacgtgcacgcttcccaaactactaaacggtatgttgttttaaagattttctataaaaaattgatttaaaaatcatattaattcatttttaaatttaaaatagttaatactcaattaaatatgcgctaatgtctcatctcgttttgtgtattttttaattttctcttttcctcccctcttttattcgccgcttcttttcttgatatctctcccccactatagttattttattttttctcttcccctgtcgatctctccaaaggctcggtccagaaagttccctctttttctcgtcttctccgccctcttccgatccccttctgtctcctgcctccttcctctcgatccccttctttgtctccttccccttcacaaattccatctcaagcagcaagatctagacctagcactcatggatcaagtgagcagctgtatcatgagcctcagatccagtgctagcagtaggaatagatcagtattacggcggtattggcggcggagctcacgaatggccaacggaacggcgagcctggcctagaaatttaacccaaattttcagactattttacgtattaaatccctgtccaggaccagccagggtacacaaaacgacaagtaatatacagttccaaacgtaaataaagcgtaaaatacttacggaagaggcacttagtcctcacaccgaaacaaaagcagcaacagcggaaaaaggctatcctagcggggcttcagctccactccacaggcaaaactcaactggggtctgagccttggtcctctaactccatcttcagctcagaagcactacacttctgaaaagggggaaaaatagcaaggctgagtacaaccaccgtactcagcaagccacaccaacggtgcagacgtgcaaggggatacaaggaggggtttgaggctatttgcataaaggcagttgtaaaacattttattgagcaagacagtaaaactgttgagtaattacagtaatattgaatctccactgatcaacgctacaccacgttgaacaggcccaaccaacccacctgaactacagtgtattgagtcaatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactaga

SEQ ID NO: 56422 - DNA, 1501 bp, Oryza sativa
tccaactttcacaaattttcacaaacgggggaggggaggcagttatagatctgacttaaccatcctctgcaaaggaaaaaaggtaaaaggcatccgcaatgacaaagaaacatgcacttaaggaaataaaaatcatcttttcattggtttcatttatttaaaaataatttactgagtgaccaaataattgatcataatttcccaacaattttaaatgtcttaaaatagtgacaaataagtttctgtaattctaaaattaattaaatcagttgcttaaaaaataaactgatttcggcctaaaaggctcgaaccggcctggcactgtgcggcatacaagcgcttgtgctagtgcacagcggcccagccgatagtgccagcccatgaagacgtggcggcccagccaagctagaagtcctagcgagcagcacaggcgacccaatgcgggagagagaatggccgtcctagattgcagctgttccggcatgtccctaatcccattatcttctcttctccctgatccccttctctccggcacgtccgagcaagcgagtagagcgatggtggcgatggcagtccggcgaggtggcgcgtgcgcgacagggaatccgtcgtgcggctccagctcttcatcggcggggggctgcctcttcccatcctttgcgcgacaatggcatgggcagggacggagggcgccaatcattatacggacaaaaaattttcgtgtaacaattggaaaattatgtattttttaagtagttaagatatttaaaaataaaataatgagcaagttagacagtggttggacaagtttgtcttgttttccacgtgcacgcttcccaaactactaaacggtatgttgttttaaagattttctataaaaaattgatttaaaaatcatattaattcatttttaaatttaaaatagttaatactcaattaaatatgcgctaatgtctcatctcgttttgtgtattttttaattttctcttttcctcccctcttttattcgccgcttcttttcttgatatctctcccccactatagttattttattttttctcttcccctgtcgatctctccaaaggctcggtccagaaagttccctctttttctcgtcttctccgccctcttccgatccccttctgtctcctgcctccttcctctcgatccccttctttgtctccttccccttcacaaattccatctcaagcagcaagatctagacctagcactcatggatcaagtgagcagctgtatcatgagcctcagatccagtgctagcagtaggaatagatcagtattacggcggtattggcggcggagctcacgaatggccaacggaacggcgagcctggcctagaaatttaacccaaattttcagactattttacgtattaaatccctgtccaggaccagccagggtacacaaaacgacaagtaatatacagttccaaacgtaaataaagcgtaaaatacttacggaagaggcacttagtcctca

SEQ ID NO: 56423 - DNA, 1084 bp, Oryza sativa
ctcttttcttgttgggggggggggggggcggggggggggcgagttaaaaatgtgcatgcttccttattcttcaccaccacttaagttttttttttggtgaaaaaactaatcaatatgaaatgggaggaataaataatatggtcttataagtacatctattttctctatctatttaatgcttgaaattatagaaatttacccttttattcatatattaattgaaagcagcgagacattgagatgatggacataagttggaagacgaatacgtgcgtacaaattctgaattccaaccaaccaaagtaatgaaactacttattttccctccacatgtgtataagaatcgaggaaatccttttttttaaaaaaaataattttatcttcttattccttaaatataacgttctaagtgcataacattaaaaagttcaagttacacagtaaaggaaactaatgaattgattatttgtttgaaaatttggtactcaaggagcataacgtttgcatcaagcgggagcaaaagatgtcggtagcattcttttcctagaattttacctcaattttcgttagcacacttttcaaacatcggtgtgtttcatgtaataaaaaatctttgtgaaagttgctttaaaatatcaaatatatcaatttttcaagtttgtaataattaaaacttaattaattatgcgctaatagttatctcgttttgcatgtccgcatttaatctaaatcttcgtcagattcgaatacagtattctcatttactacttcattctatcctggataaaagattgcaaagaggcctggcttttttttattattgtccttcccagtccgcagtccccactctcgagtctcgactcctccgctgctctccactcatcaatttgctcctcgctcgacctcggtgtctccatcttcgccgcggtacgaccgtatcgctgctacaacggccttcagtctatggccttcttcgcatgaagctcgaaggcgcctgcgtctgcaagattgaagttgcgccggcaacatcagcaaagagaaatctgcgatgcgctccctgtcccccacctcctgcaatccctca

SEQ ID NO: 56424 - DNA, 1501 bp, Oryza sativa
aatatactatttgttttcagtatatactgttctatcccagtatgtaatgcttttttaatccagtatatatatacacttaagtcgggcatatactacttttatagttagaagtagtataaacgcatatttaatttgttttaagcagtatatactttttaatgtagtagcagtatattatatatactaagacatgcccatcaggatcacatactgatactggctcactggcaaatgctcatagcgatgttatgcatagtggttcattagtctggtttcatttgtcacataccgtttcattcttccggcttcttggtttgcgtcatccggaaacatgttcatcaccagcatgtacggctgccgttgtgaattaatggagcaatcaaatatgttatctttgtgctgatagtttttaaagacggtatatactattttttatgttagtagcagtatatactgtttttaaactaaaaaaagtatgtactggccacatcagtatatactatttttttaaagtttgtaccagctagtgtatactgttttttagtttagtagctgtgcatactgtttttagtttaaaatcagtatatactatatatctagtaacagagtattaatacctaaaaatatgtactaccgagaggtgctattatcgactgagcttacagtcttacactagctagctcattgattggtaccttcactgtagaagctgtcagcaaaatagtatattgcaattttcagtgtgacgcaatgggtttgatctgccggagctctcgccggtccagaaaacaaattgcactgacgcagcggccgcgcaccactcggctgggaacgctgagggtgagggctgggaggatgagttgaatctacgacactgcatgcaacaaagaaattatatgcctaatcatacaaagggcctcgcatcaaacaaacgagaagtaatggatctaattaagcagacaaattaatcgaagtgattcagggaatcttttcggtctacaacaaaggacttgtattaccagcaccattgaagatttgatctggacgggagggactcagatcaactcagaagaagactatatatactacttgtctacctcctccatggatccgccgaggattagaaactgcagcactccattcgctgtcgacggggagaagtggagcacgtacgacctcaccagggaatctcgtcggagatgccaccacaaccgccgacgacgattggtacaggagggacgagagctagccgccgctcgtggcgacgttgaatggctgggagtagtacgctaggattagtcatttgatttaattacgtggacagtttgttgatccgaaaagaatgggataattaagaatcatgcatgttattgtttttaaaaacgaaaaatcaaagcgggtattctaggatgagacccggtagcatggatgatgcgaggggcctttgatgaacggtggatacaagcaggttggagtacagaatcattatatatatatatat

SEQ ID NO: 56425 - DNA, 1501 bp, Oryza sativa
cagattgtcgcccaaattctgagaatatgtagttgtataactaacactccgtgcactcaaagcagagcaacatattagcacatgattaatttattattagttaatttatttaaaaaagattaatatgatttttaaagcaactttttatagaaaatatttacaaaagacgtattgtttagtagtttaaaaagtgtgccacgtcaaacgagagatatgagttgggaaagtgaataaccgaactcagtataaaaggggaagtgaggggttaacttcgtggggtctttggaatttgtattgaaaatccaattttagaattcattttattttatttgaaaatttatttaatataatgttgggttttagatggactattctttcaatattacttattttaattctcgtattttagtttgctaaattgtattcctagttgaattctttggaattcgtataaaaatccactttggggatttatgttatttttaaattgtaattttaattaatcttattttgtattctagatggactcttattccaatatactatatattttattctggttttcagtaatttataatttgtatttctacttgaactctttagaaattgtagtggaatctaattttgggatttattttatttttaatttctaaatttaattaatcttgtttgtgttttagatggactcttcttttaatatatttttcagatccgaaatttaattaatattatgttgtattctagatggattttctttcaatacttattttttaaaatttataatttcagtaatttctaaattgtgtttctactcgagcctttgaaaattgtatttaaactctaatttctgaaaattgtattgaaattttttaaatcatatttcttaaactctaattttcttctgattaaattaagaatttctagtctccttttcaaaatgtcttaataatatattttctgattccagtgttagtctcgtactcccgtcgcaggtggtgccggcgtccgctacgaaatttgccgccgccgccgcatactctctcctcccctcctgactcccccaactcgatctccccgttttttgtcggcctcaacttccgtctcctcgcttctttgctagccttcgccgttctccatccactccgcgggcagcatgtgggtgtcgtcgtcgtgcgctctagctgctttcccttcccgctgtagcgacccacgtattccacttccgagatagaataccggtctacggctcattccttagtaagaaccaacttactaagaaatgggcacactaaagtagcatagcagaaacaattgtagtgaaactcattaaataaaaaccataagaaattagtttttaccaaaatagtaacactaacaataccttgctcttctagatcttcatcaccttcaacaataagttgatgtagagaaatgcaacacttgatcaattttgtcgaatcttctcttcacctaattgttagctcaacactacaaggaataa

SEQ ID NO: 56426 - DNA, 454 bp, Oryza sativa
caaaatcccttccaaaccgtatatctcatccaaccaaccaaacaaaatctcatactagccaggatgaactaatgcaaccaaccaaacagttgcatgtgtatcatcctagccaggctaaactcagcctggatatgagagatggaccaggctaaggcaatgcaagcaaccaaacacacccttaaggaatcgtacgtgaaaataccatccctcattttccctctcaatacttcaaaaatttcatccttatccgctctccaactatctcacctcctcatccttatcctcaccctcatatgtctctcactttctctcctctcctctcacgcactcatgcgtcacggcagcaggcaggtcggtagtaggcaacggtgggcggctcggcagcaggcgacggcgggaggagtagggccctgagcggactcagccggaactacgtcacccctaccgctgacga

SEQ ID NO: 56427 - DNA, 1501 bp, Oryza sativa
actaatgagttcattgagtgactttcaggtgcattagtctaaggtgtggaagatggatgcttggagacccccaaaaaagtacaaaatcaaagcggaccggaactcgagaagggcataggatagtttatcttttgaaatcgagtttttaggaaaaactatactattaagaggggttccaggtgatgctctgagatatatcaagtgctcttagtgtgaaccaagtgtcaagtttccctaggagtcatttttgcaaatactccatctgtccaaaaatgcaagtccggaacttcctgtcttccaggtccggaagttccggtcttgtgaaaaagattttcctaagtgtagtccggaagttccggtctttcaggtccggaacttcctgtctagtttccagttcaaatttgtgagtaacggctagatgacgttacctagccgtcatacatatacagctcgattccagctcgttccttggccattccactttcatttttcaaacctagagctattgctagcctctcccaagtgtttcttgtcttctccactcaatctagagcctaattcttgtgagaaagagagattgagagggagagaagaagatttggagatgtgtgaagactaggatcttgggtgagcacttggaatatctcgtgggctgtcatctcggtgcttattactcttggagatgatctcctagatggttaggtgtcgcccgcgagaatccgttgcatattgtggatgtcccgggtaagtttgtgaaggatttcctctcctccgaaagggaacgaggtaagttggtgaagttcttgtgctgagattttagaggctttccaagtagagcaacccacacttgtggtggatttctagaagtaggttgagtttgatcttggtggtcactcaattctagaaatttgcctaggggtgtttggggttgaaggctgtggatttcctcaggggtttttgcacaagtgaggcaaggggttaattgagacccagctctttggagctcctcaacggagagtaggatcgcaagattcgaacttcgggaaaaaatcgctcttgtctctttctgtgatgtttctgtgaatgattctgtgatatatcctctgcttagaatacctgtgcaccatcttgtgaagattggcttagtctcctgtttcaaaatttgaatttcatctctgttttgttacccggaagttcctgtcttagcacaccggaagttccgggcctggcaggccggaagttccggagttccttactaggaagttccaggtctgtttgaaattttaccgctgcgatttgtttttaagatttcaggggacagcctattcaccccccctctagacttcatcagcgcgttcaattggtatcagagcaaggtgctcttgattcaagcttcactgctttgagtgatccacgatgtcggatttagggggaaagaacggggaaaatggaaatgaagatggaacgagcagcaaggaaactccatcacccaagggagcta

SEQ ID NO: 56428 - DNA, 1501 bp, Oryza sativa
ttggattggaagcttaagcattgcggtggatgagttgctcttgctccgaagtgagctccatgtcatcatggggtacatcaatacctatacaaacaactttccaaatacttggatgcaaaaagattagatgcaacttcatcttgtgcttccaagcggcgtaatgtgtcccatcaaattgaggagcacgcctagaaggcacggagacaaagttgtgagggggaatggtaagtttgctgtaatcaaaaggtatagtagctcccttgggtgatggagtttccttgctgctcgttccatcttcatttccattttccccgttctttccccctaaatccgacatcgtggatcactcaaagcagtgaagcttgaatcaagagcaccttgctctgataccaattgaacgcgctgatgaagtctagagggggggtgaataggctgtcccctgaaatcttaaaaacaaatcgcagcggtaaaatttcaaacagacctggaacttcctagtaaggaactccggaacttccggcctgccaggcccggaacttccggtgtgctaagacaggaacttccgggtaacaaaacagagatgaaattcaaattttgaaacaggagactaagccaatcttcacaagatggtgcacaggtattctaagcagaggatatatcacagaatcattcacagaaacatcacagaaagagacaagagcgattttttcccgaagttcgaatcttgcgatcctactctccgttgaggagctccaaagagctgggtctcaattaaccccttgcctcacttgtgcaaaaacccctgaggaaatccacagccttcaaccccaaacacccctaggcaaatttctagaattgagtgaccaccaagatcaaactcaacctacttctagaaatccaccacaagtgtgggttgctctacttggaaagcctctaaaatctcagcacaagaacttcaccaacttacctcgttccctttcggaggagaggaaatccttcacaaacttacccgggacatccacaatatgcaacggattctcgcgggcgacacctaaccatctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaagacaagaaacacttgggagaggctagcaatagctctaggtttgaaaaatgaaagtggaatggccaaggaacgagctggaatcgagctgtatatgtatgacggctaggtaacgtcatctagccgttactcacaaatttgaactggaaactagacaggaagttccggacctgaaagaccggaacttccggactacacttaggaaaatctttttcacaagaccggaacttccggacctggaagacaggaagttccggacttgcatttttggacagatggagtatt

SEQ ID NO: 56429 - DNA, 287 bp, Oryza sativa
ttgtgaaacggagggagtagtaaagaaaacttggatacatatacacatctcttacaaaaacttagataatgccatcaccatatctctttactatccgatagcacaacacagttgggcttccccatgatcaggggaaaaaaaacaagtgtgtagattttcactatttccagtgaatgccaaaatgccatacccctcaataaaaatgccatcttcttttcaaattccacagccaagtacaaacctctgcttgatgaaattttctaattgaacaaaatcatgcaaacaga

SEQ ID NO: 56430 - DNA, 220 bp, Oryza sativa
ccccccccccccccccccccccaattcagtcacgtcacgtgagaaaaagcggcgcaaaagcgagtgaaccgcttgaaccggaagcgactcgagtccaagccaagccacgcgctgcaccactcgccgctttacccgccgttctcctcctcctcctcctccacgcgcggcggcgaggcggagccaagccctaggaaggagcggcgcgtcaccggcggcggcg

SEQ ID NO: 56431 - DNA, 1501 bp, Oryza sativa
gttacgctcatttacttgctttgtccttacatgctagtgttatatgttagattcattctgtcatatatatacatatatatatacatatatacatatatatatatacatatatatatatatatatatatatacatatatatatatatatatatatattattccttgtagtgttgagctaacaattaggtgaagagaagattcgacaaaattgatcaagtgttgcatttctctacatcaacttattgttgaaggtgatgaagatctagaagagcaaggtattgttagtgttactattttggtaaaaactaatttcttatggtttttatttaatgagtttcactacaattgtttctgctatgctactttagtgtgcccatttcttagtaagttggttcttactaaggaatgagccgtagaccggtattctatctcggaagtggaatacgtgggtcgctacagcgggaagggaaagcagctagagcgcacgacgacgacacccacatgctgcccgcggagtggatggagaacggcgaaggctagcaaagaagcgaggagacggaagttgaggccgacaaaaaacggggagatcgagttgggggagtcaggaggggaggagagagtatgcggcggcggcggcaaatttcgtagcggacgccggcaccacctgcgacgggagtacgagactaacactggaatcagaaaatatattattaagacattttgaaaaggagactagaaattcttaatttaatcagaagaaaattagagtttaagaaatatgatttaaaaaatttcaatacaattttcagaaattagagtttaaatacaattttcaaaggctcgagtagaaacacaatttagaaattactgaaattataaattttaaaaaataagtattgaaagaaaatccatctagaatacaacataatattaattaaatttcggatctgaaaaatatattaaaagaagagtccatctaaaacacaaacaagattaattaaatttagaaattaaaaataaaataaatcccaaaattagattccactacaatttctaaagagttcaagtagaaatacaaattataaattactgaaaaccagaataaaatatatagtatattggaataagagtccatctagaatacaaaataagattaattaaaattacaatttaaaaataacataaatccccaaagtggatttttatacgaattccaaagaattcaactaggaatacaatttagcaaactaaaatacgagaattaaaataagtaatattgaaagaatagtccatctaaaacccaacattatattaaataaattttcaaataaaataaaatgaattctaaaattggattttcaatacaaattccaaagaccccacgaagttaacccctcacttccccttttatactgagttcggttattcactttcccaactcatatctctcgtttgacgtggcacactttttaaactactaaacaatacgtcttttgtaaat

SEQ ID NO: 56432 - DNA, 266 bp, Oryza sativa
tggcgtgcatcggtagttacagtgaggcgatgctgatgcctaaaataagaacaagcaaaagacgtgtgctcatgttgcttgtggctgtaatgtacttctgtcctaatccgtactataagtatttggttaccggtgaatcttttctgagcgtgatggtgcataaatattctagctgtgtccccgtcgttggatggtttggtttgcaatcagtgtcacgtgagggcacacggtattgataagagctgaataccatcttgctgaatagg

SEQ ID NO: 56433 - DNA, 1501 bp, Oryza sativa
aataaggaatattagaagaggagactagagtccatatagaaatacaatttagaaatagttgaaattaggaattaagaaataaggaatattagaagaggagactagagtccatatagaaatacaattaggaaataactaaaattcggaattaaaaataagaaatattagaagtagagtatagagtccatatagaaatacaattaggaaataaccgaaattcgaaattaaaaataagaaatattagaagtagagtatagagtccatatagaaatacaattaagaaaaaaaaagaaatttggaattaaaaataaggaatattagaagtagagtataaagtttatattggaatttaaaaccaactaaaattcagaataaaaaggagcctccacgttcgctctcatggcctagaaattctcacattaatcagagaaaaaaaagcatagtccatatagaaatacaatttagaaatagctgaaattcagaattaaaaaataagaaatattagaagaggagactagagtagttattacacattagtagttttgaaaagttattgcaaaatttaaaattatgttgttattgtaatatattttaataatataatgagaaaaatatatgctattatatgagagaaaatataatgatgctagccgcgcaatctgcgcgggccaccatgctagtttatcatataatgctgagtactaagacggctctataatgcagcgtaaggaagcaaaaagggtggccttgggcaggttggacgagaatgtttgttgattcaacacaactggacagcatcctgcaacaagccaaccaccaccctggaagatagaaagtgtgatcaacgtctttgttgcaagaacatatcatggggtttgcgttgctgtttgttttgtgaggttggtgatagtttggtgtgggttttggtcacgcaatggccacgtaaatcgacgagatgcgtgtgttgtgaaaccatggtttctgcaacctccgctcgaataatttatttatgtttcttcttctatttatgtacgattcgactgtattttaaagtctgatcgtagtaagctcatcacttcatcagctgcgtgtgtgcctgtttgtaagtgtgtattttcaaagttatttgcagttgctcaatctgttagatttctaatggcaaactagttgagactagtgtcctttcaaacatatatactcactgtccaagagtgtactagtactctgaaatatagccggcaaatttgagagtaatcggaacatcaatctgatgaacgtcacactaccttgtgctcttcagctcttgggcatccaaaacttgtgtcaaaatgtccggatcatttgctattgtcctttgctcctgatcagccaccctattcagcaagatggtattcagctcttatcaataccgtgtgccctcacgtgacactgattgcaaaccaaaccatccaacgacggggacacagctagaatatttatgcaccatcacgctcagaaaaga

SEQ ID NO: 56434 - DNA, 474 bp, Oryza sativa
ccggcccctggacttctttctgcacacctatgctttctcgtcatttgatcgatgggcgcattacagcttgcgcacggcgagctggctgcgaccagcacgcagctgcatcctctgctacgcatgtgctcttcagggctttttgctcggaagaaaggcttgatttcgtcgtgggcgcgtgggtgggtctgttagttaggacatcgcgcgcgcgcaggcgcatctatggttcaacacccgtgtgacgtgatctgatcacacgcgaccgtcagcaccgagcgcatgacaacgagtgttgcgacggacacgtcgtacgtacatctcggctcgcgcgcacctcacgagtcgatcggttcgggcctcggcctgttgccctgttcggtgtggattttaaccgtgcggcgccgtgcgcccgcgcgggccgcgagcagaggccaccgctgctgggttgacggatacggaagagcgcgaaaacca

SEQ ID NO: 56435 - DNA, 1501 bp, Oryza sativa
tgaacccggggacagaggttgctccgctcctttcctcgcggaagggaaaggggacatccttgcacgtcaggttctgggagagcgcgacgtggggcatcgccgagaggatggcgagcgcgagcgcgagcgccagtgggccgagaggccatgaagccacagcagccgcctctgtggcggctggaatgcttgctcgcctgcacaccatgtcgcctatgctcaactgtacttctctgtggtgcatgcacgggagcgagaggtgatagggcccgagaggaccggggtggagtgggtcaatgggtcgtctttatcataggagtcgtgctaattttcttgtagattgttttggagattaataacctggaatttttatgtaaaaagacttgggccttacgagcctctaacaagaaaggtaggggaaaaaaacttgacgcttatgagttgctttagctcgatcggccttaattacaaagagctctagacaagctcaagcctaaaacaatctcacaagcctagccattgagctgaagttcaaagtagttaggggctatctatttttaatggcactgatttttttcttctgcgtacatttttttctttgtctagccgagttcaaagttatacaaggtctcatatatacgtattatgatattaacgattttgctatatactgtatttatcaacaaattttcttataaaaatttaacagatgtaaatttaatataattataatgtaattatattgtaacttgcatgtaactacaatataactttcacacaattttgaacagtcaaattttcttgaaaattcgtgcaagcgaggaagaaaagaatcataatgtgtgcccatgtgagtagattcagtcctacgacctccgtttcacggaaataccattttattgagggattttttgagttaagttatgttgtatttacatgcaaataggttgtaatgtaattacatcatggaaaatatgtagtgaaaaccgcatatgtagtggaaatctgaaaattaccattggataaaaatagacgtctaagacttgtccatttcatcaatagtaaaatttttacttatgattgaatttgtgagtaaattttttttactcttattggcgtggacaaatctcatacgtttatttttggatccaacaattgttttcatatattttccccttacattatggttgttctataattatatttgttaaatttttgtgttaaaatttgacaagaaatgcgtagatagtcctgatatgaattccttgtgacggttctttttaaaggaacctaccaaccgaaattaagacttagacttaacaatgatacttgtatttatggctattttttattagtagacaccgatcaacatctagacgcgtatggtgatttcgtcaatctcaaaatacatcgtcctagtttttttgaaggtgctaattaatagaagtaggctatgcaccgttaataataataataataataataataataataataataataa

SEQ ID NO: 56436 - DNA, 1501 bp, Oryza sativa
attgtttgggcatattatggataattgtttataggatgaattatatgttatgtattcaaagatagcttagaacaaattatcaagtaatactgaagtatatcaactcaaaaatcttcataaatcttgataaattatcaactcataaatcttgatatacgcgtaatccattaactcaaaacaacatatcgtactccatgtactaggacaacttaagtgtctcactacttaaaacaagcatttttctgtactatcaaaacctattttgcgtggggttgagctgcacgtctgcccagaagtgtttacgaaaattgctacttttccatgcagttggtgcacccgtgtgtgaaaatcatgtgtgggtgcttatatcatccgcacgcaataataaaaatccaaaaaaaaaatcaagacttgaaaccctagctaggacccatctgctggcaatgtcatcgctgcagaccgcagtccgccaccactcgtcatcgtcgccatcgccattgtccgccctcgttgttgtcgccaaggccgccctccacacacctccatttccccttcgcagcccgatggtggtgcggatttggcacccgtcacacggccggcgacggcggatacttccgtcacggggcaggcggtggcggatcggcctgtcatggcaccatagtcaccatcactgccaccaagcccactgctgcccaccacctcgaggtcgccgagctggccgctggccgctcaggaggggaactcggtgaagagagagaggaatgagagataatataaggaggataggaggtgagatatgagagagaaggtgagacttgaagtgctgagaaagaaaggaggaattaagttagacttctaggtggacctttaagagattcttctgcaaaaatacattttccaatatagccgtttaagagtctcgctagaaaaataagtctactttcacagtcagacctcttaaggagtctcttatgaaaatgcatttttgtacgccgcccgtcaacattccctgaaaaatgattttttgcagacgtgatcgttccggtacatagtagtgtctgtttcgtttaaaaaataacttaacttaattttttgttcttgctttcacgctcttgtcctatcattctccatatatataaatccatgtccacattatctcaaagaaaattccaatttcacataagcactgcacttcttggagataaattcccttcaccaccgtgacagttcatccacggaccagcaaattaaattaaagtggagcaaacctccattgtactttttccctcttcttccatgccaaacatttgtcgctgacactcgatattctttacgagacaatcctccaacccaattgcaaactaaatggggctttttggtaaataagttcacaagaaacaaacatcactactatagaaatcgtttttccatgcgaccaagcctagtagttacaagagcctcagtagcacctgaggtcctaggttcgactccccatgggagc

SEQ ID NO: 56437 - DNA, 1501 bp, Oryza sativa
cattagatgcagagggttttgtactacattttggctttagcacggtaggtagcaaaaagaagacgcacttgacatgttagtgtcgcattgatgttgcaatcctaccttttcaaattgtgccattctgtcatgctaaatctttgttacacgtggccaagttcgttcgaaagattttatctcggtttctgttagcgcgttttttaatatgttaaacggtacatctcatacgaaaacaactttcaatatagtagtggctttgaaatattagataaaactatttttttatttattttgtaagtttgaaataattaaaactcaaatgatcatacgttttctcgttttctatacccatacttaatattcatctaaatcacttccgttaacactgatttgagattggatggtagcatctcatctaaagaagatgaaactgcgccttcagtttcatttgcagaggtccctctttcaactttgattttttttcttccccggcgtttaatttggagatcttacctttctacttagagagttgagcttttgagttgaattccttccattatttgttcctcaccaccaatacaaagaatcatttctagtgttcgacactaacggcatgtcatttcctgccatcacattgtcaaattcaccacctaccaaattttaccccgaaaggaaatgggccatgcaataattctctaactcaatactgggaaggcatgttgttaaaaacttgcttcaatttccccgcaaatatcacattcgttggcactcctgtaatcctattcgtttccatgaaaattgttgagtcagagaagccatcggctggcatttagcccaacggttaagtgatgatgctgtctcgttttctcaattaccagaactcctgaatcattactttgtcaagagctacatttctaaccattgtaattaagaagtacaagatcgctgattgcacatcaacgcattatgttattatcagacacatgagatgtgctatcacaagtttatgccgcctaaccttcaatccttcagttctttccttcaagctggaaggcaggcctgccatcaccatccgccacaacaggctgctacacaatgagggcccctttgaatcaaaggatttatataggaatttcattggattcaaatcctataggaaaatttcctatttggccctttgattcaaaggattgaaacttttcaaatcctatgaaattcctatagaatgacacattgtaagtggattttggaggaaacttagcaagaggtccaacctcttggaaaaattcctttgagtctatatttctcatccgattcctgtgtttttcctgcggtccaatcaaacgatcattcctgtgttttttctgtattttgcaattctctgttttacacttcaattcctatcaggatgaatgaactgtactttttttatggaaaggcataggaagtcccgtagtagttgcatcaattaagtcagaaaaccttggccagaaagaattta

SEQ ID NO: 56438 - DNA, 1501 bp, Oryza sativa
tacaagattcaaaacttttagcgcactgttgatgttgctgccatgctggtcctttgatgtgctttgtgctgcagaagtcccatagcttgcaacaggtacacgaatagccgatgctactgctgctgacaaactgctgaaacagccacctacaagacggttgtgcataactgaagccgtccatgtgtgagccaatgagcacgattgaggagcagaaaatagcaagcaatccagagcacttaacatgtgccatggagtcccagtagagccccaaacatgtttggaagataatctgcacccgcaccttgggattaatcttgctcgctgaagaagaagcacataaatcatcaaaccaaggatagatggataagattggtaaggatagcaccatggagaaaataaaaatctaaaaggctataactaaatgaacggagagtaagattttcgatttgattcctcacagacacagcattacagcaatctaggggttccttaaaacaggagaaatcaaccaaaattcaaatggacctccccaggatttcagagttataaataaagttattgttcaaagattgataacagcaaaaaaatcaactacaaattacaacctgtgtagcaaatacaactatgcttctaaatgcaagaaaaatgtgtgatctaatcgctcgagaacagtggcggccccaggattttaaacttgtgtattcgaaatagaaaggggtaaaaaaaatttgttcatagacctaaaaacctaataattggctaattggcttgtatagtatcacaaactaataattatataatatatagcgtataattgagcataaattcacacattgatagaattgatcatcatttgaaattgtttaacatatagaatactaattagtaaacatatcaaagtgccaacatatgaaatacataaagggtagaaaatgataaattgggaagaaatcttacagtttggagatcaacttttcgttgtttgatattttggaaataagtgatgatgtccttgtctttaatttgcaagaaaaattctctttcaatgaatgtaactaaacaatcattcaactattgttgccctatcttgcttctcaagttcatacattatgatacaaagcacaaattagcatatatgatgcacagaaatatgtttgctaagtcgctagtaatctcaattaaaaaaaggttgttagcccattactagttcatccaacatcaggatcaggaacacatggatgctaaacatagaaaatcatgcgaaactgaaatctagatgcaaaacctaagtaccgaggggattcacatgagacaggagctagggattaaaccaaaccaggaggaaggatcgccggggggtgcggtcgttacctcggggctcgggacttgatttcttcgcgctgggcctcgaggcgggtagagcttgtcgtccatggccgcactgccgctgtcgcagcaggccgcgcgtcgcgccgcaatgccgctgtcgccgcaggccgcg

SEQ ID NO: 56439 - DNA, 1501 bp, Oryza sativa
agaactcgagagagatagttcgggagaggagatagatttcagagatagttgttgtgattacaaattcaatgattctctcttctccccttcgatgcttatatatttgcatcgggtacagctggaactcccacccattcagagccagctaagcgaacatttgcctttgtcacgcgcgtggaacgcagcctctctctgacgggattatccgttgccggatggtgtacagtagccgtaacactcccccgttctttagagccggcttgtccccaagccggggcactgcgtcttcctaagtagcttcagctaggattgtcctgtccacctgaccaagagttgtttaaccgtgccagcgcctttcttggaaactcgccgcgccaaaacttgaactggaccaattgttcctgattggctagaggtacgaacaggatttgatggagttggaggcaatgccttgcggagctgtgacacatgtacaacaggatagatagcacaaccagtaggcaactccaattgatacgccacagtaccgactttgctcacaacctgaaaggggccaaagtaatgaaaagctaacttatgattagctcatgatgccaaggaagtttgcgcataaggttgagccttcaaaaacacccaatctccaacactgaaaccctgtcagagcgatgtatgtcatcttgccatttcatacgttgttgtgctcgcagcaaatgctaacgaagaaggcctgtaatcattcccttctcctgccgccattcctctagatctgaaactgcacaagtagctccatccaacgcaccgaaatgtcgtggaggatgaccatacaatacctcaaacggagatgtccccaaagctgagtgatgtgtagtgttgtaccagaattctgccaaagctagcctccgtgaccatttggaaggacaagcatggacaaagcatcgcaaaaaggtctcaaggcactggttgatatgctcagtttgcccatccgtatgtgggtgataagccgaactcattttcaactgagtatcagcaagccgaaatagttcagtccataatgtgctggtaaagatgcgatcacgatctgaaattattgcttggggcaatccatgaagcttgtagatattgttgagatataccagcgccacatccaaagctgtaaatggatgagctaaagccacaaaatgagcataacgactgaatttatccaccacaaccaaaattcagtcaaatgtagaagatttcggcaaaccttcaataaaatctgagagagaccgtttgccaagcatgatcaggcaccggtaatggttgtaattaacctggatacttcactcgttctgcctttgcttgagaacaaacagcacattcagtcacaaacgtatgcaccgctttcttcaatcccggccaagcaaacaaacgcttgattctgctgtatgtgacctgaattcctgaatggcctccaataacgctagaatgcaaagccatcagaattttatgctgcaattca

SEQ ID NO: 56440 - DNA, 1501 bp, Oryza sativa
ggttttgaaatatgccattgatatttgtctatttgaaaccatgccaatataatttcacacctatctattatatgccattgcttacccattcagcacattttctaaacttataggaccaaattgtccctgccttcttcctcatcctcttcctctctatcctgttcatcttccatctccttctcttgctaaggtcgaggtgtggggaagtgagaaagggaggaagacgagagaacctgacatgtgggcccatagatgttttaaataaaagttggttgactggactgtcacgtgtatgccacgtaggaccaaaattgcactggattaagttagggaggtaattatttcggcataaaaagtttagggtgtaaaatatctgattttgtagttttaggggataaatcggaccgacacaatagttcaggggtaattcagactttttcctaaaaataagtaacaatatgttcacaaattattgttattagagatcatgataccttcaggcacctcactcattgcttgcacacatagcatgtatttgttttgggggaccaagtgggaaggattagacttatctatatttttagtacgagatggtcgcatccatatgggatggatgcatccgtttggtatgagggatgtaatggtcttaaaaactttttaagaaatggcccacacatcattgagaaagaaaagtaggtgggatttgtccgccagtttttgagggtacaaggttaaagtgaatcttagaaaagtattcttttttaggaacatctcatcccactgtctcaaaccaaacaccttaaaaaataggttcaacctaatccgaatccatccaatcccttgaacacatatagtggattctccgtgcacaagttaggaacatctacatctatataggatacttcatgagatttcctcacatggcaccttttccacatgatccaagagtcctgcagtacctctgctgcctgctggtgggcagtcaacatcaacattgctgaattatgacttgactgcaggtcatttgccaaggccatgggtgggtgagaatgtaaacacaccataagagtggtttggaatataggaatgactagtattttaacacaatttgtaacactagaactataataaataacttataaaataaagggagtactgttcggccggcttaaaataatatataagagtgtcgtttgcaatgccatcgatcaaggagagattttagtgctttccagcctgcctaatctacagctttgagatgtggaaaagcacaaccaggaatcatgttccgaaggctgatttgtgagcatgatcactcagggctcaatcgtgagatcagatcagatcagaagcatataatgtcgatcgtctgatctgggtgctgctttgcacaaccaagtccaaccaccgagctagcaagcatggggctggtgacaggggcgatggggagcctgctcccaaagatggggaagcatataatgtcgatcgtctgatctgggtg

SEQ ID NO: 56441 - DNA, 1501 bp, Oryza sativa
attattattattattattattattattattattattattattattattattattattattcctttatatttttttcccatctgtataaatgattaaaattacctttacccgttgcaacgcacgggcacagtaaaaaacaaaatcactctggacaaggtccggcacggcccggcccggcccattgctatcttccgttccacccgctcccgttgagctcaattatctctctccgatccccttccttccgcatccatcacccccaccactacatcacccatccccatccatctctcccccctccctttcctcctaaacttcagcggcgacacccctcgcgagccgctcctcctcatcctcctccgccgccgccgccgcgtcccctcggtgcccccctctccgccggccgccgatccggccccgcgaggtgaggatccgcccgtcgctcgccttccccttcgctccccgcgcgttagatctgcgccgccgaccccacctcgactggcccgcggcgcccccgatcggcacccccaccgtcgaggatgaggcgcgggggttaggtttccggtggccgccgtgcggtgcgcggttcgcggctgcttttttttttgggttaatttatgttgccgtgtggttcatctgctttagatctgcgccattttggttggggggaaacgttggttttgacgcggttggtacgaatcctgcgtgttctccttcggggctgtgattttgggggcggattgggagggcttattatttgccgtatgtgtgggtgcttctagtgggatgttacgtttgtgcgttggtggtggtggtattggtctcttgtggttcgatttggttcttctgttaccctgatgtgatgaatcactcgccgcacatcaaatttattcttctgcgttgctattttgtggttcaatttgtgcctggaaaggttgcaatttgtggttttgaaaatgtgcctggaaaggtgaaaaattatgttaacgatataccataaaaagctgagagggtggtccttgatctaattcgaattaagttgtctgagcttcattcaccagctgaaattcttctgttttaggtatcttgtttttagatctgttgacgacacaaggatctcttttcttccattgtgcttgatatgtctgagaatgtttagatgagattgttttctgacttttctccggaaaccatgtgtagataatagacgacatctctgttttacatctaatgagagtcaacaaatattgtatttgggcaagtcgtatattgtatgcttggtttgattgaaccatatattaattagtgatatagtttaggcttgattttgtgagttatatgcgtggttcactcttgaccttttagatttacatggatttgtttctctaatggaaccgtgcctaagatgagaaatatatgattataggttttgctagattccaatgaccatagagcactaatcttctttctttacagttgtaggaatccttgataaggctga

SEQ ID NO: 56442 - DNA, 1501 bp, Oryza sativa
ctgcagctatgggtggcggcagcccgcgtcaagaaggcgccggggctcgtcgactggttcctcgacctgtgtttatgcttgcggtggcagcagcagctgtgggaggaggtgcggtgtattctgggcagcggcgaggctaggttcacggagggaggaagggatcagtgcgatatgataggcatcgatcgattccctttcgtacgcacatgaaggaatagcctaggggaaaaaaggtcagtgtatgtgccaaaataaaaagaaagaaataattaaaaatggagaaaatggcataccagcaaggttaccttgtgagtggctggttgaacttaacgacatctcccccaaattcggcgcccacgattgaagattggtggatcgatttatgcaaaattacaccaaaagagattagaagacagaacttgggtgctttgataacaacctggtggaacgtgtggctagagcggaatgggaggattttcaatcatagataccggaacgaattccaagttgccctccaaattaaggaaaatattgagttatttgttaaatcgagagactagctctgctttcagttttctgagtcgctctctcttctttgtaatcttccagtttttctagcctaggcctatggcctaccaggcgtttttccttttccttcatgagacttttgtatggttttttttgttccttctaatatatccagcaaatctcctgccgttttatcgtttcaaaaaagagcaaggttaccttatttaatactggctttatttagattccaacttttttctttaaacttttaacttttccgtcacatcgaacttttctacatacgcaaacttcaatttttccgtcatattgtaccaatttcatcaaacttctaattttagcgtggaactaaacacacccactgtcattttaacaaagtcacatcgtggagtggcattacaatgtcaattttctcgcttttaccatgctttgtcttggggcatgagccatggcgctccacttgcgttgcgtgggggttctcttatacttcttctctattcaaaaatataaaggattttatgttattttcggttacttagatattaaaagaaaatatggtctcctcattcctttcatagttgattatatacttactagagacttaaaaacgatataagttatggataaaacttttatatatgtagttttaagctacttaaaataaatgctgaaaaaaataaactatattagaactgaatttagagttgactttaaagaaaatatttcaaagagaacttaaaaatcaactttaaattaagttttaaaatttaaattttggttataactgataaggtcaagatcaaacgatgagatagtaatctaaaataacttttatgatgtacaaaaaatatttttctatcaatgaggcgcacaaatggcgacttgcattgcaacgcaaccttctccagtcttatgatctccccggttcctcgaataatgagcaatgtgcaacgcc

SEQ ID NO: 56443 - DNA, 1501 bp, Oryza sativa
gatgtggccaagtgtgataagatatttgattatcttttacaagaaaaaaaattagattacctaaaggccatatcgtaccatctcaagaagaattgaaacgtcgagcttattgtaaatggcatgattctcattctcattccactaataattgcaatgtgtttcaacgacaggttcaatcggccatagatgaaggacgattgaagttcaccgatggctccaagatgaagcttgatcatgatccttttccggtgaatacaattaatttcaatgacaagaaggtgttgatttggccggagcaagccgaatctactaaaggaaaaggagtaatcattggtgaaccaaggccaaagatgatagtaccaaagaagccggaggttggtgtttggaaagagaataaaagtgaagcttcaacttctaaagctcctaggaagactaaagtgacccttgatatgcttttggagaaatatgaaaagcagggtggtgagagagctcacaacaaggggaaaagaccaagatcacctctttgggagcgatttgttcactcgctaagacggtcgcattcacctccatatcatcatccacaagacatgtcatggggttcttattcaatgccgccgccgagttatacttatccttattatatgccatggggggcaacatcgccaatgttcaaccatatgcctccaatgcaattcaaccaagggtggggaggaccaagaaggccaattcatgagcgtttttcttcaccaaacaatggccagttttatggtaggaaccgggccaatgaagaaaggagggaaggaaagcgcattaaggtggaggcaaggacttcggaagtgattaccatcaaagtagggtctcatgatgtgccaataccttctggagatgaagttggagagtcctcaagcaaaaaatccgaagctggtaccagctcatcgcagttggccagtctgaccaggtcttctggccggttgaccgcagccatacggccggtctgaccgcagccatacggtcggtctgactgggccatcaggctggtttgaccgccgaactgacaatggtccgaccgacgcctcaggccggtctgaccgcccaccgaatgtcggtctgacctgcgcatctggctggtctgatcggtagtctacgtctggtctgaccgggctccagcaccggtttgataggaggtttgcaaagggcgatgtgagggcttcatcgtcatcaactaaacctaatagggggcattatttacctcctggaacagagccgaaacctaggtggatacctaaggatttgacggctactcaaaggagaaggttgcaacgtcttcgggcccaagaaataagagagaaaaaggccaaagagtaaagggataaaaggttcaatgagttgcgaccaccaccggtatggaggcgtaaaaccatagagaaggaagaaccggttgttgtagaggagagggaagaacaatcggttgctaaagatgagtcatctccaaaagaagaca

SEQ ID NO: 56444 - DNA, 1501 bp, Oryza sativa
agctgctcaggcttgacaagcggtttaccgagttcgtacttgtatttcacttccgcctttgggattggtgcgcctcgtagaaattgatccgtagttagcccggtgtcagaaataaaatcttttattccaatttcttcaccggtcaccaatggctcgacctcctggtttggttgctctccaagctgagggactggtttggactttgcagaatatgctttcttaagtgttcgatcatagtccgatagctttatggcctccttggcaggtgcagacatacccctgaagaagtttctgacactagggtctataggaatcttcttttctgtaatttgaggcttcaattacctcttgacttctgctgccacataagattcaagctcctcttgcgtgcaatcgtacgccggctgcttgtttccggcggcgtcaactttcgccttcttcgttgcccttgtgcgggcaggcggtggagcttggtgggaccttgacttggaaggtgccggacgaggagcttgaggaggagtcggcgcaggagcttgaggagtcactgtagaagcttgagtaggaggagcctgaggcagagtcggtgcaggagcctgatgaggagtcggtgcaggagcctgaggtagagacggtgctggagcctgaggaggagatggtgcacgagacgccgcttgtcgcccagggaggatgatgtactgcttgcgccatagtataatggcgtggcttgtgtctcgtagatgcgtctcaccgtctcctccagggtagtccaactcgaagtcctcgtacgcggcttccaccaactcaacttcgaccttcgagtatcgtactggaattggcctgtagtggtaagtccctgaagggtctgttgggatggccattcccgatgccaccttcacgtggtgagaggttatctattagtaatcaacataagcagcaacttgcggaatggacaagtcaaaaatcataaaactatgagcataccttgattgataagttcttgaagggaatatgcaactcacatggtgtccgctgagtgatctcatcaacggggcaggtggtttcgtcctgagtttgcatggcgtccatgctctgtgatcctacctgccccgttgatgcgcagctgctatgattgcctgatgggctgaccattgcaggaggaatgtacggctagggatcctgagaccgatgtgcggccatgcgttcatccaccttccttgccacctcctcttgcatgctgagctcgtagctcgataccctgtactaaagatctgcaatctttgcctcggtatctcgcttgctcctcatccgactcctgtacgtgtggatgttctccttgaatccaatcttccaaggaatcacccctttccctcgtgttcgtcctggatgctcgggagtctgcaggttgagtgacagctcgtccttctctctgtcgggtcggaacgtgccctgagaagaggcttccactgcgttcgttagtcgactggcagcctcgtgtatctga

SEQ ID NO: 56445 - DNA, 1501 bp, Oryza sativa
ggctttaaggagaggctggtgtttttgcaattgattttatttgaaaccttttctgaaacaactaagtgagtgcttctcaaacgacacggatgagacagtgcgtctcgtccggtcggagtatgtgcaatgtatcagtctttagattttgaaacaaggttggcacccggccaacagcttttcaaacggccacccgggccaacaacttttcaaacggccacccgggccagcaactttcaaacggccacccgggccaacaactttcaaacatcgaaccccttttcacaacagccatatcacaagcagtagacaaacaaaactacgctaggaatcacctcacatccgcccatgaccgtgggcacggctgttcgaacagtttgttaacctctgcagagggggtacactttacccacacgacattactaacccggatcacccagcccgaggggatcagccacgtcgggagacctccaggctttcatgacaaggcattttcaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcaggaaaccgtacacccagtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtgtagtaattaacaaaggaaggatcaaatgcaacaaattaggtaggtctgccagtctgccttgcagacgggacaacaggtttagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatcttgagatttgaggaattttggaagttgaacggagtcaaacggacttacggttgggaagatattgaatttctaagattattggatttttggtctaaaggaaaaatgatttaactaaatcctttttggaaaagaaaaagaaaagaaaatgaaagagggagggattatagacttttcctcgggcgactagggcgcggcccaagggaaaaggagcggaccggccgagctaaa

SEQ ID NO: 56446 - DNA, 1379 bp, Oryza sativa
ttcccctgttctcgcagccgccgtccgccggttcctgctcgcggaacgccgccggaccgccgtcaccgttgcctccccgaggagcccgtcgccggaccgccgtcaccgttgcctccccgaggagcccgtcccgctggcttccccgttgtcgtctcgccgtcgccgccttggtgagcatccctcctctcctccctgctcccttccgccgcttgccgtgccgccgctcaccgcgccgccgctcgccgtcagtggccgatggccgtgcgctgccgctgccggtggccgtccggccggttcgtcgccgctgcgctccgcgcccgcaccactgccggctgccgcctccctttggtcccagccgcagtcgatctgggccgtcggatcggcctcagtctccacccgggccgcccgtgtgtccgcacacgtggccgccacgtcggtgctccgtcggcgccacgtggtgcgctagcccgtgtctccgtggacttggtccacggtaggccaaagcccttgagtcaccgacgggtgggtcccgtttgtcggcgccaccccttccctctcggtgacatcataaatcgagtttaattgcgcaataattcgttaataattctagaaattcatttaaatggctcaaaacttctaaaattcatatctaattcattcgaactcagaattgagccattcaacttgcaaaattcatctaaaattgagctctacatgtttgtttactttttatgtattgtttcccttgtttttattagagtttttcctcgttttgcatgctagcatgtagaatccgtcgtttcggaagttcgcgttcgcaaggataagagttcggaagattgtttgaagaagcaaggcaagtcacacattccccttgagcatgttgatcctaatttataactgttttaccgtttgcaaataaatatgcatgttttgctaattacatgggatctgggtattacctatctgctcgtttgtgccatgtttacttaatatctgtcctttgtcaaccctgggtaataaataaactagctcatgttacttatgtgacctagctagaactatattcttagccatgcttaattactactagcttagttgacgggataattacagtattagacctttttagtattagaatgagctgcgtgctcgagacatctggccatacttaatggtcgtaattatccaactaaaatgcgactgaatggtggactgtgggtgcatggttttgctagtcgcacccatggcagttaaggaccggttcgcgggaaaccctggaagaattcctcgtactttccacaagccagcgtgggcaacggctgggcttgtagtgtagctttcctctagctgacgcatctagacaagggtgggcgtga

SEQ ID NO: 56447 - DNA, 433 bp, Oryza sativa
tcagcttaatagaaaagcacgtctacattgtcaaattgaaaaaaatataaactatgcttatgcttatatattagcaaaaatttaaattttcaactttaaatttggagttggttttagggttttttcattgaagtttatttttcagcctttacttctagatcgctaagaacacatatatataaaagttttatttacaaattatttttcgtttgcaaatacgccatttcgcttatttcccgaataagtgaaacgatggagccgtatagctcttatgaccaagcgatcgagttaagctcacgattccacaagaccacaagtccatcccgtttgcctatatatagttaggcaacgagctactctcttagtattactaccgatcgattaaagccacgtaaggaaaaaaaaaagcccaaggtctctcggtagagcatga

SEQ ID NO: 56448 - DNA, 1501 bp, Oryza sativa
cgtttttgagctcatctatcagtatagcgatgggataaagaggctcatccatcgaagccatcagccttatcaaggattcctacaactgtaaagaaagaagattagtgctctatggtcattggaatctagcaaaacctataatcatatatttctcatcttaggcacggttccattagagaaacaaatccatgtaaatctaaaaggtcaagagtgaaccacgcatataactcacaaaatcaagcctaaactatatcactaattaatatatggttcaatcaaaccaagcatacaatatacgacttgcccaaatacaatatttgttgactctcattagatgtaaaacagagatgtcgtctattatctacacatggtttccggagaaaagtcagaaaacaatctcatctaaacattctcagacatatcaagcacaatggaagaaaagagatccttgtgtcgtcaacagatctaaaaacaagatacctaaaacagaagaatttcagctggtgaatgaagctcagacaacttaattcgaattagatcaaggaccaccctctcagctttttatggtatatcgttaacataatttttcacctttccaggcacattttcaaaaccacaaattgcaacctttccaggcacaaattgaaccacaaaatagcaacgcagaagaataaatttgatgtgcggcgagtgattcatcacatcagggtaacagaagaaccaaatcgaaccacaagagaccaataccaccaccaccaacgcacaaacgtaacatcccactagaagcacccacacatacggcaaataataagccctcccaatccgcccccaaaatcacagccccgaaggagaacacgcaggattcgtaccaaccgcgtcaaaaccaacgtttccccccaaccaaaatggcgcagatctaaagcagatgaaccacacggcaacataaattaacccaaaaaaaaaagcagccgcgaaccgcgcaccgcacggcggccaccggaaacctaacccccgcgcctcatcctcgacggtgggggtgccgatcgggggcgccgcgggccagtcgaggtggggtcggcggcgcagatctaacgcgcggggagcgaaggggaaggcgagcgacgggcggatcctcacctcgcggggccggatcggcggccggcggagaggggggcaccgaggggacgcggcggcggcggcggaggaggatgaggaggagcggctcgcgaggggtgtcgccgctgaagtttaggaggaaagggaggggggagagatggatggggatgggtgatgtagtggtgggggtgatggatgcggaaggaaggggatcggagagagataattgagctcaacgggagcgggtggaacggaagatagcaatgggccgggccgggccgtgccggaccttgtccagagtgattttgttttttactgtgcccgtgcgttgcaacgggtaaaggtaattttaatcatttatacagatgggaaaaaaatataaagg

SEQ ID NO: 56449 - DNA, 1501 bp, Oryza sativa
atagactgatgtaaacctatatgcgtggaaggaattcagcctcatagaaaagggcacgtattctcaagttgaaatttaaaatctccaaatttcaaagagatggtccttgtttgattgtccctaagttttcacttaatctttctcaggcctccacgttttgctcacattgcctcaaattattcggttatgaaaagagtatgaacgaatgcgggaggtcgaactacttgatgaacaagttttattttttcataattgcactattcattttgagaagatcatatatattctttttgatgagcttctttcaaaatagaataaaaaggtcaaaagtacccaaattatctaatcttcgtgtgattttgccttcagaattgaaactgaaatatattttttctgaaagtacttgattaaattagaacaaatttatgagggaggtgaatttgcccattcaccatttctttttatatttttacaagattttttaaactaaaatttcaatttttctaatgaacttaaaatatggttgaaattattcctactaaacattaaaatttaatttcaattattatcatgtttaaaaatttcaatcacttgaacattttcacaccctttgacaattaaaatcaagaagaaaaaaatatccctagtgagatttttaactttgtgttaggaggcagagatgatcttttttataagaaacaaattacaaacgtagagataataatcattttgagagagagaaatgctacctctgtttgaaaaaaataagggtacactttattttgttgggacaaactttgaccaatacttattctttcatggtataaattttagagtaagttttacaaaactacaaataatttgatcaaactatcacaaaactacatatttaaatataggtatcacaaaactacagatttaacaccaaggatattacaaaactacagatttaaaacttcattaaaaaactacatatttagtgatgaaattatcaaagaactacaaattttagagtttatagcgtagaacaattgaggttacaaaagttgtagttttgtgataaatctatgttaaatctgtagtttctgatataatacaatcaatctgtagttttgtgatagtttgatcaaaatacatacagttttgtgaaatttaatctaatttctatgatacaaagttaatgttgctaaaattttttaaaggaaacaaaatgaaaatttaggaatatttaatttaattaacagtgaaaaaaaacattgaacatgggattgattaattaaaaactgatcaatataacgaaaggcacacaaaaaaatttttctcaccttaaattcaattcaaaatgtcaacaggcagcgggaactgggtgtgacattaaacaagaaactgagggcaatgtgctacctaacctaaggctaaaggccataaacaaactacaaatgccccagcaactatcgattcgatgcctcatatgtatcgtcaaaactcgatagttggaaaa

SEQ ID NO: 56450 - DNA, 1501 bp, Oryza sativa
gatcgagtacccaaaggcaaaattgtcttccaaaccaagtctccaacttgaaacaactttgctttcaccctcttgttgtacgccttggccaccctcttcttttctttctctatctcttccaaagccttcaggcgcttgtcgatgacttcatcaaggttgtctcccatcaacgtcttgtaatctttacttgacaaatcatcttgcctgatgtaacgaagataaccaagatttacctcaaccggtaaaatgacttcttgaccataaaccaactcaaaaggagtgactttagtggcaccatgtttagatatcctatgcgcccacaatgcttcgaaaagcacttcatgccacctctttgggtgttcctcaatcttctttttcactaatttcaacaatgtcttattactcgactcggcttgtccattagcctgagcgtagtaaagagaagaactcaacaatttaataccataagattcggcaaaattcttcacttccttagatataaaagaagcaccttgatccgtagttaatgtttgtggaataccaaatctatagataatatgcttcaaaataaagtcaattacctccgtatgagtcatattcttcaacggcacatcttcggcccacttggtgaagtaatccgtagcaactagcacgaacctatgcccctttgatgacgaaggataaatttgaccaatgaaatctaaagcccaacctcggaatggccatggtttgattataggattcaacacggcggcgggcgccaattgaacattgccgaaccgttgacaagtttcacatcctctataatatttgaagcaatcatcaatcatcctcggccaatagaaccccgctctcctaagcaaccaattcatcttgtgggccgattgatgagtcccacaaattccttcatgtacctctcccatagccactttagattgatcttcatctaagcacttcaacaagacaccatctatatttcggcgatataaatcttcatcaagcaatgtgtacttgaatgcttgccgtcgaattttccgatcaaccttaagcgtgggatctttcaaatatcgaatcaaaggaatcctccaatcttcttctgtttcttgggcacaaatgtccgaattcacaattaattcggccttaaaattgattgaaacgtgccctccagcgctctgcctagaaccggtcagaccggccataccaggtgtcacaccctgaagttctcctcctaagcctaaaattgaatttataaaccagcctaagaaaatgccggtgcaaatcaagacaaaaccttaataaactaatgcaaataataatcggaattggcatgtggaatttttcttgagttctacatgtcgaaatacgctaacaagatttttagtggaattttcagagctctcgaaataattttaaccaattaaaattgagcacatgcaattttaatcccaggaaaaatcatttttccttctttttcctttttctttcttttcttttctctttt

SEQ ID NO: 56451 - DNA, 471 bp, Oryza sativa
gcaaagcctgcgttccatgtgttgtcttgtcgggccctagccatcagcgtaggcatgcatggcaatggagccacaccccacagccatggagccatatggaggtagggggaggaggacggccacttcctcggattccgtggcggcaatccctcgcacgtacggccatgtgagctcacctgccgccgtggatcagggcgctcagctcggagacggtgcaatgaaatgaatgcacgcacggcctggtcggggttccagggtgattggatggctttgcatcccgtccactcacagcccggacggaccggctgctgcatcgatgcgctcctgcgcccccaagcagccgatcagatccgtgatctcactgtgcgacgcatgagtcatgtgcacgagctagctgcacgcacacgcgaacgtctcggtggtgaaacgcaatgaaatggccttcatgcatcatgcatgtatgggtggatg

SEQ ID NO: 56452 - DNA, 250 bp, Oryza sativa
tcgaaagagttttgggcttcatagtcacgtactaaaagcttattgctccaaataggcttattaatgggcctttcaagtgttttcacgaaggcccaacccaatcagaaagtaagcacaactaggccgctatataaatgcgagtaacccgttcgagtcgaaaccctactgcgcctccactcccacccgtagcgcctccccgcgaacccactcccagccgccgccgccgccacctgcaaccgagggctcgcca

SEQ ID NO: 56453 - DNA, 1501 bp, Oryza sativa
tttagtttttgatataacatttgactcatcgtcttatttaaaaattttctatgattagtgtttttctcgttactagataaaacatgaatactccctcatttttagattttgacacagtcttcaagatgctacttgatcaataatatctataaaagtaaaatgttttaaataaaaagaattgcacatgatagttgtttaatgataattctagtaacaatcaattttacatgatcgatctttttttctactaatagtcaaaattaaaaatgtttgacttgacactattctaaaaattattatattttttgtacggaggatctagtactttatgtgtggttaattttttttaaaaaaattttcataaatttttcagataagacggatggatatactagcttcattattttcaatataaatgaacaccactgtagtatatgctctctccatttcaaaatagaaggcaactgaggctcttataaccactgggttacagtccctttcgcattatcatcttattgttagaatcatcctaataaatacaatgcatgtgtccaatagaattagaaattctaagagtgaagaatttaaataataataaggaataagtctacataaccccaccaactatcacagcgtgactacttaaccccctcaactatcaaaccatgtatcagacccctcatctttctaataccgtttaattaaccccctgaggtagttttgccaggtggtgtgctgagttggacaagcttcttgtgttatagcaggctgacatgtgggcatgcatgattttgtgacactcaaatgacctgaaacacttatgcttaaattctgaatgttatggcgttatttccgctagcacctgttgcttaaattctgaatgttatggcgcgctagcacctgttgctttgaattgtacactgaaatagcttttcatgatgtagcagccaattatgtttgtttcggtggaaatgaatagttcaaattatgatctaatttgtgtttgcattatgattatgtgcatgctgtcatatacttttagtgttgattttttttaagccgattcaatgtccagagtttaatcctctcacttacaagccggtctacatgtcagcctgctctaacacaggaagcttgtccagtttaacacgccaccgtggcaaaaccaccctccaaaaccaccttagggggttaattaaacaatatttaaaagatgagggggtctaatacatggtttaatagttgagggggttaagtagttatccggtgataagtaattttaaggatgctagttaattgcatatatgtcttgtattatagaacatctgaaaaaaattggggggagtaaaagttttttcagtctcatgagaatacatagaagttccaggttaatctgagaaacaattaaaaatttaaaaccaacatgtagccagtagccacaagagaattagcacgctttcggcgacaatgaccccttcacagttcacactcccaacatagc

SEQ ID NO: 56454 - DNA, 501 bp, Oryza sativa
cggaagatccgctctttgtggaagtagaagccgacgtttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttattattaattatttccttgttcaccctagagtaaacaaaaccccaactagtggacactctactcatggcaccactagtttaattttaggtagatgcttcgcaatttaattaggtaacattaggtggttttacaactctagactttgggaacattcatatcacctggacactatggaatggtttggttattgtggaattggcttcacaccgctccttctattcaaaatccccaaattggttttaggctgggctcgaggtgcgtggttgggttttgctagtcgtacctcgggtactataaggattaa

SEQ ID NO: 56455 - DNA, 232 bp, Oryza sativa
atttcataatgtccgcagccaatgttatagtttgaacctaagtgatgagcaactagcagatcttgcattccaaggattgtcagcaccaatcagagatagattcttttgccacgggtttgacagtctagctcatctaatgcaaacagtatcagctcacgaaagccgattgcaagacgcaaatgaagatcagttttggagttatcaagaccagacagaagataattttgaagca

SEQ ID NO: 56456 - DNA, 407 bp, Oryza sativa
cacagatgtcaaatgccccattgaaatccttggagctgagaatgacgctgtaacaccaccaagattagtgtaccagtttgttaatgccttgcgccaaagacctgaggtaagttcctgttgattttcattggcacttgatgccaaatgcatcagcatagtcccacggtagacacacacgagaaaaatctcccactgatgatgagaaattgaaagatcatgctggctctatttttctttttgaggcaatattggatctagctaattagtaacattaatgaaaagtccaaacactagcacattgtcaataaacaagtttacaattgtttcttaaacacaaccactcaatgatctttaagaaaagaaacaagttatgaagagcctcttatggattgcatctttgttgcagg

SEQ ID NO: 56457 - DNA, 1501 bp, Oryza sativa
agctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtacaagaagggtatagtgactcaaactggatatctgatgctgatgagataaaagccacaagtggatatgtgttcacacttggaggtggcactgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacaaacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtacattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatgg

SEQ ID NO: 56458 - DNA, 1501 bp, Oryza sativa
atctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttttcttcgttttgcgtgttagcttgtcgtttccgtcgttgcgaaggttcgtgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttggattattataacttgacaagttgagctttatatattggttcagctagatattagatatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacctttcgtatagcatggttcattgcggggcaccagactgagaagtggcggagataagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttaggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaa

SEQ ID NO: 56459 - DNA, 965 bp, Oryza sativa
taaggatccccggtgtctcctctacccgccgccaccctcgcctttgcctctcgtcgtccgtagcgccctagctccgtgtgccctagcgccgccgtcgccgccgtcgctccagccgtgcgccgccgccgttccagacgtcgccgtcgctcgggaagatcgccatcgtggtcgccgtcgcgtcgccgtcctcgtccaccgcttcaccgccgccgaagaccgtcggagcaccgtcgccgccgtcgacccgatcttctccgccaccttttcctcgacgccgccgccgtccgttggtcttccgccgacgttttggtcatcggtgagttcgccgcgccgtgatctacgtcttggtgccctccgtttgtgccgtagagccgccgttcgccggcgagcatacgcgcccgagccgcccgagtcgccgccggtgctgacgtcatcgctgacgttgtcgctgacgtcatcgggaccgtccgccgtgagccggtcgtggaccgatcgatctcggccgtccgttttggatagggttgatctcggccgttcgttcccatgaaccgttgccgtgcacccggtccaccgcgaaaccctagctgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttt

SEQ ID NO: 56460 - DNA, 1501 bp, Oryza sativa
cagatctaatctccaatccaggagctaagcaaattattaccagatataacatccataattattgtgagaagtgtgggactaatcacgaaaaacattgctcaacccgcccataaccgtgggcacggctattcgaatagttttactctggccagaggtgtaccactgtacccacaagacacagccccacatcatgtcaccatgtgcctcagtaccaccacggtacctcggaaaggggctgtgacattaccccttgcataacacaatccaccgcagtgcaccattcctggatcataatcacccccttataaataaggcatggactccccagcgacccccgtgggcttatctccgccacttctcagtctggtgccccgcaatgaaccatgctatacgaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaacttgtcaagttataataatccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcacgaaccttcgcaacgacggaaacgacaagctaacacgcaaaacgaagaaaaagactaataaaaaccaaataaacagtacatataaagtaaacaaacatgtagatcataattttagatgaattatgagacttgaacggcctcattctgacttcataagaatttattatgaattttacaagattaaatctaattaaagcccatttaaaaagaattaaataaatttaattctatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcagctagggtttcgcggtggaccgggtgcacggcaacggttcatgggaacgaacggccgagatcaaccctatccaaaacggacggccgagatcgatcggtccacgaccggctcacggcggacggtcccgatgacgtcagcga

SEQ ID NO: 56461 - DNA, 1501 bp, Oryza sativa
tcatggtgaaaaaagtaacaaccatagcttacagacctgttttcttccatctcaaatatgtagattttgctggaggcttctttgatgaattccaacagtctaatggaggaggtggaagacaatcaaataatttgctaaaaaaaaggaagagaagaggccagaacttcacctgtgcttgatcaatggttgaatccgtggttcgctgtcccagcatgttgtcagatgatcgcctggggccatggcctcgtttggcgccaaaaaggcgagcgcgaccgccaaaacgcgtttgttcgcggtaaaaaagataggagcgatggcgctgggacgaggcttgttgggccagccttggcccagactcacgacgcggctgacctgtatttctgggcggacggttcaatcgaacgtggacagttggatgacctcgactgctctccgccgtcatgaggggtgaagtcagatgagctgaatccctggagaaagcattatagctaagtgatacaatagatatatcatatacttactgtaacacaaatattctttttgtttttataggcccaccatccctctactctctttcttgccggaggaggagatgcgtgggaatgttttatccttcacgtgctcaagtccaaggacgaacatcagtacatcatggccgccgggttcatccggtccggcccgcgtgcacgtctggcgctggtgtactaggagacgacgactgtggtggacggggatggcggccgctgcaaaggcggacgatggtggtaggacgggtgtgtgtgaggacgacaagatggatgaagacgaagattgcgcggcgcaacggatgtgggcgaggacagcgggatggacgaagaccaggacagcggcccggcgccgtggatgtgggccaaaatgacaagattgacaccggtgaccacggcaacccgttaagataagaacacggccggccccccggccaccaattgaagcaccgggttgcttattcaggcggccgggctggacgagaaccacaacggcgacggccaccgccgccgtggacgaggtccgcagccgaggcggtcgcggtgggcaagggccactgccaaggcgagcagaggcgatggagacgacggccatggcggacgagggtggcgacaacggtagacgagggcgatggagacgccggccatggtgcacgaggtggcggcccggtggagcgcgacgacggcagatgagggcgacggagacgctggccatggtcgatgaggcggcggcccggtggagcgcgacgacggcagatgagcgtgacggcaacaacggggaacacaagcggagcgaacgcgctggtggtgataccggcggacgcgggccgagtggatggcgatgcagacgcgctggtgggccccgctgcctcgggcgagcgtgcagtcaagcgactaattaggccatccccaaccaataaactattagtttccatacttgtcatgtcatatagacactatatgtagacactatgtat

SEQ ID NO: 56462 - DNA, 456 bp, Oryza sativa
atttaaattattgcattaccgctttatttaaattcccgcgttatcaccttgggttttttttttttaaatttttaagcgcccaattggccccctttaattttttttaaatttcccggttttttggtttttaaagaaccattaattaatttgctatttgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 56463 - DNA, 202 bp, Oryza sativa
aaatctttgcaaagaacttttttaagtaaaaaacctcttgagaaagagtagcacaatttttgcaagcatccaaaacactcttttattttctacacgttgagcaagacatcacttcatcttgttaacaatttcctccatgtgcttaacacgacccaaagcatattttagtttcatctcattagcaacacatgttgtcgaaaca

SEQ ID NO: 56464 - DNA, 284 bp, Oryza sativa
gattaagcaatctagtaccaaactttgtttgacatgtgtggatattatgggtaccccatacccatacggcatggttatccgactagtcataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagagatatatga

SEQ ID NO: 56465 - DNA, 1501 bp, Oryza sativa
aatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgactatgtggttaattgaacaaaccaaacatatagtcaaggaataaataatctaaccaaccgagtggtttcgataatagcatatgatgtgtgaatccctgaataatatgatccaagtgatataccaactactttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatcaaatcaattgcttaaaaacccaaaacagctcttgacttatatataaaaaagtcagcggggcagctatataaagctttactgtttgacaccttttaagatgcattgttccactcctaaaaaagttaagtaactgcggtataaaaggattttaagggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaacaaatcttctgggtaatatagaccaagtgtagctcatatgaatagcttctgatctgaatgattatcccttatgggatactccaaaataaatataataattgaatcccgactggcgcaagtattcggttgatagcctttacggggaataataattggtccagtctttgagcatagaaaatagactcatgactatgaatccatgtggaatgtatccggaacaagtccgaattggagatataatcctcacgcttgagttgatgagcccctgagcatatagcttgtccttctgtcatagtcaaaattgtctattggcaatagctgacgcagtcggcatggagatgaaatgactaacatgaagacgaaattgctcatcagaagtaacggaagatgtcagtggtagtaaaaaacagtgacaccaatcaaaggtaatgaagttgcataaccatggaggcgaagaaacagtcggtgatgacaaaagcaaaccgacgatgaagatgtagacgcgcatcaacagtgatggcgaaatccaccaatca

SEQ ID NO: 56466 - DNA, 340 bp, Oryza sativa
ttttccacgtttaatttttgttttgttttcatagatcaattttttccttatcatttctaaaatattttgacgttcgtgacctttctcccattttttttattttatccgaattttccaacatgttttactcattttctgattttaaagtgtagtgaatggtagtgatcccttctaatcccacctctgtccgaacagtctaacgtgagagggatgagaggtgggggattcgcaggaagccaggtagggattgggtgtggggtgtggggacaacccaaaccccacgtgggaggctttacccggattaattcccacagctagcgaacaaagcctcaatttgaaa

SEQ ID NO: 56467 - DNA, 294 bp, Oryza sativa
agaattaagggggaaagagagaggagggaaaggggattaattcccccctcaggccttgttcttttcggctgggtttgagggggggggggaatgggccaaaatccccgtgtgccatcccggccgggtcgaattttcttccgtggcccatgtatgcgttcgcctgggctggggtcggagcaattctccacccaatccacaccaattccacggggagagaaaaatcgcctcggagacgatttttcttttccaagccagccgcagcgctcggcctcctcgactcctcgctgcgctagg

SEQ ID NO: 56468 - DNA, 1501 bp, Oryza sativa
catctaggcttccgtcgaagtcgttgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgctgtcgtggtgaagacggccgctagatcgtcggggagcttcatcaggatcggtgggtaagccccatcatcttgatctggcgtcgttggagaaaatgcgatctcggccgggtggtttgaagccgactcgatcgagatggtcttgaagtaactttcagccgcgtttgggaatccaaacgggactggaagtcgattctctcccgactggtctgattccgagtcaaggagagaaatcttgccgaagttgttggtgacgaagtcgaggctgccgaaccgaaacgtctgccctggtgggaagacgaggtcgtcgatgccggtgacggaacccatcgcactaatcggcgaaaggcttgacgctacccctacctggcgcgccaactgtcgaaactagatttcggcaataataaaagggggtggctatcaagctcggaaagtgtatgggtttggagacaaaagatttatacaggttcaggccttcttataaaagaagtaataccctactcctgtccggggatgaatccgccgagtgtattattgatggtatgattcgggaaaaatcagcatctacccctagaggcgcccggaccccccttatatatgggaaggagtccggattacaaaagataatctatattcctaacggaatatgaagatataggtaaaatacaatcgtaaccgactaagtctcagggtgtttccttgatatacaagttaagaaacaaacccgagatacagataagatattctatctacattaagtatccggtacccaatccaaataccgtcgccatgtagatatgggatacccataatctccacaaagatcatcccgctctgctgcgtgacaggcctacgagtaatgccagccggtatccatgtatccttccaaatgtcaatctgattggcatcaccaactccccaaatcagtactcattcagagctttcaagcctcgtacaatacttctccaatctccagggatatgaagggtatatttagatctcactttaaaattttacaccctttcgcattgaacatttgaacacatgcataaagtattaaatataggctaaaaaataaataaatgcacatattgcgactaatttgcgagacgaatcttttaagcctaattgctccatgatttgacaatgtagtgctactgtaaacatttactaatgacggattaattagacttaataaattcgtctcgcgatttactgacggattctataattagtttttttattagtgtctcaacaccccatataaca

SEQ ID NO: 56469 - DNA, 1501 bp, Oryza sativa
gtcccaatcaccagtggttggatcaatgaggtctgcaactttgttcaagattgtcgaaactagatttcggcaataataaaagggggtggctatcaagctcggaaagtgtatgggtttggagacaaaagatttatacaggttcaggccttcttataaaagaagtaataccctactcctgtccggggatgaatccgccgagtgtattattgatggtatgattcgggaaaaatcagcatctacccctagaggcgcccggaccccccttatatatgggaaggagtccggattacaaaagataatctatattcctaacggaatatgaagatataggtaaaatacaatcgtaaccgactaagtctcagggtgtttccttgatatacaagttaagaaacaaacccgagatacagataagatattctatctacattaagtatccggtacccaatccaaataccgtcgccatgtagatatgggatacccataatctccacagtagcccccgagtcctttgcagtcgaccatcgtagccttctcaaggatgataatccgagtacttcaaactcctcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcatcatatgacaaaagcatacgcggcgcctaaataggcatgctagccgactgctttttagccacaataaaagaaatccgagtggtttacactctaaaaggttcacgaacgaacacacttgataggcatccgaatataaaaactctaaagattacccatcaagcattataaagattatggtaataaataagtcaaatagcctaggccatgactatttaccatgaaaacaggcatataacacgccaaggaaatgactatagtaaaaacaagtcattcctagttaacccaaacagcttttgtagcctaaaaaagctcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaattattgggctgaagtactgttcaggcctaggcccattagcacctccgatacccttaactgaaaaaatccgatatccaagcgacgcttcgtcttccccgccggaactctcgccattttccccactccccgctacagtgcaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaa

SEQ ID NO: 56470 - DNA, 1139 bp, Oryza sativa
tatatgtaaaatttgtgaataatattactatcactttatcggatgaagaaatgaccaaaataaaagttatagatattgatgagttatacaactttattgttgatgacttttttagttgaaatcatttagtacttgaaaatattgtctgaagttgttataatttgaaattcaaattcaaattatagaaacaaagtcatatagcaaaatgatcaaaacaaaagttgtagatattgatgagttatacaactttgttgttgatgactttttcatttgaaatcatttagtatttaaaaatgttgtttgaagttgtcataatttgaaattcaaattcaaattattgaaacaaagtcatatagcaaaatgaccaaaacaaaagttgttgatcttgataagttatacaactttgttattgacatttttttcatttgaaattatttactaccctaaaaaatatttgaattgagaggaaggaggcattatagacttctcggcgagggaggagcaaaagggctgggccggcggcccgaagagggaggaggggaaggggaagccggcccgtggagggagagagaggctgcgggctacgggctacgggctaatagtgtatactttataccttataccatggtattttgctgtaatttttttagaatatttgttatacaaattatatgaagttatagaagaatatattttgttgttgagacttaccaattagacttcatataattgtgttttataatgaattgttgactgttaaaacttgagaattgaacttcacaaaagtttgaagctcagtttgaggggtttctgtattccgataaattttcgttaccgtatccacaccggttcgttttcgctctgttttcggtttcgataatattcgtttccgttttcgtttccggggtttccgattccgattccgattccgaaaaaaatatggaaacgaaaacgataaaggttgtttccgtccgtttccgtaccgttttcacccctatacaaaaggatgttcatttcattttacagggggggcagcagcagagagagtacagaggcacgagccgagggccggcctgcagttcacgccgccgccgccggcaggcgctgcgccgtgcccagccttggcagtagtccataga

SEQ ID NO: 56471 - DNA, 1501 bp, Oryza sativa
agaatagcgagagcgatgtttgcgctattgtgggagagagatatcggaagaggaagagacggcgattttttcggagaagagatggggagcggaagaggcgcgagctttccagagagaaggcggccggcgtattttttttttcacatttactcacgcgtgggaatagattagatatacttacgcaggggagtatccccgaataatgctgcgccacgtggcgtttgtctctggccgggaacgtgcatggaattcgtatatagagatacggaccaagaaaattacattagcataataatccgtgtgtaacacatattatatttttttcctttttaacccgatacctacacctatcaaattcgatacgtgagtatcacccccgatacttgagtatcagagccaatacctatagataggggtgggaaaaaaaaaccgaaccgaactaaccgaaaccgaaaaattcggtcatcagttgtaactaaccgaattttatacggttttttcggtcatatccttcagttaaccgaactaaccgaatcaatatgaaggcccaatacagcccaatagcccattagcgagaaaaccctaatcccccgtccccacctctccttcccactcctcccgtcctccccaggcccccacctgcgccgcgctcgcgcctgcttctctccgctttctccgctttctcctcacatcgcacatctccgctttcttctcctcgcgccgtgccacagccgctaccttctcctcgcggcgtgtcgccgccttctcctcctcgcgctgtgccaccgccttttcctgctgaatcgccgccgatctgcacatcctcgactccgacgaaccctcaactcatggtggcgccgcctcctctccgacaggtgctgtggaggtcactcatagctcctagatccagcgccgcatcccgtcgtcaaggtcctcatgccaccggcgaagcccacctccacgtgttgctcgcgccccttcaactcctcttcggttagcatgcacttttgtggggtttttttttcgatctaaaattgtggatggtctgtgttttattcatctcaagaatctcggtcgagaccgagaccgaaaaaaccgagaccgaattgtccggtcttcaattttatcgaggaccgatcggtcttgactttctgatgaccgaaatttcatccaggaccgaagaccgagaccgaattgctcggtcagaccgaatgcccacccctacctatagatatcagatccgatacatgagtattaaatccgatacatatagatatcagatccaggacctgagtatttgtcacaccccaatccggcaccgccgcacaacggcacctgacaggagcgtgtcgtagaaaaaacggcgcgaaccgcttccttacgaaaccgcgatctcggtaccagtcccaggacatagtgctggtacccacggtgacaaatatgaatcatagcaatccttaaaataaatagaggacttatttaccttaacttaggttgcagc

SEQ ID NO: 56472 - DNA, 1501 bp, Oryza sativa
aatttagaggcaacatgtagaggcttatagtacttgccctaacagttactcctacaacttcttttaaaatctccggagggccccattcgtttataaagaaacacagtataactactaaaaataattagccgtaaacgtaacacttatgtcaaatctagagttgacttaaatccagataaactagttcaacctcaaataacctaaccggttatttgagctatcgcacaatcaatcccaatgtttgcaatgttttgctttgatctaacaaaaaccctgtgcgatgagataattactgtgatatgccagtttttctggccccaacgagaaaatgaaaataaactacaccggttatcctgggatctctcttgtgcagccgcaagtcgaaaggtgggctgggttatagagaattgcatctgttctggccatgctgtgctcaagttctcacggcgaaatactaccgtgtggcaaacttctgaatgctagggacgggccggggatttcggggatgtttagattcagtggtgtaaagttttggcatgtcatatcggatattatatagggtgttatatggggtgttgagacactaataaaaaaactaattatagaatccgtcagtaaatcgcgagacgaatttattaagtctaattaatccgtcattagtaaatgtttacagtagcactacattgtcaaatcatggagcaattaggcttaaaagattcgtctcgcaaattagtcgcaatatgtgcatttatttattttttagcctatatttaatactttatgcatgtgttcaaatgttcaatgcgaaagggtgtaaaattttaaagtgagatctaaatatacccttcatatccctggagattggagaagtattgtacgaggcttgaaagctctgaatgagtactgatttggggagttggtgatgccaatcagattgacatttggaaggatacatggataccggctggcattactcgtaggcctgtcacgcagcagagcgggatgatctttgtggagattatgggtatcccatatctacatggcgacggtatttggattgggtaccggatacttaatgtagatagaatatcttatctgtatctcgggtttgtttcttaacttgtatatcaaggaaacaccctgagacttagtcggttacgattgtattttacctatatcttcatattccgttaggaatatagattatcttttgtaatccggactccttcccatatataaggggggtccgggcgcctctaggggtagatgctgatttttcccgaatcataccatcaataatacactcggcggattcatccccggacaggagtagggtattacttcttttataagaaggcctgaacctgtataaatcttttgtctccaaacccatacactttccgagcttgatagccacccccttttattattgccgaaatctagtttcgacagttggcgcgccaggtaggggtagcgtcaagcctttcgccgattagtgcga

SEQ ID NO: 56473 - DNA, 1501 bp, Oryza sativa
ttcacggttgggatcatgtttgccgtcgaactcgaatgctgtgcgggatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttggtacattggaggaagacaagagtacccgggaagagcaggttcaggattctgaacatagaaccagtttgcatgccatcctttgttcgaagtcttgaagggcattgagaaatatttttggctcagagttccccttagttggaatcctgcccccccgactacacatggtttgttcttgtttggttggggcttgaggaagaagatccgacggaatagggcaaagtgaggtttgatccccaaaaaggcttcacaagcatggacgaaattggcgatatgcactatggaatttgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcttctgttacgtcggatgacgcccattgaccttcgaagctttctctctcttccgccattggtttcactcaaatgtgttgatttgatttgagggatggcttgggagaggtgagggattgaggcggtggatcacgggaaggattttgatgcacttttcggaggtggatttggccggagttgtgaaccctagttcgccggcgcagctttgcactgtagcggggagtggggaaaatggcgagagttccggcggggaagacgaagcgtcgcttggatatcggattttttcagttaagggtatcggaggtgctaatgggcctaggcctgaacagtacttcagcccaataattttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgagcttttttaggctacaaaagctgtttgggttaactaggaatgacttgtttttactatagtcatttccttggcgtgttatatgcctgttttcatggtaaatagtcatggcctaggctatttgacttatttattaccataatctttataatgcttgatgggtaatctttagagtttttatattcggatgcctatcaagtgtgttcgttcgtgaaccttttagagtgtaaaccactcggatttcttttattgtggctaaaaagcagtcggctagcatg

SEQ ID NO: 56474 - DNA, 812 bp, Oryza sativa
caagcatgatttatacagaagagaacggagcgagcccccagcattagaccgtagttggcctgacatcggaagcactcgcacaatagatattgtttaaaaaacatgctctaggtaaacataataaattatagatctgacaatatcgtatagattggaaaaataggtacgataaattgtatataaattaccgcgtacctgtgtagatatatgccaaatatatctacgaaattagtagatcaattaaattattcaacctactaattgccttactgtgtatgcttggtgaggaatagtaactccttaattgatccgattgtgtgtatggtactgttccccatgtaagcatgaaccttgtattttggtcctttaattgatctgtttgccacgtcgttggaacggccaaccaggatgctgcctagagattggattctagtgcgagcataagagaactcctccaatccgacttagaatttacacccatgtacatatcaatctggctctagatttcagctccacggcgctcgttttgttggtggagataagccgagttcggtttgaacttagccagccgatgtctcacaccagtcgatgccgcacaccatggaggaatcggtgtcggattgctcttggatgccaccgacacagtagcactcctcggcgatgatggttctgatctagtcggaagatgtcttggacaggttggatctccccacagccgaagtcgtcgagtagcttgttgtcggagagtccatctcttaaacccatctcgtcgaaatcctgaagcaccaaaatccccctacctggcgcgccac

SEQ ID NO: 56475 - DNA, 181 bp, Oryza sativa
actctagaggatcccctcgtaagctcataatctattatgaaccaaataacctagcgattgatggcgattaaaatcaagtgatcaaccaaagagacatttgtttggaccaagggtttcagatatgtcttctttggatcaaaggcatgcacccgttgtggagaaattggacacgttgctagca

SEQ ID NO: 56476 - DNA, 747 bp, Oryza sativa
aggatcccccatttttaaattaaaatttaaatgaagaaattcgcaaatattcatttaaagagcatataaacttcaaatggccataacttggccatttgaactcggaattggactgttcaagtctctaatttttccttaagaagtcaagaacccatttttgtgctttgttcctacttgttatatggagtttattagagtaaaagccttttcttttccgttggtcgtgtaaacgctgcagcttcggaagattcgctcttcgtggaagttgaagccgacgtttgggaaaatgagcaaggcaagtcacatcatccttgaacatattgaatcccagtttataaaattattttgatttaaattattgcattatcgctttatttaaattcccgcgttatccctgttttatctagccatgcctatttacctttgttatgaccttattattgctattgttattattatcttgttcaccctaggaaaataaaaccccaactagtgggtactctattcatggttccactagtatgaatttaggtagatgcttcgccgcttaattaggtaacattaggtggttttacaactctagactttgggatattcatatcacttggatactatggaatggttggcttttgttggaattggacacacacctccccctctattcaaaacccctaaaatggttttaggctgggctcgaggtgcgtggttgggttttgctagtcgtacctcgggtactataaggattaa

SEQ ID NO: 56477 - DNA, 281 bp, Oryza sativa
acatacttcatcaatgccgaaaccaatagaatcccttttaggctagccaaccccaatctaggaatctggaaaaacaccatcaagtcatggccatcaactgtgaaaagttggacggcttggtataaaagggtatcggctagcaagcaaggccactgggaagaaattgggatagcacaagctttagccttgactgctacagatatggctaaggacgaacccttgatgtcggctgccagctaattctggtccaataccttaaacaccttccttttcaaccaaga

SEQ ID NO: 56478 - DNA, 255 bp, Oryza sativa
agaagaagagccaggggcatttccgtccaggatggtattttggcgaagacactctggttgaggatggtattccagcgaagcctgttttcataatggtattctagcgaagccattcttatgggatggtagatatgcaattttctccatccccccagagcgccgattttttttttattccttgtttcccgatttttttttcggactccatctctctcccgagaaatccccaatctgagaaatccctaactacgccgc

SEQ ID NO: 56479 - DNA, 1501 bp, Oryza sativa
ttaaactgagtaaattgctgtcaataaccgtagggaaaagaaattgacgcatgaacatgctatggaagctaggatactgattaaatttctagaaaataatagagtggcacacttttttttcaattaaatggaagatgcacaagcgcacaaacctccacaaggtttcgttcaattcattttgacaaagcctgtaatttttgttcgtgtacagtggtggggacttaggataaatactgtgtgaccttgagaagctaaagctatataaaaaaaatagaacaggtttttttcccgatgattaaaaaacatgcttgatgtttgtcagtttctttttatatcaaacattaacttttggacattgtcatggttcgaggtaaactatggtatcctttgctaattcaatgctggtattaacctttttcttactgatcgaaagtgagaattcgtttctgtaacgcatgaattcatttcatttttcaattgagcaccatcaccaaaatgtttaaatggtctaaaatttttgggcaataagaaaataatattacatttggttactcattatttatgatattattttctttatcattttccccaatatttatgcgatttcaacacatatgattcgataccgccattttgtatggagcgagcgtgacaagataacaatctacatgaggtcatgagtcattgtcactattcactggaatacatgtgtaaggtgccacaattttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgatagatttcttgagcttgggacacgtagaattgatccgaatgtggttcaactcactacgctccaaacatcaaattggaccacgctgaaacgacaactagaaataattcgaaaggacagcatgacaaataattggagatgacaatgacaaatagttagggagtactcccccatttcatattataagttgtttgacttttttcttggttaaaattctttaaatttgattaagtttatagtaaaaattagcagcatgtacattgctacaatatttgttttgtattgaaaatgttactatttttttctacgaactcggtcaaagttaaaagaagtttgattaaaaaaaatcaaaccaattataatataaagtgtaatagtttatattatacgtaatacaaagtgtaatagtttcactttgttttttttacaagaaaaaaggggcgcaggattgcagcgtgcagctgactctaccggttaaaggcatgtacaaaagcccaagcatcatctctcactcatcagtatgcaaattaaccatatggcaa

SEQ ID NO: 56480 - DNA, 1501 bp, Oryza sativa
ccttgcttgaaaaacacatgcgagtagagtcgcagtatgccatcagcatccaatgtcagatggtagtaactctctgaatctggggaggcactcaatgactgattagtcagaaacaacaccattctatatggactatttcggtcgaacagccatagggtgccgttgggatccagtgtaagagtgagaagaaagttttgtgcataagtaccagtattccagtatgcactatcaggatctatcgcgcctatcggatacatcacaaggttgccatctggctggttggaaaggcgatactttcctgtggcatggttggtgttagagacacttgagaacagctgattgccaggaggcaagttctgccctggtaacagggtgtccgtcggagtaccaaaggtagaccatatgacctgatttttggcgtcatataacacaaagttgccggtgtccaagatagcagcagaagtagccgaagtaggggcggcagatattaccttcccttggaatccttgattaggtggaatccattgaagtgaaccaccagcggttaacagaattgaaccaccagaaaccgggggatcatttctgaaggctgtccacaagatgaacctggatggatcagtgacaagccacacaccaatggagaatccctccccttcgggatagaagccaaacgcaaagcgccctgagggggagacccaactttgggggccagctgtgttgatttcagaaccttgaggaatggttgtctcattgatctgagctcccatggaatgactagctttgatgatgaagagaatcaggcacagagggataatataaggggacattgtttggccagaggaggttcttcctttgggctctgcaaaatgaactgtttggttctcatgtaaggaaataaattcatgacacaaaaaccacctattatgtgcacatgaattaaaacaccacgtcagggataatcacaactcacaagaacgttgacctggacctggacttgggaaagggaaagtatcaagttagtcaactactgatgtaaagtgaaagtaatcttgatttttttttctgggcgtagccgtaccgtaacggtatggaagcaacatgtcagtacaagtaagtcctcaattttccagggtgacaaataacacattggacaagtcatgcaatgagttgtgcaggaaggtctgggggtgaaaaattgaaccgaatgatggcaatgtatcagaaaatgacatcctaaccaatccaagcacagaggaaatagaacaatcaaataggcagtttcacaatttataacaataatttttcaaaactgttgctctttgagtgtgctatgtatggcgacactatattactagttagggcgaattgtagcaatgaagattaagaaatgtcacatgtttgcacccatttaaaacataaacacgtcatcattccacacttgacaaatacaacatgataatttgattggctcacataataattatttttttcaaaaattgtt

SEQ ID NO: 56481 - DNA, 1501 bp, Oryza sativa
aagattataaacgcttatagcatagccgatcagatagatctggcatgtatcagctagtactccgataccactctatgttaagatattaaaacagatagaatatatcaaacaaaagcctaatatactttattgagataagatcttaatataaatggcagacagcatatcaatcaagcatataaaacataaagctaagtcaggtaagatcggctgaaaccccaatactatctctctcgatgatcataaaacaagccagatatcataattataaatatcacttaatagatcgaactcaaccgatgcagcattaaacataaagacaagtatgagatctaagcaaggtgatgaaaacctataagagatggtggatacatgatacaacctaaattaataacaaaacataactctaccaattgcttcctaacaataagaaccagccgataacaagttatataacgcaactagcatagattgtaacatgtgtgtgataactcgatggattacataaacaaggttaaagtatcataaagatggaagcattaaccccgataatgcaagctgccataacaagctttacctctagttgaagatcgaaatcgatgcagctcaacccgaaagcaagaactcgtcgaaataaacgaaagtaaaaaagggtggcgatgcgccgagattgtattgaacgattgttgtctgtttacatgggttcgggtcatatttatacccgagatacaaaacatgtccttgccggacacgacacttatcactaacaaactctaagataccataagtctttgcggcagacttttgcccaaacatatctataaggaaattatacaaaataccctaattaatagatacaattgcctttccaggactcaatccgtacgtggcaatccgtatgaagcactttgactcaacctgatgatatgtaccgagttgtgttgtaagaatcggctcaatctgctaaccttgtccgacccaaactctgccgatcctgtccatagccgattcggactccaaccgattcccactctgttttcgatacgatttatcctgtggattccgcttcgatcccatctttatctccgatattgcaattaacacctaccctaccaccaagtcccgaaccctcaaacataaaagggaaaatattaaatcacaattaactatgttttgattaaaaaaatgacgcggagccatattctagctcttcccttatcattcttgatcaaattaaatagtctttacaataacacagaaatttgacagcatatattatttcatcatatacttcctcacaaacatacatagctaaattagaccttataaggagaaaatatcaaaaacccataataactcaatgtttgcaaaggattgatgttcgagtgaacatttttccatgtgtttctcggtacctctctggctgttacattttctttagaggcatattgttatctctggacaatgcaattggataaggtgccaacatgtttccatagaa

SEQ ID NO: 56482 - DNA, 163 bp, Oryza sativa
tcaaactgtagcctgtcttctaatttaaggagtgcttgagctagtaatgccatgtctaacttgatttatccttcttgtgaatgctaatattgtacacctgcccattttgaatattcttgtgtcatgagattaacttcaccaaatcacattctctgtgttatca

SEQ ID NO: 56483 - DNA, 1501 bp, Oryza sativa
aaaactcaaagcgacgaatatcctgggacataagtagtattttgaaaacaaacataaatgtgtagtggtagctctacaagataagagggcacgtagatgtagctagggaccaaagtggtgatctacactagcccacagtgggccactaatcgagtgtggagagaatgtattctcagctcaggtgtttatctccaaggctcgatgttttagaagattctcctattgtcctattgcctatatttgtcatataaaattgaatctttatatatatgtacttctacagtacatataaagatgcttctacagtatcacaactttattatcatatcctcgatggagataaaaggttcaaagtcaggtcgtagaatacatttgtaaatgtagatgaacttgttaggtttcttacagtgaaacatacctactcaaattaagtctatacttgatatggatgctcacttttacggctaataattttaggcaatatgtatatatcgataatgaaacgcatatggtaatttcgtatatcaaatatgccgaccaatattttggaggtgttacaggggtaagtatgtgcgtttgcatgtatttatacgggtaagcatgcacgcatattaatgaatgcttgcatttgtaacatgtttcgaaaaaaaaatcatgccataatttttttttaaaaaaataagtataaaaagaacatttgcttatgtactatgttgttatatttcggcaacaacgataattagaccataggaatgagccaactaaaagatgacctcatacaagtgcaacactaaacacatgggcccacatgtcagtctgccgctttgtcctaccaatccaagcttcaagccctacctacccctaccttgtcgggaagttgtaactacccactcgcgccggtcatcgtcattgtcgccatgtccttccatctacaagcccacgtcttcatggcgaaccctctccatggcctttccacttctaccgccgtggatgaaactttgattgtcgtataggctgagctcttatctctactttcctaactcacctccatcgtttccgcacgcacgtttttcaaaccgttaacgatacgttttttgcaaaaaaaataaaaaaaattctatatgatagtttctttaaaaacatattaatctatctttcaaatttattttagctaatacttaattaatcatacgctaaacgctacttcgttttgcgtgccagctcccgaacacaatagtaaattttatataaaaagataaaagtaaaaaaaaaaaaagctgatgcgcactaccctgtgctatttcatgatgggctgaaacttttaggcaactacgagaattgggccggcccgaccaatagatggcctcctgcaactgcaacactgaacacgagggcccacatgtcagtgacacaacctccctacgctttctcctaccaatccaaccacctactacccccaccttgccgggaagctgcaactgcacactcgccgccgccgcca

SEQ ID NO: 56484 - DNA, 305 bp, Oryza sativa
ccggccgccggagtcgcgggctcgcggctcgcgggagcgccgtcgcccgtcgggagtgggaggccgggagagtgagtggagaagccagagaaagataggtttttttttttttgccaggcttttttttttttttgataggccaaggaaaatgaatatacatggtcttctcgttaggctcggttcgggaggaacctctcctccccgcacgtaaaataaagtctctcttattatatgattaattaagtatttattaatttttttaaaaaatagattaatatgattttttaaaacaactctcgtataga

SEQ ID NO: 56485 - DNA, 1501 bp, Oryza sativa
aggatgagagaagggcattttagagaaatctaactatcaactcacggacaaataggtatataagaaaacaaaataaaacttacgggtatataatggatgacgcaaaattcaagagcataaaaaaattgagaaaaagaaactcatgtgcatatagggatttttcccttctttttgagattatttattgggttatcgaaacggatatttgtccgacacattgaaaaatacattttttgcaaaaaaaaaaaaaaaaactttcttctactattaattcgttagggaaatttgttagattgagtcttatttaagttgtaattcgttcaataagatcaacaaggagaaatgaatctgatcaacaaggaaaaaactttcttcttcccaccggtgtgcccaccccctctgtgcatttctttctttctatctgtcgtctctgtgcctcgccggccgtggggactacggcctcgcccgcctgcgtgacactgtctcaaagcaaagaaaaaccaagcataataaaattttgccctaaatttgctggggctagtaatctgacaaataaggacagaacaaatcgtcaagtattacaaccgtttttttgacaaattggtccttgcaaaaaacttattttgaaactagtccctactaaaatctatatctagaaataggccgtcggctcagcgccagcgccaacgggactggcgctgacatcgcgccagcgtggcgggcgaggcgcgacgtggcagggcctcagcgccaatgcacttgacactgacaccttgcacaccctaaatagaccgatgtgctgcaatgagttaacaatgtcgctcgtggtgcaacggtaattttctttcttgctgtaccttaggactagggttcgaatcccaggtcagccatttttgtttttttttttaatcatcaatcaacgtgcgtacatattagtgatgatctccattttcgtttttgtcttcaaatcttcaatgtacttttttttgtttaaattaatttttattaaaaagaaatatcacatttagtacaaatttaaaaagtagaagaatggattaaaaaagtttagagacaacttttaaaagaaatatcacttttttataaaaaagaaattagaagaatggatttaaaaaaacttgagtttttttttaaaaaaaataaacaacaagttgagaactaagggtaagttttattctaaaatgtcacgtgttttaataaaattaaaacaacacttgaacttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaaagtttagtaaaaacataaaggagagggttcgaaccctggtcactgtaacgccacctttcaaatacctaccactgagctaagccaaacctaattgttgcttttgcttttgcttttatttag

SEQ ID NO: 56486 - DNA, 1501 bp, Oryza sativa
aactcgcctcttcgttgaggaatgaaaagctctgcgaaggtgtgagagcccacaccctctctccacggcatcacgaagtctacatggtggaacgaaggaacgctccagtgtggatgcctgagccaatgcaaaatactgtagttcctctgcattttactcttcaacgcagaggatctaaagtatttcagtaatactataatcttttttttcttctattggactcttcttaaattctacttttcaccgtaaactcaaaattggtaattttcacttcaaatttatattttttccattttgcatttgtggaatgaaatgctcactactacatgataatcagctcttgcttcgtttacagctgcagcaaacaatgattaatcggtgtcgtgaacatttaaagaaaaatcttcaaatcggggagaaaaaatgatcaaaagaaaaaaggaacagaactccagccgagggcgtctctacagacacaccatacttggtaataggacaggtgaaaatcacacgtggagctgcatcaagcaaatttttcattttactacggaacatcaagcaaaggaaaaacaactttcagaacatattttcccattaatttcaaagcaaaaagaaaaagggttatacaaactctgctgcagtctgggttctaatctgaactcgcaagaaaacagaggatatataaattggatttctgagaaaatatgcactgcatgtacaaatactgtttgccgtgactaacggtgttcgtatttgaaaagtattgattgctcacattgacaactgagacatcatcagcttgacagggcaaatacctgtagtttgctccacgcggtaacaaacgagcatgtaaaagcaaataagattattttttgtttcttcagccagccaaagttcctagcagctcattctccacatgctgacatgcaatggtgaggtgacatgcatctgtaaccatggccctctcaacttgtaacttgcacttcaaatggcacccccgcatatgtaaatgacctagttcacctatatttccatgagaaacatcaggatagcaaacctgtgtcacaatccagatgatgctgaggattgtcagcaacagcgcaacaaaatttgagcaatggttagggaactaaatatgagctgccatagatttgaaaagataagatagattcatacatttttaagcagttccgtgttcaagacaatctgctccagttagctatatatctctggtttcactatagctggagcctggccttcaataatgcactacaatttcacattttcacttgacttcagcaatagaaaccttactgcttggggtgtagtgtagcacatcgcagttacgccaatatttactccaactgccatggtctttgactacagagagatcaataaagtgctttttaatattaaaacaatttttgaaaaaaataattattatgtgagccaatcaaattatcatgttgtatttgtcaagtgtggaatgatgacgtgttta

SEQ ID NO: 56487 - DNA, 1501 bp, Oryza sativa
aacagatggctttgctgaagagctaggaaggggtgcatatggcacagtgttcaaaggtgttctaacaaatagtgggaacaagggcattgcagtgaagaggcttgagaggatggcagaagatggggagcgagagttccaacgggaagtgcgtgcgatcgcacgaacacaccataggaacctggtgcgtttgttcgggttctgcaacgaaggtgcgcatcgccttcttgtctatgagtacatgccaaatggctcccttgccaatcttctcttcaagcgcgatgcaacactacctaactggagcaacagaattgcgattgcgctggatgtggctagggggttacaatacctgcatgaggagatagaggtgcctataattcactgcgacatcaagccagagaacatactgattgacagctcaggaatggcaaagatcgcagattttggcctggcaaagctgctgatagggaaccaaaccaagaccttcaccggtgtccggggcacgcgtggctatctcgcaccagagtggagcaagaacacagcgatcactgtgaaggtagacatctacagctttggcgtgatgcttctggagatcataagctgcaggaagagcatggcacttaagttggccggcgaggagtgcaacatctctgagtgggcctacgagtacatgttctcaggtgaaatgaaagaagtggcagccggcaaaggtgtcgacgaggttgagctggagcggatggtgaagatcggcatttggtgcactcaaaatgagccagtgacacggcctgtgatgaagagtgtcgttcagatgatggaaggaagtgtgaaagttcagcgtcctccaccaccagcatcattttcacagtcactacgctgaaatcatccagagtatttcatgtcctatactcctattgtcttaagtcagaaggcaaaggatgacaaatcatctagagtatgatcgaaattgtgcgtcttacggcaaaactgctagcagtaagggcatatcaaaacatcaatgtatctcctctgctacctatcttaatgtctagttgggtgtttattgtaagattctttcaagaaattaaacttctctcggctaaatacactgtttttggagtattatatatggagtaatcgaactatgcatccaaaggatggaatggtcaaattgcaattggttcgattaacccatgagtagcaatgagttcaacagaaaaaaaaatggacaaattgcaattggttggattaacccattagtagcaatgagttcaacagagaaaaaaatctaatgttacaaatttcaaaaagccaagcgctggtgtctagcgctgcctccaccgagagacccgactgtgtgcctctatagggcctcttttcggcagggggtcgcctgccgtggggatcttttcactgctccattttttttttttttgcagctggccggcagggggtcgcctgccgtggggatcttttttttttttttgcagctgaaatggtagggcgg

SEQ ID NO: 56488 - DNA, 1501 bp, Oryza sativa
aggaacctctcgccacaagtttcaaaggtttgactttgaaggcaagtcacattacacatctccactctcctaccaaaacatgaagaaaaattaaaaaaatacatataaaattgtggagtggtgagtattctatcctcgttccaaaagtccacccgttcaataacggggatcccaccatttggtcatgggtgctcaatttgatgcaacttttacaaccaaagcacaaaattcttctgaaattataaagggtaaccatgtgagcaaagtgcagcgttgcttgagtttaaaaaaatagaggcaaatacgatacataaaacaactaattcatctaacaaggatttttttcattggagaaaagggacgagtgaatcttttggtgttttttttttgaaaaaataaaagtctacaagaccgcgtataaagaacacatacaataaacatgtgctccaaccttgtaccgcctaagcagcgtaagcggtcgactataccatataagcgtccaattatgccgcctaaacgctacaaggtgggggtgacagcatgaaccgcataccgcttatcaaaacattgttcagtgtgctccaaccttataccacccaagcaacgtaagtggttgactattccatataagtgtccgattgtgccgcataagcgctaaaggtgggtgaccgtataaaattgtgtatcgcatttaaaatattattcaatatcttatcatcatgattgatcgacggtggaagacaaaatgttatttccttaagaacaattcggtgtcaaatctttccaaaaataataatgtaaggactaatgtgtactaaagaaaagtataaagttataaaataaaaaggacggtaaaaaaaatccataataacaacaatttgaaaacaatatcatttcatagttagcaaaaacaaatttaagctatgaatttccaaaaacaagttctagttacgtggcaaattattaatgccacatttccttttggaagccattcaacgtgctttatcaataaaaaatatagttacattgttcactagaatgcttagtaaaaaaaatagaggtttcatcaacccagttataacaattcttcaaatcaaaaggcacatttagctacaacatatgtcatccaattgtctatgctcccaatttttatccaacagagaaaaaaaaatcctcacatttatcaaaacgtgccaaaatgaaattcccatcttcctcaaggtgctaaacataaaaaaggatagaaaaagataaaccacctcattgacttccctcgcgtctatccaactcctcttcgtcttcctccctccccagtccccaccaccatttccacttataaaacccatctcccccaccccaaccccgttcccacctcacaatctcaccctcaactcaccacccaacccaactcaagcacctcctcctcctccaccggcaaacgcagcagcggcgcgcgcgctctcgcctccgtctccggcgacccatggccgtggacctcatg

SEQ ID NO: 56489 - DNA, 1501 bp, Oryza sativa
catgcagatataatgtaagttcctttcaagtggatgtcaagtgggcttccctagtcagaataaaggaatcataattaagcatttattcttggaacatatcttatcttttgtttaaagccatatgacttgactaatatctaacctcgcttccttttttttgtggggtcgtgcaaacacataggttttcttttttgttgtttgtttcacaccgtttgtgataagatgtactacaaacctaataataaattaaagtatatcaatattgattatatatatatatatacatatgtatatatatatatatatacatatgtatatacatatatatgtatatatatatatacatatatatgtatatatatatatacatatatatatacatatatatatatatatagagcaggttttctattcaactagcttagcaaattgaccctattgcacgtgggaacaaagtcaagtcaatataacgagtgcgttcttcacaattttatcgagtgcaatcaagcctaatggaaattcagaatagacctttcaaattgacgatattggtggataaatacattccgtattaattaaaggcgttgttttgaagaatgttacttaggtattgtgttttcatttcgctcgagcaaagtgtcgcaacacgatcgtgaggcatgagatgtcattttcgagctatcttaagatatatcttaataatatcttagataatcatgattcggaaatgcaattttcgatagtcatacagtctgaattgtgaagtttggtttgtgccgtgctaatcacctacaattttcatatatatgattgtgggagtccaatggttcttttacctaggatttcttatgaaatacgaccaacctacttagttttcaaaattggcaccaaatcattacaggcaaccaacaatataatattagctatatgtaaaatatctttacagacgggcaaagaacattttccctgacgggcttcattacgtaaaatcattttcgcatgtggctaggctacgctgtccaccaaaaaaaaaaagtcttatagtcggcacgtggttggtggctgccaatgaaaatggtgtattttctttggctattagtcgctagcggcattgccgtcgcaaccagaggaaactttacctgttcgactgagattccgagaataccaaataggtttaaccaagctaggtgatgaagtacaattaattagttggaccatcccaacaattatgataaatgtgggctctgtggaatactctgaacaaatattttcgaattttaggttgtttgactttacactcatgattatatcaattttctgactttacaaatatttgttttttacacaattctaagcataacatgttcattacggcctgactggcctcttcctcgttcaagttaattaactacatgtagtaattaagttgttcgatcactggaaagaacatgccaaagtactgcttctagatacgagattatttcgcgaaagttactttagc

SEQ ID NO: 56490 - DNA, 1501 bp, Oryza sativa
gaaatcaagttggaggatgcggcgaggtctgccatgaactggggcacggtgaatgaaagtgtagccatagagcagtacacaagcatcacccgacggtcagtgggttcccttggcttcgcagtgcacactgaggccaactttggctggctcggagcttcacctgatggtgttctagggggtgacccaaaccgtgggatcctagaagtcaagtgccccgttcaacaagggtaaagcctgagcttcgctctgccatgggcgcgctatgccatactattacatgccacaggtgcagggcctgatggaataatggccagagattgggtcgagctctactgtggactcccaccgaagcagcgttttccgagtacctagagatcgcgaatactgggagctcatccatgaagtcctgcgtgatttctggtgggggaatgtaatgccggcccgggagctggtgctgcttggtaagaaggccgaagctagatcctttgaaccacagcccaagcaccggttgacaaacctggtgatttttagaagcagtaagcttgcttctgaagccaagttgttgtgcaaggatattggcggtcatgtagaattcttcccatgattagctctgccaatggctgcacactgtattctgattatttattctttcaatcaaaaacatttaattgcgtgactagttctcaaatcgttggtgtttttactgcggttttggagcgtataaaatgttccatgatacgtcttgtcgtagttccacatgttttctcagattttcatccttgaaacaggtggcaatgaatcaagcagacttgcagattagccaaacagaggcacaaatataatttgcttttttcccctatgtgctatagcctaactcaacgtgacgatctcaaactgaactttggtttttcttttcttttcatttgccaaatgtaattgttgagttggccttctctttttcattctctactacgcgaaacagcagaaattcactccgacaggtgttgtttgcttccaggatattcccatcatgttaccaacgaggacggccattcaccatacttgacaaattgacatgaaagcaaaagtttggttagaagtcatttatttctctgcaagtagttgtaaattacatggtagtgtgacaaatgttttcagaattacacaacatcaacattgcggcacgcatgtataaggtaaattacagcaatcctctatttgctctggtgagaccgtgagaggaggagagcagttcatcttcgatcttaacattccaagaatatcagctgctgctgcaatactgacgtaaagttcacgttgtgcttccgctcttgaacagcaatccttggaagcaaccccaaaccaaagataggaaatgatctctcacataagactaaattcaatgggatgtataacatcaaagcaatcaggaaaaactcacctctgaaatgtcaccagttagacgatagtagcgaaacaatcttttttttttctttttttt

SEQ ID NO: 56491 - DNA, 311 bp, Oryza sativa
gggtttaggacaatgtcttttggtggtgactaggtgggaagtgaacgcttaataatggcatgaaactctggaggagcttgcaactacaaaacaaagtatggaatgaaaccaaatgctccattgaccattaggatgcatagtacattttggttaactgaatcttgcaattgggggcaaggacactcctagcgttgattttggggcgcatacatgttaattgagtatttgtgccaaatgccaaagggattttgggagaaaaagaagataaatgaagagataagggaaaatgtgaaggattataagatttcaat

SEQ ID NO: 56492 - DNA, 242 bp, Oryza sativa
gattataatactctctagctaccaaagccagccagccaagtactactccagctaggattattgttcttagatcgtactccgtatatgaaagatggtatcaatatgatctatgagctagttagtggttatcgacctaattaacgagtcctacatgtcttaattaactaactaacattgtgctctaaaacaatataaaatttaactatggcgtacttatgttctcgcaactgtttgtgtacagg

SEQ ID NO: 56493 - DNA, 209 bp, Oryza sativa
catattcacattggttcctggatatattcgtaaactgcaaggtcgtagcatggtcttttgatcagtagtccaatatactaataaatgagacaatgattagttaagacttaagagtacttagcatataacttttgttgtgttatgttgtattcattcaataccacagcttcttgacgcttcatacatggcatgcagggcttaactgcgaa

SEQ ID NO: 56494 - DNA, 689 bp, Oryza sativa
aaacgggtggccacccatccgtacgcccagtagccatgtcatagcaacatcacctatcatgagatgcaaccacactagtgccagtggcaagtgcatggcagcccttgattatattttgccctgcagatctaccagctgataatacatactatctgtgattgatcaactatcattcaaagattagttaactgaataaagataagattaattagttctgaagtagccaagcctagctacttagctaggaggatacttaattacatcagtttgagggatattgctgcactagattttgagttaattaacatgtgaactattggttcttgcaatacttcggctctagaggatgtgagttcactatgtaatctttaccatctccctatttgacacggctcgagatctcaaatccatgcgaaatttatacttcatatgttaaattaacatggttaatagttttatatttttttaaataaaataaaataaaataatttattcaaatattatcaatagttgaaaattgctacctgaagtcttgactcctgaacctgattaacctgaactaggagagaaatcttgttgtagttctctttcagaaacacagatgaatcttcttctttttttttttcctgatgaaatgcaagtagaaactgttgtaaaaaactatctaggcatcttttgtgatgcgtaga

SEQ ID NO: 56495 - DNA, 1501 bp, Oryza sativa
tggagcagcagccgcagcggcggcgagcacggcgaggctgagtaacaacgcccatgccatggttctcatgcaagaattggctctaccgagataccttggatttttgttttctttacgtggctttaatcgttcggtagtaatactgagagagcagctcgttgctaactatataggcaaacgggacggacttggagtgagatcatcagagctatagtttatatttttcattttgacaatgtacacgtgtttttctattactttgaattgaattaaatgttcttaattaaaggaaaagagcttctagtctagtggttacaagagcctcagtagtacctaaggtcctggctttgactccccgtgggagcaaattttctaggatttaatgactttgtgctttcagtgtggtaggtgatgtacccgtcgacaggatttactggccctgtcgaggcgcctatggtgacttcgtcaatttctaggatttatcggcccagtcttcgaagattctcataggggtagggtttgcttgcgtgcgtttataggggtgcatgagtgtgcgtgcattgtgagtgtctgtgttgcactgtgtaattcagaaaaaaaatgttctcaatttaatttacacattatagtggttcacacacatcagagcgccattaattgtaatcgatccatagctccgttgatatcaaccaaggattaattgacaccgtaccgttttgtacttgcgagaaagcaataagcatttcataagaggatgtatatacggttcaaaataaacatccgtctgaaaaatagaagggtttcgtctgcagaaatggttttcttagtagtgttctagctagcatctccaccaactatagatatacagctatatatactttttaacgtttgcattttctatcggcctctacctgcttcctccttgtcatatgctatttcttaaaccagaatcatataatatgtagtcatttgacagtaatgaaatgatgattaggtctttcctcctgcaaaacttatatcaaaatataatcacttgtagcacgaatactactgccaagaactctctcacccttaccctcccttatttaataagatgcaccaaagtcttttcttataaaccttaatcttttctaaacaaccaacaaatgcttatatatcataatagatggatgggaacataacatctacatataagattcatgtgcatactccgtgtataccaactaacaaatatcacaataaattctagaaaaaaattgtgcatatactttcagtagtattacacacctataatgaaaattttaaccccatagtcattatagtttagacataacaaaaatatttaacagttttaaggctataagtctatctgaattttgtatttttctctttatatatcatgaatttaaagatgtgactttacgtgtagatgtgtaatattactaaaagtatttgtttctaatgtttttagtgatatttgatacattttcaagacgaagtg

SEQ ID NO: 56496 - DNA, 1501 bp, Oryza sativa
gaatgggttgctggcgttatatctgcaagcaaatccatggttcactccttggaagaccttggcaaagtaatcaatcttcaataattaatgaacaaaaggttatttctaacgttcattttttgctaatgaataatatatttctttgcaaagatttgttattgaaatatttgatgaatgttttaaagaaaaatatgttcttcttgcaaaaaaggagagaaaggaataggtataggattaaagccacatgcagtgccccaaatgatggcctagcttttgtggattagattttgggtgagttattttcctcgtttcgcttatgcaactcacttgtttactgtgactattttttaaaccacgaaacagtgaacggtgtcttttttagaaaattttatatatatatatatatatgtgtatacgtttctttaaaaattaaataaatatattttaattttgtaatagttaatatttaattaatcatatactattgttatttctcggttcccgtttacaatatgctagtaaatcttttgatttttatgctattgtatcagctctaacttttgccagatgttgaccagcaattagagccagcattccctcaaaaggaaaatatagccagcatgatcttttatcatatcatcatccgtggaaaattctcttgtgtgtctacagtctcatttcctttcagaaaatagacttaattagtttttcagttcaagtgttctcactcttccggtctattgaatcctgtgcttcatgtatatgtgcaaattaaattatcttatctgaaaaacaaaaaggataacaaattgcaaggcaaatagagctatatatgctgatgcatttgctatatcaactgtaaacgaaattataacaggggaactcacccgatcagttctatgacgcaaggcctgaacatactggtacactaattttggtggtgtcagtgtgtcgttctgagctccaatgatctcaatggggcatttgacctctgcgtgaaatgtcacggcgaactttggaataagaaaacaatggctatatattcctgtgcaaccctatagctagatcagatgatacatgcatatttcagcaacagcaacaaagaaagaatatcaacctttaatgtcatcgacagtcaccaatccaggatgggtggtgacaatcgcttcaacctcgttggtttttgctacctccacggcaaacttccctgccagttaaaacttgcctttgagagactttaatatgaatcagatctctgtttgttcaatgtggagaggagatcaggaaggttcagagtgtatccttagaatatgaatctggacagactcatgtcttcgttggactagaaaacatctcatccaatactagattggtttttttttatggagggagtatgttgttattcgtgactgcaaacattttttttgtccctagcaacctcaggcggctgcccaggctcattgctgaatccattgaaattatatattagaagattgaaaca

SEQ ID NO: 56497 - DNA, 1501 bp, Oryza sativa
gatcttataggaatggttcttggatggggatcagtagctgctcgatgtcgagcaaccttgctttatttgttcctcacaccggtgttaggtggtaagaaccgacacctatgcgcaactgcataggtgccgactacggaaaccgatacctatgaccagtttctaaccggtacctatgacagttcaagcaatattgtaataagggcatcaggaaggcacggttctcattgttccctgtggtatatctatctgtttgcaaagttatccttatttcatagataagaggtgtaacaatgatatattataacctaaacttaaagtaattttacaaataccatgaaataatttaattaacaattggtaaaaaaaacaaagtgaaatgcaaaaataaagtaaatctatatactactacaatatatttttgtagttaaaatgaactaaaatcgaacacattaacatggcactacaaatttatgattagcaattaatgcataattttaggtgtttggaattttcaaattttcatgtgcctaatatctagcttttaatatccggcacatttgagtttagacttaatatttgaattcggtatgaattttttgcattgtggcctacataaggattttgcgaaagatgtagcatcattttttttgtcctattaattcaatcactttattttattaccatttactccacaattggttatcttcctcatgtcatgtgtaagttaataaactaagccagtatataggagtacttgctagccagtgtcctcaaactttatcacgcacaaagtcccggatacctgcaaatgtagatgatcttacagccggagctaccgtcggccaccgtcgccggcagcagcgacagcggcatgtgcgtgcacatcagcctcggcgacggcagctcgtcgagaaccgcgtcgcggccgggggcgaagagcctgtcgacgaggggcacgcagtcgtgcgggttgaggcggcggagcgggtggtcggggctcgccggcgggtgcgccgcccgcgccatgacggcgaacgcgagtgccttgagccacgtcgtccccgacttggggaggctggcgaggaggacgtcgccgtcggcgcggggcacgaggccgccgccgccgcgctgcatggcgaccgcgccgcgcgcccaggcgtcgagcacccagtacccctggtgctgtcgcagcttcaggttgtggaagacgcgcgccggcatggcggacacggcggcgtcgttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 56498 - DNA, 1295 bp, Oryza sativa
cgggactaatgatcaagagtaccaaccgtgactaaaatggtgatatttagtcccggttattgacaccaaccgggactaaagatcctcggccccctgacatacatctgacagggtatgaaccaggactaaagatcaagatcaaaatttttatctttagtcccggttctttttggaaccgggactattgtggattttgccagaccgaccaaagatggtttctccaccagtggaaagatgaatcctttcactactttagattttttaaatttttagctaatatttaactaaatatacgctaaactgttgtttcgttttgcgtgcaatgaggaaagtgttttcaactccaactgacgaacacaacctacagctggagctgtgccaaacggtatagattctctattttttggagcggagttagtagagctgctccacaaatttgtactacgggggtggagctaggtttttgctactccacagcttcactccaccgcaaaagacccactaccctttaattttttagtctatttataccaaaatgctactgaactaccccttcctaccccatctcccgttctcgctcatccccatcttcatcccttgacaccggcggcgccgttggtgtcggcagcggcaggcggtggtggcaggtgttggtggagtggcggcgagggccacgagcggcaacggtggcgggagacggcacgtgggcggtggagtgtggtcggcggcggcagggcgaggtgcgagagtagcgtcggctgcggcagcaggcagggccatgcgcgtgcggtggcggaggcagtggggcgacaccaaccaggtgttcaactaaatgccaacaagggacgtgttggtgtggagctaatcaatctagccaaatacttatatacccacttcagctcctataggagctagctatcactggagttagagtttaaagttgggagttggagcttggagtcctactaaacgggcctaagaatccggataagaatattgatcattcgagagctagaaatttttggagaaactgtggccgctaaaatctcgtccagatagtgcctatagtaacctgccaaataaagtattgtagagaatctcatccggctgtcaaggccatctggccatgcataccaaatcttttctcaacagcaaaccaatatacggagtatagtaagtactagggtcttataagagtcgatactcgctcttgctgccgccatggcgaacaagggaggagagccggcagcaagagcagctgtgcgccatggtggaggccccgtcgcgttcaagga

SEQ ID NO: 56499 - DNA, 1501 bp, Oryza sativa
tccgcacggcaaggcagttctctgactacaacatccgcgagtacacgcgccgccgcgccgcggacgccttccgtgagaaccgtgccctcggcgacacggctgccgcggcggcagcattcgcggacgggaagaagcagctggaggtggcaaagcggcaggcggtggtgtactctctgtacgccccaaaggccaagagcatcatggagatgaagttgcagtgatcgacgcgagaggtttcgtgctctcttgcttgctgtcctcttactcaggatttctttctgctctgtttctaaagttatgtgataggttcgaggaaaattggtgcaatcaaagctgagatgttatcatgtttgctggataattgccatgacatggttgctatgagttgaataaatcagtcaattccacgattttggtctcttgtgttcaacataccattacctgttaactgtggttggattggtgccgattgcagcacttcgaccagggctcctcgttgctgctggggtccctcgtcctgttgccggcttgcagccaccagtcaccgttgctggtggtggtgccttgtacctgctgctctccgtcctgatggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcgacccgttggctaaatcgctaaacacaaggtcttgctttcatgctcgactggtttcttcagaataaattcctggtccatgtaaaaatttgcattaacaaccttgcaggctgaataagtactgttagccatctgcttagtttttttttcacatcttttcttatttgtggtccacagtacagataattttattttgaattctatttaagattaaatttattcatcaaaaactacgattctaaaacgtggcctgtaaagtggttctcgtaaatattctttcatgcattgcagattgagtatatcattcttcactaatctactagacgc

SEQ ID NO: 56500 - DNA, 216 bp, Oryza sativa
tcggcgtgcgccgtggtggggatgtggggactcggcgacgaaagcctcgacttgggggagacgagggcggcaatgaggtggccttggccttgggtaccggcatgggtgccttggtgacttggtgggtggcgcggtgaccggagccggggtggcgggtgtcttcttgaaggagactgacggcgtggtggtcagcatcgtcgtaggggcgagtggaga

SEQ ID NO: 56501 - DNA, 722 bp, Oryza sativa
tctgataaaaagtcagcaccagtttcgtatcttgcatgtaaggcgggaggacatatgtgacaaaatggccttcaggacaagcattgtgagtattgtattgccttccctttgtatcctgtctatggtggtaaattgaccttcagcagccaaaatacttaacggttgtttggcggggttttggttttctttggtgtccctgtcatggattgtgagtttgagatgaggattgagcttcttaggaactgaaaaggacatgatgattgtctgtactattattgttaatcagcatagtttccattggatgtaagttagcatcaatcttattgttcagacagctcttctctgagcctattgtcgaacaatgcaagatctcagttttgataactgtacgctacactatgagctattgctcactcatctgcaacatctgattgatttgggattttatgggttttctgttgtcatattgcaactaaagtttcttttcaaggtgattttacctgttcacatttttgtgcatcttctgtaatgtgattatgtgaaccaaatattctagttcgccctaccatgtaaatgaagtaatgccatgcatttcaagtctccaagtcctgcccatgatcttcaatattgtgagggtaagacttcttcacatttcacaactacaaattcatggtcatgtgtaagttactttcaaacatgaatatttccataccgattgtgaa

SEQ ID NO: 56502 - DNA, 1501 bp, Oryza sativa
ttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacacccaacagcggcggcataatagaccagccgtgtaggcggaggctccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggaaccactcggcggcgacggaggcaggccggcggtgaagtcgtagacgcccaacagcggcggcataataggccagccatgtaggcggaagcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggtgaagatgacgatgcccatcaacgatggtgtgaccaaccgaccgtataggcggggacaccagtcggcggcgacggaggcaggccggtggtgaagtcgtagacgcccaacagcggcggcttaataggccagccatgcagacggaaacaccagtcggcaagagtagtgccgcggcgttacatgcaaacagcagaaaataccaagagagattaatctgacatttagagatcaatctaataaacaacaataag

SEQ ID NO: 56503 - DNA, 1501 bp, Oryza sativa
tgtgcagggatcagaaggatgcattggtctccatgtggcacttcctgaagcgcaatgggctacaaaatctgtacgagtccttctgcgagggcacatgcttcgggggccctgtttggaatcacattctcgagtactggagggcaagcaaagcgaacccaagcagggtgctcttccttagatatgagcggctgcttcaagacccaacagacagcatcagggagctagccgagttcgtcgggcagccattcactagctccgaggaagaagctggtgttgtcacggagatcgtagagctctgtagcatggagaatctcatgagccagaaggccaacaaggaaggcgcccaaggtgtgttcatcaagttctctcacgactcgtatttccggaagggggtggcagggggttggacgagccacatgacccctgagatgggaagacgtctggatgcgattctccgggacaagtttgatgggtcaggactcactatctgaatatgcatttagttttacgtgtgtttcgtcttttaatttatgcttaacaatatatagtagtacgcaaaaaacgttggattgttttttttcttgttgaaccttttctccatgtattgaaataatggtgttgtttggaagtatagtctgtaaccttttatgcttgtaaaacggttataactttgtaatttccagggcaccaaggaaaaccctttaattgtaatttccctaattcggttaatcacaatgtagcttgtattttggtaattgttagagttactctggttactgatgtaatgggataatggactagctatctggcataaatacataatgattccccacacattgctgcaagatggctgtggatatcatttgctttggagagatgcgcatactatataaaatgctttctagaagtctatcatcaatgattactgcaccctaagacaaatttagtaaattaaggcaaactgtttcagcttacttaagaattcaactaacttcatatatatttcccaattcaagatgactaaactaactaagtgtaatgtcaacaatcaatccagtatactgttcattgaaatataagctagaaaaattcaacctctaattctttcttttgagaagaataaaggaccaggtcttcgacaatggaagcctttatgccatatccatgtacttgtttatgaagtcataaatcctataaatcctataaatcctataagtttatacaggatttataaatttaatatagattactaagtatgctagtgttattgcccaagccccatatgatgagtcatcttaagggagggagggaagtaattaattaattcacacatctgcaattaatatggagatgatatatactcctcccgtccgtgaaagggcatatagcctagtggttgcagtgatctgagtagcacccaaggtcctaacttcaaatttccatatgagcgaattttagattgagttattagagggcaagttccttatttgataggctaagt

SEQ ID NO: 56504 - DNA, 1501 bp, Oryza sativa
catgtattattatgagtcaattgcagtactttgttatttttttggtactcgatattgataagcatttttttcatattgtaaagagtagccataatacaagaaataattttttgctagctatcagatcaacctcattgcactccaattgcataacctttcacttaaataattagaaggaaagaaaaaaatgtggtatatcgcagaataactttcactctaaataatagaagaaattatataatgaatggaaaaaaaagtgatgtgattaggtgtcctatggcgaatgagcaattgatgaggggaaaaaaatccaaatgtaaacacgattcattttgttggtgattacttctttttttaaaaaaagaaagacacatgtgattatttttattttaaaaaataatttattttgtcggtaaataattcattttattggtgactacattggtgactacatgttttaagtaataaaatcgcttcttttattatccgattcctgcttggcgtgagtccaaactttattcgtgttcggttgctacagtgttgtgcagtactgtgctgggctggtgggctgcttctcctccgctctgtgggctcgctggtgggctgcggctgctatctgggccggcctgctgctgctttgggtgggctgcctcgtcactaatccaatccgggctgctttggatgggctgctccacaaacaaggttttctctttttatttttcttttctcctttatttgcaggcgtaagagatcgtggccacgctttcggatcatggattagcgacgaattatcgtgtgggcccactcttaatgacggacgaaaagattaaccggaagccttacttattttttaattaggtatatagatatctatatctaataaaaaaattcgtaaggcttccattagtccgcttcgtccgtcgtttctatatagatatatagatatccaataacttgatgagtttaacgtatcataccttacccataaaccaaacacaagattgtggagatgatgggatttgctttgagatttgtgatggaacacgtgtcacctgtggtcgcgaattttctttcgcgagagcgagacacacacaagtacacaaccgcatctctactgtgggcccccttcccctcctcgcgtcgcctctccacttcgcctctataaagtcccatccaattctcgattcccaatctagcacagcacaaaggctcctccttcgaccgcagctgtgctacctacctccaatggggctggtcgtggagaaggaagagagatcttccaggctgatcccttctattggtacgaaagcagctcactggagctttgccacgaccgcgagcaatcaaatcgaaatctttctttcttttttattgatgctccaacctagtttcacatttgattttgtctgttgcaatggcaggttccccttcccaagccttgcttgaggatccctccgccggagtagggattagggagggaagaacaggaggcgattcacca

SEQ ID NO: 56505 - DNA, 385 bp, Oryza sativa
agagtgggcaccgagggcagggagtatttgtagggtccgcatgcagtgggaccctctacctgtgatgtgatgagcgaagtgacgaagacgcaaagtgcaactcaacacgatttttgtagtcttctagggggtgtttggagagaggacttatgttttggagagtttatgtttttgagagtttagcctctctctcccaaacacccccttacttacacaaacatatatttttaagagatgtgtgaatattatgctcactttatcatgtaaaaaaataacttagtgctggatataacacattatattactatgaatttagacatatttctgtcaagattcgttgtactataatatatcacatctaattataaattctcgtctttttaga

SEQ ID NO: 56506 - DNA, 1501 bp, Oryza sativa
taatttcagtgtagaaaacatgcagttgctgtaacctgtactctgaaaccaatcgttttgatttcaggccttaaaactcatgtgcaaaaactgttggaaaatcacatcaacaacagttatcaaggtacatgaacaatcatgcatgaggcaccataaatgtactagctagtatcacacatggctagatctgacgagattagtaacaaacagtttgcaaggttcagaataattactgtacgagacatcatgatcatctcctctgcccagcaggtcagcatctaccactaattgggggcaagataaaaaaaagtcagtgtagatgtgcaagaacgcttctttctcctccttgatcggaattacgggcagaattattagaacaggttaaggagaatagactgaacagggagcagcagtacaagtgcagtgagggacagtatttggaccggtttgtgctgcattgtcttagtgttatggagcctgaattattggggcttgtgtgattgatacctctcgcacctgtccatgttgccttgtagatatacacacatcactccatgcatctactctctagtaattatccatgtgctcgtctggttggattggaacaagcaacaactaggtatatacacttgtctctgagtgatcttatatgagaaaaataattcatacaaaattcccgcatttcaaataaaatttatcaaattccttcataattacctcgcttcaaaggacgcaaatatagtgattttataatacttaaaaagtaccgtacttttgattaatttagcataaattttaatacctctcaaataccgtaaaatttctcaggtaaatatcacttattggacaacatgtcggccactcatctagtcatcttagagtttagctcacgttgggacgttaacctaatagcagcactccaggtgtcgtggagcctacaagaacgtcgtcgtcggtgaagatagacaaaccatggtagaaagcaaactttcatgaaaaagcgaccaaattaggcgtatccaatccaatcctccaagcgaagcaaaaacacacgtcacaagaagctcacagcaacaactaatggctccatatatataaattaaatctatcctatttggtgagtggtatttattatctgaaagaatctggtgagttttcatatggatgcctacgtggagacatgttgtgtggccaactggggtccaacctgccaatcatgcattgggccagccatcaggctacttgttagtcgatcgatcgatcgccacgacaattcatatatatcttatttacaaggagagagagaggaggaatcaatcgataattcgagacatatagtgatcaatcatgcatcttctggttgttggaagctagcaaaactgaaggttcttgttgctgttgctgttcatcattatcatagccaataagaaagcaagaatccaagaggagacaggatcggaggaggaggaagaaagcgagaaaccaatcgatcgatcgatca

SEQ ID NO: 56507 - DNA, 286 bp, Oryza sativa
ttgacaaatttatattcttaaaactattatttttgtaatggctaaaatataatgaatttgactttaaaactttacatgtaggtataatactattaaaagtatatgcattatttttttcttgagtctttttatgatattaattagttggtgtgtatagagtgtgcacgtagaacttgtatacatagggtatatatgctgccgctttggatttagctatagtttggaacaaactttgaacaatagaggtaattaactacattctagaatatactaggaagtatacata

SEQ ID NO: 56508 - DNA, 1501 bp, Oryza sativa
tatatatattgcaaaaagtagctaacctgatctgtgtcggcgactgtaacgcgtcaccaatagatttatttaagatcgtaatttggggcccagaaattacagtcaaaagtgtctgaagccactgtcagtagtggacactgatgccaagctagcatgcatgggagccgtagataagtgtacactagatttatttttaatcaaattaacattttaagtttaagcttgtatagttatctctaaccagctggctaattacaaaagtagtgcatttaagacactccagttcagcttttgttgttgtcacttttttttcttaaggagagtgtataagaataatattagggtgcgtgcgtagtgttgtatgttgagtgtatcccttttattcttaagaaatcctttcttgtgaagctaaaaatatcatcatgcaaatttctattcattatcttaaaaaagctacaagtaattattgcttaagtttgttttcagttcttgtttcccctacttgtgtccaaggtgctttatcttattcatagtataaattgtttatctcaatcttcatttaaacttgaattatttttattacgaatatgttgtaattaatccagatgtatagttccaatacttaaactgatggatttggatttaattagcaccaacccattgaactgaactgatgaatttggactaattggcaccaaccaaacgaactgatgaatttggatcaatcggcaccaaccagatgactcaaaaggtccagcatgtatacacctaaccaatgaaacagtttctcaaaaaaaaaagtacacattttggaagttgttaatttacccccagtatgtgtcggcactcggctgcaatcatacaagtcaccaagagattctccgatcctaattttggaaccaaatttgtgttcttcattgaggttctaacctcacctctctcgttttccgtatacacgtctgctaaactattgaacggtgtggttttttaaaaaaagttttttatacaaaagttagtgtaaaagatcatattaatttatttttaaatcttttaagctactgcttaattaatcatgtgttaattcgtcactccattttgcatgtgaacgaaggtgttcccaaccccctccagaagaacacagagcaactcaaactgactgactctgctcttccttcttttctttctttcttttttttccctttctttttgcagagcaccggtactctgccttttgggacacgtagcgaaacttcccaacattagcgctaatcatctttatttatttgctaattatcattgttaacgtagtagattagccacagcccacaagccttcgtccccacccgacagcgacgtcaccaaaccgcgccaccaccaccaccacccgccgccggagcagcgcctcctcctcctcctcgcgccagtataaatccggcctccccctcgccgtgccactcactcatccaccacccaaagacaaagcaagcaagtacagtagcca

SEQ ID NO: 56509 - DNA, 1501 bp, Oryza sativa
actagtttctacagcatcactagccatggcctccagttgacaaaaacccttttattcctgcactgaagcacaatgccaaatcttcaatgatgaaagccagggattacgatcaatcttgtgctgaataaagctgctgagtattttgtgctggtggtggtggacatgaagtagaagaggcaagaacaatgaataatggctgctgctacttcttccactagctgtactgcttttcagctcagcaaattccagaattgcttgtccgggatggccttgtgggacaggaactgggaataaaggttgcctgccacttcgggggtttggcctacacaactcaacatgtttaacacggttgtgatgatgtgattctaatggcctaattggtagtactaatggtgcttggaagttggaatcgaccttttgtggggtcattttgttggataactaataaagtgttcttcttagaggaaaaaaaggggaaaaaaaaagaaaaacaagaggaggataagtgttgctatggaatgaagcaagaggatgaatatagtactccatccgttccaaaatataaggcacaaccaccctcaacccaaaaaccaagaaaccattattatcatctcctagtttggatcaccctaataaatataatgcatgcaaacagtagaattagagatcttgagagtggaggatttaaaaaagtgataatttaatggagaagatgtcctagttaagtgtatgcatgcattcatgccttatattatgtaacatcaaaaaaaagtagttgtgacttatattatgtaacggagagagtactagtacgtccaaataatttggaatctcatgctaagccttttaactcatgcacttcaattcttttccctgcacagaaaagaagccagtgtatgtgttttaagatctctccttcttcttcttcttttttttcatattttcgttttttgaagcaaatattcttatacggtagatgaaagaagaaccacttacccaaaagataatggctcaaaaatatattttgcataaacgtacaaagatgattcacatacacaaatcaacaagtgtatgtgtatgtctatgttctagtacacatacaaaatatattttgcataaacgtacaaaagatgattcgtatacacaaatcaacaagtgtaagtgtatgttcttcttagactctaagacttagagagaaaaatggaaaaaaaagaaaaaagaaaaacaagaggaggataagtgttgctatggaatgaagcaagaggatgaatgatagtactagtaggtcaaaataatttggaatctcatgctaagccttttaactcatgcacttcaattcttattccctgcacagaaaagaagccagtgtatgtgttttaagatctctccttcttctttttttttcatatttttgttttttgaagcaaatattcttatgcggcagatgaaaaaagaaccacttacccaaaagataatggctataaaatatattttgcacaaa

SEQ ID NO: 56510 - DNA, 1501 bp, Oryza sativa
tgaataagatgcagagatgtatgtagcttttgtcagagattgtagaaacacatgaaaagaattgataaattgatgcgatcactcaccagatgcttggtgtaatttcagtggtatagttttctttttacttgaattcagtagtataatttgtccagcaattaatcaaagccccaacaacttcagtgattaattccatacttcattagtatcattaccatcctggagaacaaaaatgtatatgagaattatatttattcagaaaatacagataaaaatcagacaacttaaacatgagtggtacggcaggatgcagtaagcgcaaaagatttgtttcaatttgggaaaaatacaaaagcaaacatcagatttaactcaaacaagtgctatgttgacatttttacgatcatttaaagcaaatccagttgactttgtcccaagacaacatttgagcttctcaaagtacggatatgtgatgaacttgtactaagatgtaccgttataaatttgcaaattgtttatagcacaagttctggggttttgttcccatgagcatccatgaaaaaagaatatgagtgcacagccgcacatagggcttagtctgaaacttggaggtctgaatttactggtggaattttggtatgcatcacctcgtaatccacaactgacttaccctttctgacttgcagatcaatttgtctatggaagaacagttcaccgcgtcacttgcattagttgggtttctagaccagagtgtcggtctacacaaaaaccatcagatcaatcaaattaatccaccagtcaggagtaactcctttgaaagattcctctgaggaacgactgatatctattggagctgcacaaacctgacaataatgagggactgagttgaacaacagcaaatcattggtaactgttccgaaggcattgactggaaacaacttgtaactgcatatcatttttgtgtacttccagcctttcacaacctagtagatgtcatataacatgagaaaccagcaagcaagattagatgccttatagctgaactaataattaccttttatgtggatctagtgacagattgcaccacaatggccaaagggatcctaaaactcttttgtcatcataacataagccttcagcaacttgcttgagaaccaccttagcttgtcagaagaccccgtgggacggctcgcagatttggagccaagatcgaaccctagaaccagttagtcaacttgatcaccattctggctttaatggaagccactttcatcaccattttttacacaacttattcagcagccagacgattctcttcagtttcttacatcttccaagaatcaaagtcactggcaagctagatattgtttagttgtttagacgcgctcgcacaaccaagtctcccttcacctcagtctataaagggcacaccatttgagacacagcacacccactcactctgctcactctcccataccaccaaaagccatggggcaggcta

SEQ ID NO: 56511 - DNA, 1501 bp, Oryza sativa
ttgggggaagaacgaattgccgcagtcctcccacaagtttgttttgaaaaaaaaaaatcgccaccaatccttccggtgataaatgtttgtattcatctatttgccacatgtcacctaacatgctcttgtttcagatttgttcctttcttacaaaaagaatcagtcagcaatgccaaaaggtttcaaaaagatgttggaaacattccccctatctctaatttgcatgtcctatctgaatgaaactaatttatgcagcacaccagacctagccaaatattgttccactcaagtacagctaaaattactggtagtaaggtttgagcatccatgttgcatcatttttgcatctttgcaacattgctatttccttcagcagattcttaaatagcagcatatccttggacataatggagttcttaaaatgcctggttaatgcttgttgagctggctgaagcctgaaggtgcatattggtaaattaggacttgaggttgcatgataatgttcctagtagaagagcttgatgcatgacctttctatgataaacttggtgtgtgattagaagctagtccctagatcatctttttctttgtagcgaatatgcaagagatgttctaagtgcatcctacctaaaagtttgcagactttggccctgctatttgaagtttctgatggctgagaagaactaaataaaccaatgcctattgagtgttgacttaaacttcaagaacactgaggatggtgtctcggcagcaccagctcttaccagtcgaactagcaaccaaaaaaaactatcatgacttccgattggcgtcaagcttctggtcatcattagcatgcattatggcatcgtgattaattgcactctgagaaaaatggaaaaaaaatatcattttcagaaacaaaagccgagacaaattatttgtgttagggataagaaataattgcttacatgaatccctgagcatcaaaaagactcttcaaaatgtgagattcttcattcatgccgagatgagctatggtctattttttttccgcattccatgcctggatgagtttggttcagtctcggaggtcgtctgcacatacctgatcttgccgctagtcatttggaaccttggtattcacatcttcagacaactcgctgaaaatattggatgtttcagtcaaacatctactgaaattattggatgatcagtctatatactatcacatctcctctcctaccctatcttaataatgtttgaagacattaagcttctctctctgcttatgaaacggttttcagattattgtgcgcatggagtatgttgtatatggaggagtgttacgaagtaatcgaactatttttgcaattggttcaattatcccatgagtagctatgagttcaacaggggaaaaaaatctaatgttacaaatttcaaaaagccaagcgctagtgtctagcgctgcctccaccgagagacccgactgtgtgcctctatagggcatctttttggcagg

SEQ ID NO: 56512 - DNA, 1501 bp, Oryza sativa
ctccgtgtggcgggctcgcccgtcgccgctggcgctctgctccgccgccactgctctgctcgccgaggccaccctctctctcgcaatggcggcagcatcatcaatgtcatggcttcctattcgactatgcgccaaccgccacagtgcctgcctctacttccatgcccaccgctgtggcgccatctgctcccggctcgccattgccacgtcaccccttctccagtttcgccgcgccaccgcaccgcccgtcgccgcccgctctttcccacctcaccccaccaaccctatgaggagaataatgagaaagatagagaggaggaagggagagaagaggggaaatagatgacgacgatgtggtgaccctgatgtgtggggcccatgttgagtcagctgccacgtcggataaaaccggagtcaaaaccgtcgagggacctagtttttactggttttgtaagttggaggatgtgttgtatccggtgttgcggttgggggacgattttgtaactcgatgataagttgagggagcttcggtgtacttatccacaaaaaaaaaaaaccaggcgtgaactgggcctgcagcagcttgggctcgatgcccaggctgcggacgatgggaaaaaaaccaggcgtgaagagagaagcccaacccgtggcttatgggacgatgggaaactggagccctcgatctctccccctcaccttgtcgcttcctcctcccccgacgccgccgcttccccaattccggctccggcggcgagcagcaggctgcggacgcgccgtcgaagctccaggaggatgtggatctccggtgtagtctccgtggcatgcctacatcggcggcgcgaatattcagcaccggcttagatcgatggcgcccctcgccgccgggcttccgtggagagcaggtatgcttccgcctctactcctaggtcggtctgcgccgctgttctttggctccgactgaatccatccaacaattagttttgtaccatatcgccgattctgagacaacacgacctgtttattagctcgatttgattccattccatcgccaccccagaggcacccaccccgactgcaatgggcagcggtagggcgtgtatccgcactaccgtttcagctgcaaaaaaaaaaaaaaagcagtgaaaagatcccctactggggcacggcaggcgaccccctgccaaaaagatgccctatagaggcacacagtcgggtctctcggtggaggcagcgctagacactagcgcttggctttttgaaatttgtaacattagatttttttcccctgttgaactcatagctactcatgggataattgaaccaattgcaaaaatagttcgattacttcgtaacactcctccatatacaacatactccatgcgcacaataatctgaaaaccgtttcataagcagagagagaagcttaatgtcttcaaacattattaagatagggtaggagaggagatgtgatagtatatagactgatcatccaataatt

SEQ ID NO: 56513 - DNA, 193 bp, Oryza sativa
atgggtctgtaactccaataggagctagcttcaactggagtaggagtttggagctgggagttggagtttggagccgtaccaaacggggccgaagatgcgttggcctgcaaggctgcagcggagaggcgcgcgagacagttcttgatggattggatcgataacaggggtcgtcgctggcgcgcagtgaggacga

SEQ ID NO: 56514 - DNA, 162 bp, Oryza sativa
tgcttatatacctgatgagtacccgaccatgcatgtggattaatatattatatgcttataccatgtctgattactagtttaatcgtccacccctatatcatgcctctgcaatggatatgctctgctcatgttcttatgccacctcctcctgccaaaattagc

SEQ ID NO: 56515 - DNA, 1501 bp, Oryza sativa
tttgttgtgtaatttttgcacgccgtttgtggtcgtcgtccaccttcagtgaatcctgatggatactgctgcgtgccttttttaagctgtaaaatgaatcttcgtcctttttatagatgtgtaatttttttcctcacattatagatgtgtaattttttgcctcacataatgacgcggcacggtacggctgcgggcgcggtggtgacgggcgactatgggcgggagagacgcggcagttccgcctccaccgccgagtggcggcgtgcgcggcgtcagcggatccggcacagcatggctgcgggcacggcggtgatgggcgattgcaggcgggaggcgaggaggcagcacgccggcacatccggtcgccgctcctcgccccacgcgcgcggatccggctgcggtggggcatatcctgcacaaatgcaggcggcgtggcagcggatccagtgtggatcctgcactggtgacggcgggcgcggctgtgacgggcgactacgagcggtaggcaaggcggcagcggatccggccgctgctccgcgcccacgcgcatggcatgacctccgtggcggccacctccacaacgcgtcgccgtcgatgtccggagcaagcgcgaacgaaaaattaacttatacttatagattgtgtggatgtatatggagtaaaaattttgttgtcataccaagttaatttattactcagtaaggataccaagttaattttttacatagtctccccatgtttttaagcttattaagctgcatcccatgtaaaaaaacaaggtttctaatgaatatgtaaaaacttatacgtattgggatgcatttttttataacaacaaattacaaaaaaaatgcaaacaatcatctctgttaacaagtatgcaaaagctaactcacccaaaaaatgacttgtttgtgggagacgggtattgtaaaaaaaaaactgaatttgatcatcaaatattataatttcaaaaactaatagtaaacttttaactcccaaaccatgtcagtgtaacccacaaccaaactgtatacgggagtaaaaattttactgactttggagaaatttattgagcacctaatatatagggagtgaaaattttactgaagcataattttgctgggagttaatttagcccatggtgccacgtgtagattagaaagatgaatctctcgtgctagagcgaacagggtaaaaaaagcaatagaaacggaaacaacgctcgatgagtaatattttgaccgagatgaccggtgagggagcgaaggtgaacagataaaccggacgcggggactaccgtgagtcgctctacgaagcttcctggcgcgctgcatctgttagtggcgtcctatttgaacctgtgagagaggatacggtggggtgcggagatgctggtgggagccgcgagttaaaaatttactacgttcgggtgagggtcgaaaagatgatctgtggagtgccatatagctacgtagcacttaaggtaccatatagtagt

SEQ ID NO: 56516 - DNA, 1501 bp, Oryza sativa
gggcaggaggccctctagggggcatgatgacacaactagatcgtcagatcaatacacgctcggcggattcaaatccccaaataggagtagtgtattacctctcattgagagggcctgaacctgtctaaatcctttgtctccgcatccatccacttttaggtctcgtgcgctacccccttttattattgccgaaatcatgtttcgacagttggcgcgccaggtaggggacacgtcgaggtcctcatcgacgagtgtgatggaaccaatctccgatgttgttggagtcacaaagatcaatctcggcgagattcaacgatttaatctccaatatcaccggctcatggattggtggcgtcgctgtgtagccgactgctcgtgagcctactccgggacgctttggccgagtggttaaggcgtatgcctgttaagtacatggaagaattaatcttggcgatggacctaatcactgttgccgccgaattctctatttgatcggcaagaccagcagccaattttccaacactaccgggtttaatcttccaacgactccgcaacccggctgccggcgtgtacgtcgactgattaattcggcgagactgattttgccaagatcaaattgaccttcagggcttcaagtctgccgcggtggagccgctgctgcccttccaccttccatatttatgaagtcgccggagccggatatatagcaacatgatccatacacagaacaggagaaaaaatcaagttcaacttcagtattttcttttcatctgccagtggaatctgttgccattggaatcatcttcttatcaaatcgatctacaaagagacgccaggtttctcgttccaatctgttgctctgttagattaatttctaaatgcagattgatctgctatgatattgcttttgcttgcagtatcgtcgtcgttgccgatccgattggtagccacgcgcgactttttctggagcggcacatgcgcggccgaacggtctccttcaggtcacgccgtttgctgtcaccgcacggttcgatcggttgtgcgccgcgagctgcgtgcgaggtggcgctagcacgtacgcttcgctcgacgtatggagttggtgtgatcggacgtctacagtacaacggctgagtaggaatccgttgccgacgattcagccgcacggagctgtcgacgatccaggcgcctacacatatgcatctcgcatgcaagcttgacaacggtcaaccaacaagaatattctatttaattgatatacaagagcatatacagtagcatgcacgcatatttgttcttgttttctaatcaaactgatttgcttgttcgcatgtattcacatatccaacgaggacacaactaaagctgggctcaatctgaccgatgtgcagcgccggctgcttgccatcttcctttgccgaagatgatcttctactttcattgccggtcgtctccgtcatcgttaattagtgccctagccttcgtggctgacctattccat

SEQ ID NO: 56517 - DNA, 211 bp, Oryza sativa
ccatatcagcagtcgcccttcaacaacattccgccaaatcattatgtaagttgattaccatctttttttttgtttggcacttaatcccattctgtttactgccactgcatgtacctgagatatgttacactgaatttattgccattaacatggacaagatagttactctagtcatttgatgttaactattaatttgaaccattgttgtagt

SEQ ID NO: 56518 - DNA, 1501 bp, Oryza sativa
aagacgtcgtggttggtgaagtagtaaaacttgcgaagtaacagcaatagagtttgccagtgccgaagataataaagatgaagtcgccccaccatgatgacaaagttgcatcgccgtgatgaagtgaacacgagtcggcggcaacagaagcaaactggtagcgaagacgcgcggttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagacactgatgcctattagtagtgacagcgatgtagccagccgtgaagaaggtagcatcagttggcgttataacaggccagccgtgcaggcggtgacaccagtcagcggcggatgcggcggccggtcggtgaagacgtagacgcccaacaacggcagcataataagtctgccgtgcaggcggaagcaccaatcggtagcggcgaaggcaagccggtcggtgaagacgtaggcgcccaacaacggcggcataataggccagccgtgcaggcgaggacaccagtcggcggcgacgaaggcaagccggtcggtgaagacgtaggcgcccaacaacggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcgacgaaggcgagccggtcggtgatgttctgactgatccattcctggagcgtaagagataagcttaaagccatgaatcccttttatgcatatctggatctggatcctgcagaacaaacatataggatgagtagtatctgatatataaatataatactcgagaaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgacaggtacttttgtactcagattatgtcgcaagcaatcaagataaat

SEQ ID NO: 56519 - DNA, 1501 bp, Oryza sativa
ctccactctccgcgacgccgccgcttccccaagaccggcggcgagcagccagctggtgatgctgccggagaatctggatccggccgtcagcggcgacggcgacggcgacggccgggcggcgggaaacttcaccagcacggccagttcgacggcgccctcgacgtggagtggagagcaggtatgccacgcacctctactcctagccctaggttgctctgcgcgctgttctttggctccgactgaatccatccggtaatgagttttgtaccatatcgcccattctgagacaacacgacctgtttattagctcgatttgattctattccatcgccaccccagggacacccaccccgactgcaatgggcagcggtagggcgtgtatccgccctaccgtttcagctgcaaaaaaaaaatgcagtgaaaagatcccctactgaggcacggcaggcgaccccctgccggccagctgaaaaaaaagaaaaagaaatggagcagtgaaaagatccccacggcaggcgaccccctgccgaaaagatgccctattgtcgcgaccgggaaaattgccttttcccgaacgctagtgtattaatccccgtcccaggaaaagccggggtacaccaaacaaacatgatacaaaaggcacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagggagtacaaggggataataatatacgggttaagttttgcagtaaacagcatttaaaagtcacttagttgcccaaagccattttataaagacgatcctagagctacacagtattattaaacaaggccgtgaacccacacgaacctgccttaacccaaggcctacgatgattcagaccgaactggcaacccgaccctgggtcccagctcgtcccaagccaacctaggccaaccattccacattttagttgttgaccaaattttaagaattataacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaaccttcgggacaggcaggcaggactgagcccctagcagcagggcaccaaccctgtgccatgacatctcgactaccgggccgcagctcgtgtagccttcatttgtcctagaga

SEQ ID NO: 56520 - DNA, 153 bp, Oryza sativa
tgcgccaccggctcacgcgcgccggcgggatccacgcgtcgtcgccggagtccttccgcgacgacctcagctgcacaggcgcaggtggggatggcaggggagggcagcgccccaatcgccgtcggcaaggcagcatcggcgcggcggtggaga

SEQ ID NO: 56521 - DNA, 1501 bp, Oryza sativa
atatccggtattgtggttaagggatacgaattagactcggtcactagttaagggagtcatagtggacttactccccttagaaaatacttctaggctgcaggcccacaggccacatctagcccccagcggcccagcccaagtttccattccccaatccccagccccaaatccctagcactagccaaggcagtgagctccccgtgcggcggcgcaagaggtgagcggcgcgggggaggcggcgaggtaacgacgagctgcgcagcggagcgcgctctggcgaggcagcaggcggaagcgtgcggcgcggcggcgggcggcggcaggtagcaggcgaagcgcgcggcgccgcgagcgcgagcagccgagcaggtgcagcagcaggccagcggcggcggcggaggctgcaggccggtgctggcgacgccacgggagcacgcgagcaagaggcaggaccaggcgagcaacaggcaggcagcagctggccaacggctgcaaaataactaaacaaggtatgtaatgcttagaattttatgcaaatatgcaatgcaactgtgattactgattacttaattggaaatttggaatgattcaatccattaacaatttagcacagtttctttctttctttttttttgtctagactagaatctcagcatgtcgaaaagaacattgttcaactattattcaagtggcagcagcagtactcctactgcatcagaggatgatgagaacacaagacaacaaaaattggcaagggtagagtttacttgcttagatattgttagtgatccaggaacgtgcaaaccaattgatgagtatccatttgagattagagatcaagtgaagagggcatttgttttaaggggtccaactcaaccagttggttatacatttccttgcaaatggcaaagtggtgaatggagatctttccaacaacgttggttggagatctatgattggttagagtatagtgaatcaaaggatgcagcattttgcttgtactgttatgttttctttgagccaggaaaacctgaaaaatttgggagtaatgtctttcaaaggttgagcgcccccccacccccccaccccaatctttcattcctggatccgcccctggtgttgggtttggtgatgctactgctgcagctgcatagccgcagtaatatctcccgatcagcccctagcttataagtctaaacaaaagaggatacaaagtgtcttagaaaatggaacagagggaacacctggtggtatacagtgatgcctagtagttaagtagcaaggatgacagtttcagtttccgaataaagtggagttcaaaattcaattacctaagcccattgggccatcttttccccgactcattcctgcatgtgtttcggcccaagtcccataaccaaaccatcaaatcgtctccgcaggcggcggcgaatcgagcggcgcggcggctgccaggcgaggccggccggtggggcgccatccagcggcagagcagcgtgct

SEQ ID NO: 56522 - DNA, 1501 bp, Oryza sativa
tgatgccattataacacctaaacattatgtgtatggactgattggtataaagatctgtatggattgacaagattcacgaccaacaagacatacaggtactgtattttccaagtctcttccagttttgttcctcatttgtctaagaagtgtggggaataagtattcttgcattctgccaccacccaacgatctgcaatttatgtcccccatccatgttacattttcttgttagtttagttctccaaaacacaggtaattagaagaacaatattcagattttttttttgttttttttctttaaattctttctggccaaggttttctgacttaattgatgtaactgctacgagacttcctatgccttcccataaaaaaaagtacagttcattcatcctatctattcattgtgtagcagcctgttgtggcggatggtgatggaaggcctgctttccagcttgaaggaaagaactgaaggattgaaggttaagcggcataaacttgtcatagcacatctcatgtgtctgataacataatgcgttgatgtgtcatatgtgcaatcagcgatcttgtactgcttaattacaatggttagaaatgtagctcttgacaaagtaatgattcaggagttctgataattgagaaaacaagacagcatcgtctaaatgtcagccgatggcttctctgactgatgagtatcaacaattttcatggaaacgaataggattacaggagtgtcaacgaatatgatatttgcggggaaattgaagaaagtttttaacaacatgccttcccagtcttgagttagagaattattgcatggcccattttctttgggggtcaaattaggtaggtggtgaatttgacaatcagcatgccgttagtgtcgaagacaagaaatgattctttgtattggtgctgaggaacaaataaatggaaggaattctactcaaaatctcaacaatctaagttgaaaggtaagatctccaaattaaacgctggggataaaaaaagcaaagttgaaagaggggtgcaaatgaaactgaaggcgcagtttcatcttctttagatgagatgctatcatccaacctgctaacggaagtgatttagatgaatattaagtatgggtatataaaacaagaaaactattagtatatgattaattgagtttttattatttcaaacttagaaaataaattaaaaaatggttttatctgatatttcaaagcaacttcgtatgagatgtaccatttaacagtttaaaaaacgtgcttacaaaaatcgagataaaatctttgaaacgaacttggccacgtgtaacaaagatttagcatgacagaatggcacaaattgaaaaaggtaggattgcaacatcgatgcgacactaacatgtcaagtgcgtcttctttttgctacctaccgtgctaaagccaaaatgtagtacaaagccctctgcatctaatgaccattaccatgcaagctaaacccatcaccatggcaacgg

SEQ ID NO: 56523 - DNA, 1501 bp, Oryza sativa
gtataacttttgtttttccgccgtcatcctcctctctttccagtttcccttttctctagaaaattaaactgagtaaattgctgtcaataaccgtagggaaaagaaattgacgcatgaacatgctatggaagctaggatactgattaaatttctagaaaataatagagtggcacacttttttttcaattaaatggaagatgcacaagcgcacaaacctccacaaggtttcgttcaattcattttgacaaagcctgtaatttttgttcgtgtacagtggtggggacttaggataaatactgtgtgaccttgagaagctaaagctatataaaaaaaatagaacaggtttttttcccgatgattaaaaaacatgcttgatgtttgtcagtttctttttatatcaaacattaacttttggacattgtcatggttcgaggtaaactatggtatcctttgctaattcaatgctggtattaacctttttcttactgatcgaaagtgagaattcgtttctgtaacgcatgaattcatttcatttttcaattgagcaccatcaccaaaatgtttaaatggtctaaaatttttgggcaataagaaaataatattacatttggttactcattatttatgatattattttctttatcattttccccaatatttatgcgatttcaacacatatgattcgataccgccattttgtatggagcgagcgtgacaagataacaatctacatgaggtcatgagtcattgtcactattcactggaatacatgtgtaaggtgccacaattttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgatagatttcttgagcttgggacacgtagaattgatccgaatgtggttcaactcactacgctccaaacatcaaattggaccacgctgaaacgacaactagaaataattcgaaaggacagcatgacaaataattggagatgacaatgacaaatagttagggagtactcccccatttcatattataagttgtttgacttttttcttggttaaaattctttaaatttgattaagtttatagtaaaaattagcagcatgtacattgctacaatatttgttttgtattgaaaatgttactatttttttctacgaactcggtcaaagttaaaagaagtttgattaaaaaaaatcaaaccaattataatataaagtgtaatagtttatattatacgtaatacaaagtgtaatagtttcactttgttttttttacaagaaaaaaggggcgcaggattgcagcgtgcagctgactctaccggttaaa

SEQ ID NO: 56524 - DNA, 1501 bp, Oryza sativa
gttggagcagcagccgcagcggcggcgagcacggcgaggctgagtaacaacgcccatgccatggttctcatgcaagaattggctctaccgagataccttggatttttgttttctttacgtggctttaatcgttcggtagtaatactgagagagcagctcgttgctaactatataggcaaacgggacggacttggagtgagatcatcagagctatagtttatatttttcattttgacaatgtacacgtgtttttctattactttgaattgaattaaatgttcttaattaaaggaaaagagcttctagtctagtggttacaagagcctcagtagtacctaaggtcctggctttgactccccgtgggagcaaattttctaggatttaatgactttgtgctttcagtgtggtaggtgatgtacccgtcgacaggatttactggccctgtcgaggcgcctatggtgacttcgtcaatttctaggatttatcggcccagtcttcgaagattctcataggggtagggtttgcttgcgtgcgtttataggggtgcatgagtgtgcgtgcattgtgagtgtctgtgttgcactgtgtaattcagaaaaaaaatgttctcaatttaatttacacattatagtggttcacacacatcagagcgccattaattgtaatcgatccatagctccgttgatatcaaccaaggattaattgacaccgtaccgttttgtacttgcgagaaagcaataagcatttcataagaggatgtatatacggttcaaaataaacatccgtctgaaaaatagaagggtttcgtctgcagaaatggttttcttagtagtgttctagctagcatctccaccaactatagatatacagctatatactttttaacgtttgcattttctatcggcctctacctgcttcctccttgtcatatgctatttcttaaaccagaatcatataatatgtagtcatttgacagtaatgaaatgatgattaggtctttcctcctgcaaaacttatatcaaaatataatcacttgtagcacgaatactactgccaagaactctctcacccttaccctcccttatttaataagatgcaccaaagtcttttcttataaaccttaatcttttctaaacaaccaacaaatgcttatatatcataatagatggatgggaacataacatctacatataagattcatgtgcatactccgtgtataccaactaacaaatatcacaataaattctagaaaaaaattgtgcatatactttcagtagtattacacacctataatgaaaattttaaccccatagtcattatagtttagacataacaaaaatatttaacagttttaaggctataagtctatctgaattttgtatttttctctttatatatcatgaatttaaagatgtgactttacgtgtagatgtgtaatattactaaaagtatttgtttctaatgtttttagtgatatttgatacattttcaagacgaagtg

SEQ ID NO: 56525 - DNA, 341 bp, Oryza sativa
ataagataagcggccacccatgtttaaaaaagtcaatggcgtcaaacattttgggatggagggagtatttttcaagataaatctattcatataatttttacattttcaaactcaacaacttgagagttattcttgatttatattcccaaggtttaacttaatcattctaaacgattttctttacgagtgagtacggagggagtatatagcaagtgtcagatatatatatatatgatgaatccaattaagcacttgtattggtaatacaaccgtaagaaacgagaagagacgtattttacggaaagactaaattcgcgtgcgttggcgcgccgcgttttagg

SEQ ID NO: 56526 - DNA, 525 bp, Oryza sativa
ggcgtcaaacattttgggatggagggagtactttcataaacgtatacatatgtcacttttcaataaatatttttatatcacttttcaataaatatttttatagaaacaagaagttaaagttgtgttttggagaccgtgtcgtagtttaaaataactttcgtaaatggagtataccattgtaattccttgtcaataattatgtactgtacgtaccggttggccgccgcccgccggagagaaaggaggaacactactacaagcacgcatgcatgccgggcggtgcactgcgcagacgaccaatcaaaatcccgccaccgcgccgatgaggaacccgctcgctcgcaagatgccgcacaggaaagccgtcctccaaccgccgtgcaaactgcaaagtcggcgccggctcaagaggaggaggaaattaattcatggaacatgacgaatctaattaaagaccaacaaggagaaccatatgtgaaatcattttcgtaattatggttttggaatgtttgtattcggtttgaa

SEQ ID NO: 56527 - DNA, 1501 bp, Oryza sativa
  unsure (1)..(1501): unsure at all n locations
cggctggcattgtttggggttatgggggccgatggcaccgattttgaattttttttattctaaaattgttttcactggcagttctctttagcttgccgcttggttatcttagcatatccgtttgcgaaactcgattttcgctggtcaacgaaaacccaatttaactaccagcgaaaactatttttgtagtagtgatttatgatgagatatatgagtgacgataacaatattacaccaccaacaacttaaagactggaaggtaaacgaaaagggagttactgaaaaagaagagttatttttaattacataatggtactgaccagtacactacacgtatgtatatgtgtgtggtgatgatgaagaaagcactccctctgtgtaaaaaaaattaacttagaaagaaatttgaccctcctagaaggtataatgaatttggactaccttttatgattcgttattttaaaagggatcacatctacatcccctactaggttaagtaggttgccaacgtgacagagaccaaagtgctgctgtgacatttgggttgaggtaacagacaacggcatcacactatagtactatatacaacagtacgcaaataatatccataaatattatacatacagtgtggtcgagatttaccgcttcccgcgtacgttaaaacaacacacatgatgctaatttatgcgtgtatgaatagtaatataactagcaatatatgttcgcgtgtagaaacaaacattgaatttattggtataacaaatgaatgaatttgatgtatatttggtttggaacagacgaatgctccgcttttaagcagtagaggtaagaatttaaagggaaaaaattcattagtgtctaaatttttccgggtttttttgaaaagaaaaatntttttanataccaattagaannatattaaaaaatggagaaataggaatacatgcaaacttgaatccataggattttcccaaaaggttagagtggacgggaacaaaatatatgttttccctctacatcttgtaggagaaattttttctttggttttcctatatctacattcctaataatcaaatagctttcgtaggaattaatcctaaaagaaattaaaatcctttaaaattcatccaaaatgaataggcgtaaatgagttagggaaaaaaaagaaaagaaggaaatggtgaaaaaggaagagaggcccatgcaggcccaccaaccaccggatctcgatgggaggagtgggccacctcttgtccatcccctcaatcctttcccttccttcttcaaagtcgagactcgagagagacaagaggagaagagagagtgtgggcgctcttaaataggagagaaaaagaaaaccaccgccaccgacatcgcctcgcctcgtaaccnccaaatccagcgcctcccttcctccgcaataatcgaatccaatccatcttccacgcgcattccggatccgcggaccaagggaggatgtcgtcgtcgtcgtcgccgcccg

SEQ ID NO: 56528 - DNA, 653 bp, Oryza sativa
tcggttttaaagcgaaaaatttaggaaacatccaagctaatttctgacctcattcgaaggcctgggggcgatgtcacgcccaattgtacctttttcatttggattttcatgattatttttcgtattaaagccctgatagtaaaacgtacacactactggttagtgtttgagtgaagaggaaaataaatgattgagaagatacgtaaaataaggttagccattagcatataattaatcgagtatcaactattttaaattttaaaatggattaatattatttttaaagtaacatttctatatatttttttaaaaaaacacatcatttagtaatttggaaaatatgcgcacaaaaaataaaaggtttgctccctcaatctccctgaacaaacgcagatacatcttaagtggaaaacaaaaggagatcggatgtattctggcttccagctatcaagaaacaaagagcttaacatactaatgatggacctgccctttcatgcagttttttttttcacagtacgcaatcagtatgagtttgagaacaatgcacagtactttctcaagaaattttgaactaatccaaattatcagttcatgacaatgggaacccacctggatactgtgatagcacgagaaaagctcaggcacacggcatg

SEQ ID NO: 56529 - DNA, 1501 bp, Oryza sativa
gaatgggttgctggcgttatatctgcaagcaaatccatggttcactccttggaagaccttggcaaagtaatcaatcttcaataattaatgaacaaaaggttatttctaacgttcattttttgctaatgaataatatatttctttgcaaagatttgttattgaaatatttgatgaatgttttaaagaaaaatatgttcttcttgcaaaaaaggagagaaaggaataggtataggattaaagccacatgcagtgccccaaatgatggcctagcttttgtggattagattttgggtgagttattttcctcgtttcgcttatgcaactcacttgtttactgtgactattttttaaaccacgaaacagtgaacggtgtcttttttagaaaattttatatatatatatatatatgtgtatacgtttctttaaaaattaaataaatatattttaattttgtaatagttaatatttaattaatcatatactattgttatttctcggttcccgtttacaatatgctagtaaatcttttgatttttatgctattgtatcagctctaacttttgccagatgttgaccagcaattagagccagcattccctcaaaaggaaaatatagccagcatgatcttttatcatatcatcatccgtggaaaattctcttgtgtgtctacagtctcatttcctttcagaaaatagacttaattagtttttcagttcaagtgttctcactcttccggtctattgaatcctgtgcttcatgtatatgtgcaaattaaattatcttatctgaaaaacaaaaaggataacaaattgcaaggcaaatagagctatatatgctgatgcatttgctatatcaactgtaaacgaaattataacaggggaactcacccgatcagttctatgacgcaaggcctgaacatactggtacactaaattttgtggtgtcagtgtgtcggtctgagctccaatgatctcaatggggcatttgacctctgcgtgaaatgtcacgccgaactttggaataagaaaacaatggctatatattcctgtgcaaccctatagctagatcagatgatacatgcatatttcagcaacagcaacaaagaaagaatatcaacctttaatgtcatcgacagtcaccaatccaggatgggtggtgacaatcgcttcaacctcgttggtttttgctacctccacggcaaacttccctgccagttaaaacttgcctttgagagactttaatatgaatcagatctctgtttgttcaatgtggagaggagatcaggaaggttcagagtgtatccttagaatatgaatctggacagactcatgtcttcgttggactagaaaacatctcatccaatactagattggtttttttttatggagggagtatgttgttattcgtgactgcaaacattttttttgtccctagcaacctcaggcggctgcccaggctcattgctgaatccattgaaattatatattagaagattgaaaca

SEQ ID NO: 56530 - DNA, 1501 bp, Oryza sativa
cgagcgccttgagccacgtcgtccccgacttggggaggctggcgaggaggacgtcgccgtcggcgcggggcacgaggccgccgccgccgcgctgcatggcgaccgcgccgcgcgcccaggcgtcgagcacccagtacccctggtgctgtcgcagcttcaggttgtggaagacgcgcgccggcatggcggacacggcggcgtcgtgctccgtgggagggcgcaccgggatggcgtcggcgtcggcggcgtccttgaacgcgacgggccccagccccgcggcggcgccccgcccgtcgcgcgacgtcgccggcgccggcgccgctcctcctcccgatgccagcattacttctcccgtgctacccataggcgggatggatggccagtgtcgatggagtgagcacgtagagtctcatatatatagctgctccagaggaaaattatgcgttttggcccctgcaaaattagacgggattgctaaaattatgacaccatgcatatatttttcacttaattttagtctttttatgtgattactctctttcctatatatatatatatcttctatatactcttttaagttgataataataaattattttttaattctaattcttttatgttagaataattgggctaggcccaatttattctattaaatctcaaaggcccataataaatgttaaggataataataccacctcaggatttaagcgagaaatatctcaacctaaatagggagttattagaggctccctgttgaccagttgaggtgggggtcagaatgccacacgcgcgcgcgcgcgggccgtgggcgaggcgtggctggcggcgtgcgtgcgtcacgtcacgtcgctatccttttgcagccactaacccacgttcccacgattccctccgtgcctgagttgctctctcgcttccccgcttctgatctcttgcacgcacgagagattggcctgagatctacaccgggtaggcgggtgatcaggtttttggggagtgcctcccgcacgactgctcatcgccatgtctagagttgctgccgcctctgttggcggaggtgatacgccgccgccgacaggagctggtgcgccaggaggaggtgccgtgaacgactacaacaacggaggcaattctgcctcaccatccagcggagggccattctcggggtataatcttctcctatactatgtgcttgttcctgttctacatgatgcctctagcatgttatcgcgttactggtatgttcctgttctcgacattcatgatgcgcatagtatgctactggttatgttaagatcaccctacactacttatgccatgatcattgtttctttttcttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggtagacagcga

SEQ ID NO: 56531 - DNA, 1501 bp, Oryza sativa
cctccgcacggcaaggcagttctctgactacaacatccgcgagtacacgcgccgccgcgccgcggacgccttccgtgagaaccgtgccctcggcgacacggctgccgcggcggcagcattcgcggacgggaagaagcagctggaggtggcaaagcggcaggcggtggtgtactctctgtacgccccaaaggccaagagcatcatggagatgaagttgcagtgatcgacgcgagaggtttcgtgctctcttgcttgctgtcctcttactcaggatttctttctgctctgtttctaaagttatgtgataggttcgaggaaaattggtgcaatcaaagctgagatgttatcatgtttgctggataattgccatgacatggttgctatgagttgaataaatcagtcaattccacgattttggtctcttgtgttcaacataccattacctgttaactgtggttggattggtgccgattgcagcacttcgaccagggctcctcgttgctgctggggtccctcgtcctgttgccggcttgcagccaccagtcaccgttgctggtggtggtgccttgtacctgctgctctccgtcctgatggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcgacccgttggctaaatcgctaaacacaaggtcttgctttcatgctcgactggtttcttcagaataaattcctggtccatgtaaaaatttgcattaacaaccttgcaggctgaataagtactgttagccatctgcttagtttttttttcacatcttttcttatttgtggtccacagtacagataattttattttgaattctatttaagattaaatttattcatcaaaaactacgattctaaaacgtggcctgtaaagtggttctcgtaaatattctttcatgcattgcagattgagtatatcattcttcactaatctactagac

SEQ ID NO: 56532 - DNA, 1501 bp, Oryza sativa; identical to SEQ ID NO: 56503

SEQ ID NO: 56533 - DNA, 226 bp, Oryza sativa
agcccttgacttcagtggtacagtagttcatcactgatcatcaaagaagacttggtataggcccattaaactcaactgaggcctatcccgggagagtgaaaaaatggcatctaccatgagttctaccagtataacccgaacggatcagtctggggtaacatagtttggggccactcggtctcgacagatctcatcaactggatccgtcttgaacctgcaatagaag

SEQ ID NO: 56534 - DNA, 731 bp, Oryza sativa
  unsure (1)..(731): unsure at all n locations
ctcccgcacattaggaacccncgttattctcctcttgctttaacaaattcacagccaataaaanaaagcaatggttgagctagtaggagctccgcttgatccggtaaatgagcgaaaaaaaaaattttttaattttccccaaaaattttcccttaatttccaatgtggtctaatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgattttgtgggacccaagggaaaaaatttttttttttttgggggttttgttttcatcccaactagg

SEQ ID NO: 56535 - DNA, 770 bp, Oryza sativa
atataaatttctttttatgataatcttacattctaaatgccttcaatcatttcctacaactgtggaacttaatacctgtcttgaacatagtaaataggcgtgtttcagttggggcctaaaacctaaacccacaggcacgggcattccttgcataagctcattaaacagcatgcatgtgattatggcaaaagtttagtccttttacaaagcattgcacatcttcttttagttttcagtgatctcatgagtctcttttacttttctgttcctgaaaaatcttgcgagtatgggtgactaacccccttgctcctgaaaaatatcttttgacctgatttttgttcttgctgattatggtaattttttaattaatgtacagatctgcagtaagaaggaaaggttgcatgttttactatccttgcttgagaaggatgcaccaaagtcagggattatatttgttgctgaacaggtattgctacttgtggattccatttactccatggcatgttgattatagtgttgctccagggtgatgggatgtgccaatttaggggttagaaattattctagagggaccaaccggccaagggacctcatgatggaccatttatgctatcctatatgcaaatacaaaatgttacttatcatagatagtctttatctgctggtatggaataattttcatttttggtacgattgaagatttaatatctgattctgtttcaatgggaatcaccagctagtccattagctgatattctttatttttatcg

SEQ ID NO: 56536 - DNA, 268 bp, Oryza sativa
cctgcagcccgttaattttcaaaatggaaaattatttttgtaaaacttttaataaaaaaaattataaataaaaaaaattcctaaatagtccttatttgggcccatgggcctgataagcccaacgcatccggtacaatacaagttcttcttctatactacacgagtggagagggagatatagagacggagaagcgagaggggaagagcaccgacctcgacctagctaattaaggcgcaacacagaaaccctcaccgccgcccgcatcca

SEQ ID NO: 56537 - DNA, 458 bp, Oryza sativa
  unsure (1)..(458): unsure at all n locations
gcggccccattagttnctcgttggtacagtagttcatcaaatggatccatggcgtgcgtcatgttgggggcgaagaccatggcgacgttgcggctgcccatcttgttgctccgctcctccctcgccacgtccgccatcagctgcaccgcccagtccagcagcgccgccttcgccgccggcagccgcgcgcacagcctcgcgcagtcgtcggcggactggcaccgcgtcacctccgccgccggcagcgagtccagcatcccgccggggagctcgcggaaccaggccttgatgagccccgccaggcagtgcacgtccacgccgccctccgggagcacgccggagttgagctgctcccggaccgcctgctcctgggcgtcgtcggcggcgatgcggaagatgccctccgccttcagcccgccctgctcgtagagccgccgctgcatcaggaggaggatgca

SEQ ID NO: 56538 - DNA, 256 bp, Oryza sativa
tgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 56539 - DNA, 475 bp, Oryza sativa
tgcagcccgtctaaatttgaccattcgtcttatttaaaaaattttaaaaaaaaattaaaaacacaagtcacgagtaaagtactattaaagctttatcatcttataacaataaaaatactaattataaaaaaaaattaaataagacgaacgattaaagttggacgcggaaactcatggctgcacttattttgggacagaggtagtaaacaaaaataaaaataaaaatatagcgtctctgctaagtgtcaattcctctacctcaaagcttttggttcccaacaactgatgtagctttcttggtgggtcttgttgtctactcatttcatgcttgataccatctggagacagtatttataccccaattattcttacaataaacacaatttagaatctttttaatggtgtatagtactcccttcgtttcacaatgtaagtcattctagcattttccacattcatattgatactaatgaat

SEQ ID NO: 56540 - DNA, 1501 bp, Oryza sativa; identical to SEQ ID NO: 43081

SEQ ID NO: 56541 - DNA, 403 bp, Oryza sativa
aataatttgagctgtttgtagattcgtaggagacaaacatgccgaattgcgcgtatgtattgatgaacatgcgctggtatcaatggcgttttacttgatggctggaggtggtgtcaaagctgcgggcgtggtggcatcggaggtgaaggtgtgcgacgtcgtcgtttgggaggtgagaaggcaaggcttcttggaggcagaggcggaagcggtggctgtggtagaggcggttgcgggggaagacggggatgagccagtgagctgttggtgctcacggcggcgagcggtgggcacctaggtgctcttgacgtggatggagcaaccgaagccgcggcttttgcaacacgtgcggcaatgttggtggccacagtctttctttgcttggttaccgcagtcctagcac

SEQ ID NO: 56542 - DNA, 435 bp, Oryza sativa
ttcctgcagccctattcataactcataagttggattttatctttctctattatttgaggatgttatttcgcgaagttgtatatttatgttatatatatgaattttcaactttttttaagattttctcatgataattggaataatgtttgaacaaagagattaaatttgtgtgcaacatgcgcacctatgcaactccatcaactggtgcaagctggctagcatacgagattagatcttaatcaccatcctgctcgtgcattaagtagtaacaactacactaagcactagtactaactgcactgtacctgtgcaccatgcaacctggctaaaaaaatgtcgttttgacatgagctaaatactaaaaatcaaagaagacaacgtaaatccaagcctgctactagccaacaagaaaacaagaaaacggtcgggtaatca

SEQ ID NO: 56543 - DNA, 1501 bp, Oryza sativa
ttgttttataatgatactatgggttgtttacctattgtcgtagccatgctgttgatgtaccatgtttctttgtcaacttggggttctaacatgattagagttaggactagggattgcttagccatgcctagttcaactagttcacattggggaaaatcctattaatgtttagactgttggttctaatagttttgttggattagtgacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacggaaacgtgtcgtggggctgtgtcttgtggatacagttgtacacctctgatcagagtaaaactattcgaatagccgtgcccgcggttatgggcggtcaaccagattcaccgtgattagtctcaccctagtgtaatcttttgaatttggataatttaggtggatggttgggcctgtcgcaatgtgggttagcgttggacagtggatagttgatactaattaattattacaactgtttaaatctttcaacttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaggtttctccgaggagtaggcttcgtccgtgccgtcgaggatgcctgtggagtggtgttcctgctgcagttttagtcaaggcttagctcctgttgtctttcttttcttccgctgcatttatgtaagacttttatgatgtttgtaagacgtggatctgaatgtcaacattgtcgtttgtgtacccaggctggtcctggacggggaatttaatgcacattctgcttgaaattctattcgggaatttctgggcgtgacaacagtgtagtgcatgactggtttcaacttgccaaaaaactttaaggaaaatccagaagctttcttccggagcgtcaagccgcaagtcgtcgctccgcagaaaactctaccgacaaagaaaccagccataccagctccaccgaccttcaagactatggctgacaagaccctctatgaattcgctgctccctctactgacaatgtggacattgggctgcagatcaacatgggaga

SEQ ID NO: 56544 - DNA, 1501 bp, Oryza sativa
tcccttttatatcgtgggataccttgaccctcaagtaagacttggagatatgtaaaccgacacgatatactagagattttaccctctccgagtaggacttctgcaattccttaacttcgtggagatattttccataatttgaggcgaattcctaacggcgtatacggaaaccaaccgtatacgtgaaggtataccttatcggtatattccataagtcgtaggatagagggtatgcttatccgtaaccctgacagtagcccccgacttcaatttaaatgaattatgtgctcgcacgcgacttctcctgatggagcgttgtcgtactcgttggatcgatctcggttatataaccgtagagacatagagttatcgataacgctttcagggagcctatatgtgcgggttttgaatttaaattgaagtctgaacaacggtccccaatgggcctcagaaattttcggcgaaaatctctcccctttcctcgaaatacgaaccatcagatagtgcgcctatttaatgggattttgggatccatttcgagtccgtttgccaaaaactctcactgttccccagcttccccggactctccgtctccccaatctcctacaccctccatcagcgatcttcttccggcaatctcccccaatggcggacctcgagcaatcttcctccgatgccgccgcgctaaagaagctgtacaccggaggagccgtccctccaaggcaaaccatggcgagggaggtaggaggtactgtcccttctcccgttttaggtcgtatggtagcggtagaggatttcatctgatgtggctttctacctcctccttccgaattcctcttgctgatattaaacttctacgacatttctcttttgcacctaaaccccaactccatcgcttttctgagcatatttgttcatctttgcgaggcctacattggggtagtgcctttccttataaaaagcgaaagcgctggacattaagttgtcgcgtaagtttctatccactatgattttacaattgcattaattgaggcagaagaatgactatagcctcctcggttgtacatattcctaaatggcttattagaaaataaaaattaatttatagataaaacttatatatatttgtttatagcgacttaaaagccaacgctacaaagaaattgcgttgaaaatatcataaaattaacttcataattgacgtttgctttggtttattaggcaaatcgatgaggctccttgttgactaccaatatacgtggaataatggaatattgttaggatgcttccctaaccacaagtgtacgttcaggttaattttgtgagggaaaagttttgcttagtctccataattttcttattttagaaacctttcgaatatttgaaatttgatgaagattttatggaaacaaaatatccatggagctaacagaaatttaaaattaatatttcagactatcgacaacgagacacttataatgagttaatccatgtagttaat

SEQ ID NO: 56545 - DNA, 590 bp, Oryza sativa
cctcttctgtctaaataattggccatgtaaatatggtgttattgcgtacagttctaagtaatactaacattcataatttatgtgaagaaagaaattgccaaatttccttgtgtggttaaaaatggtagacctagtaaactgctctctctggcccattttaaacgcagttacgggtttatgtgcccaaaatttaatcgttcgtcttatttgaaaaatttataaaacaaatttaaaaaataagtcacgcataaattactatttatgttttatcgcctattaaataaaaaaagaattccaatcacaaaatttcaaatagaacagacggtcgataaatttgcacctgcaccgtaagaagttcggatgcgacaacttacaacaatggggcccacctgtcagccagcgctgtggaatccctccccgaaatgcccggctgcccgccttcgctgtgatttctggcgcgaatccttaattttcggattaaataaattaaagaaaaacaaaagaaagagggggaggaagagcgtcgcgcccccatcccctcctccccgtggcggcggcggcggcggcgagccggcgacttcccgccgcca

SEQ ID NO: 56546 - DNA, 528 bp, Oryza sativa
taatagtatttacctgtagagatcgagaaagagaggtttatatcaggagattgggcacaaacatttggcagtattttggtgcttagtgattgatgtacatggaagatatctctttgtgcgatggcaacattacaaggttgctagtcaaaaataggtggcaaattagacttatgatcttaactcataagtaatggtgtaataagatgcagaaaagaaagataatggtattcctacggcagatggtgtatatgcctctaattccaaatgtaggtcattttagttttttcaactcttttctaaatatatgttggtttgaaacttctgcgtgtttttttatttcttccatgtttgtcctcacaagatcgatagtacccctctgataaataaatagatccctttttttccaatgtagtataaacgaagggcaacaaagttattcaagctattttcttaattcatgtgtgcaaatctataacaacttatatttgaaacgaaggctactaattcaagagatatcacgccgagagt

SEQ ID NO: 56547 - DNA, 597 bp, Oryza sativa
cctcattgccataggccttagcattggcgcccaacatccaagcatcaagggtcttcgcgaccctatggcagaagaaattaaaatgatactacctccatattttaatgtatgacgctgttgactttttatccaacatttgaccattcatcttattaaaaaaatttatgcaattgtcatttattttattgtgactagattcatcatcaaatgttatttaaccatgatataaatgttttcatatttatacgaaaattttgaataatacgaatggtcaaacgttagtcgaaaagtcaacggcgtcatacattaaaatacggagggagtattaggcaagagtaagagaaaaaaaaaactaactgttgtgcaatggtaagtatatgcaaatccttaacactgacctgggttcaaatcctgtcctcgtcattgggcaaggaggggagtcaaattaccacttcataccttgtgatgatcatagctcccaaccattttaacatgcatacccctcatccttaacaccaagacctgtggcattgatttgttgggctttctccaacacaatgcttaaattagttgaattgcaagcatggaggaatcccc

SEQ ID NO: 56548 - DNA, 1501 bp, Oryza sativa
ttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggtcttcatactcctcaccgcgatataggatacaatcgttcggacatgcgtgaatcttatgaacttccagtcctaacgggcagactatcttcttaacctcgtacgttgtctcgggcaatttgtttccccacggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaacaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttcgaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactacattttggagacaaaaaaagtgtacaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagac

SEQ ID NO: 56549 - DNA, 1020 bp, Oryza sativa
accgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaaactctaattaacatataaaatgccacttgcgtgatttaaaacttttaaaaatcctctagtcaattataattagcatatgcatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctg

SEQ ID NO: 56550 - DNA, 1501 bp, Oryza sativa
tcgtaatcctcgtcagtcttgtcctcaactccgacgatttttcttttgcctgagagaaccacttgacgcttaggctcatcaggccctctgcccttctttcctttgctagacatgtccttcacgaaaaagacttgctttacatcattggcaaggacaaaaggttcgtccgagtatccaaccttgttaagatcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgctgtggagattatgggtaccccgtatccacacggcatggttatccgactagtaataggggataacatatatgtatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggcgggcagggagccccctctaggggcatgagacaacctgatcgtcagatcaatacacactcggcggattcaaatccccaaacaggagtagggtattacctctcattgagagggcctgaacctatctaaatcctttgtctccgcatccatccacttttaggtctcgtgcgctacccccttttattattgccgaaatcatgtttcgacagttggcgcgccaggtaggggttgcgtcgagttttccgtcgagaagtgcgatggaactttgtgccggcatctttggccgtgatcttctcaacaaaagggcagggtcttcgtcgccaaaaattctatctggatctggtcaatcaaccaggagattaatcaccgatcgaatcgatctacaaccagcttgttatcgtcaattttacctctgtcagtgagatcaaatccgtcgctacaatgctgccatgtctgttggtccgtcggtttcgtcaccagggcatgatttgaagcaatcagcaagcagccgccgccgaaatcatgcgaagatcaccgtcggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccatgcatgtgctaccgacgattacatgtctacacggctgcatgctacggttcatccattgacaggccttgaatcaaaattggatcacaaaccaggtttatcgttctaaattttcttatataaa

SEQ ID NO: 56551 - DNA, 191 bp, Oryza sativa
accgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttt

SEQ ID NO: 56552 - DNA, 1501 bp, Oryza sativa
acatcattgatgacaacatcaggttctattgtgtgtagcatcaagaaaaaaatacactgcacatcatgtgcaacattataagaaaagaatgaaacacacaaacagaacaagatgcaacagaaataaacaatataattgcaacaaaacctacaatcatcttcttcccctactccattggctgaatatacttcttccttcactccagcaactggatccaccaaatgccatttcctcataaacatgcctcctccacctcctcttccacggcgaagcctccaaacatcaaccctcttgttcttctacttcctcgccttcccctgctcgccaccagcacgctgacacgtcagtgccaccttgatgacaagttggatctccccaccatgcagctcccttaaagtctattagaggggatgaagatgattgtggaggagggagaagggagccagtggggaggagggaggatcttttggcggcggcggctgcagaagcagtgactctggcatcgaggagagggttgttgttgcctgcgtggagccatcgaggtcaggatatgggacactcgcatccaagtgtttcccgcaactcaaccgtcggatcacatcttggataaatggctgggattcttgtggaggtgttcgatgggagcgttgcgttggatgctcgatcgtgagcattcttggaaaaatacatgaatagaaaaggatgtgagtgtaaaggaatatagaggtcagtgttcagattacaaaataggaaagtaacagtacctcggcattgtcaaaacgtcaagaattatggagccggagggagtatattttgtcgccatcccagacatttataatttttaaaatttcgtttatctaaatagatctaagaaattacaacacattttaggagatggaaaacacctcgaatgaaagagtagtcaactacaaagtggtagatctcgtcaagatttaaaaatttgtataaagtctatcttcatctgtcttcatatgaaaaagatagatagaaaatacatgtaagtccataggtgatcctttcttcaagaaccgacacatatatgacatatataggtgtaaatttattagatgaaccggcacctatgacttggtagaattattgttgccggtttttttaaaccgacaccaatgagtagttataggtgctagttcttaatttttatcccgtcaaaaggctcatttacatggaaaacgcctcataggtgccggttttaggcaaaccagatcacggagatcctatataatcaatggcggagccagtgacaccattgagttaggttcactaatagcgttttttagtgaccaactaattttcataggcgctgtcgggtgttgtagtggagacggtagcagcggagtttgggtggccagcagacctgccttggaggtggctccgccgctgtatataattttgtcatgctaccctacttaattacatcacctatcatttatatcgtgtcctttgtcgatccaagtgcacg

SEQ ID NO: 56553 - DNA, 1446 bp, Oryza sativa
aacgaacgtgaacgagcgaacgaacgtgaacgagtgaacgaacgaggatgaacgttaacgtgaaatgcaaaatatatatatatatatatatatatatatatatatatatatatatatacatatatattacttggcatttatcctaatacatctgtttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatgtaagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatattagattactttatttgtaattagacttagtatataattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattattgactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtatggttctaatgtacgacatttacagttagcatacatgacttagattgttaaaacataaatgtctcgtgacttagcagatgtttcttgtatgaacaga

SEQ ID NO: 56554 - DNA, 1501 bp, Oryza sativa
gtgttgagttgtaactgtttgctcttgctctgtaacttgatagggaaacttgtggactcacaccttcataatagaaggaaattgagtgtgcaaccccatgttcaggtattctctcaagattgatttggagatgatcattctttttctgaaatactgttatggccatttgctgccattgctgatagtcaaccagggtcacctgtactgaactgcatttacctgtacgtcgagctgtgggccttgcatttgttgtaatggtgtagaagtatttcccagagttcctttttaggagtacttgaggaagtattgggaggagtacttgaggaggtattgggaggtataagatgccatacttcctgaaggacagtaaaaacgctcttgtttaacctggccaagtgggctgggcatgtttggatttcacgtttccatgcgttgccagaaaaggaattcaaatatctatcttttttaataaatgtgttttcacaggttgccgaaaaaaggtgtggtatgtttctgtttgattgattagcaccgcctaacctctttttcctaaaccatgtaatacagttaatttaagtcctattggatgaaacaaataaaccagagcggtgaatgtacgaatatacttagacaaagtcaaataagagacatgttgccattgcataagtttaggtgatatcgccatccaagtgattgagtagttgatatagatcacacctaaaattctaaaatagactagttatgccattagcctccatgcacaagccataaataacttgactagatggccagctaattgattagtaaactatttatataggactgttgttttaaaaaaaatacagattttgttgtagtacatggcgactttttgtttacttcctgaacatcttaaaagtgaatatttggaggaacacactcttaaaaaaacatgattattcgctactttccagtcgcataaacctagacgttaattatgatgttttagactaggttgaagttaaacttttataattttgattataaatgacttcaaaaatacttagtttaaaggcactagaacaacaaatatagttgtatatatatcatagaaaaacatagtcaaagatatatttccgagactgttattgtgcaacacgtcaaggataccatggacattaaaatatatatttatgattaaataggagagtgtattcttcctacatcaaaattcgcacaaaaagagaactctaagttgcagtgtttccctatcaagtatcaatcgcgagctgcataacttatatagtgataaggagaaaccgatggggatttaaaggcttgatgcgatgacgctcttgcaggagaaaccgatggctctcccgcgtgtctcgcgtgacgctataaacaaaccgaatatacaatgcgagcaacgcagctataaaagttggcgaacgacatgtagcatgcattccaagcagagccagaacagtgcgtgacaccgtaatgccgccggagaagcagg

SEQ ID NO: 56555 - DNA, 436 bp, Oryza sativa
cttcaatgcttcatcatgtaggggagtatatgcaattcatgggatatgtcgttagaatgggatctacatcctacccccttgtggtcattggtatgcacttttctgaacacactggttcgagaattcggagtgctggaacttgtgctttatactatatattcccaacttgtgttcttatactctcttgttttatgccttcgcttgcccaacacctgtgtggtctgacacccaatgtcacaatgaactgaactttagttcctggtgcctccaattcttatcagtcaaggcctggagtcttttaagtgatctgtttgagatatggttccgagtatatacatttatatataattgatgggcaaactactgccttattttcttttaaagtagaacctcaccctcctatgcagaccatgacatttccttttcatttctcaga

SEQ ID NO: 56556 - DNA, 1501 bp, Oryza sativa
actaaacggtatattttttgcaaaaaatttctataggaaagttgctttaaaaaatcatattaatccatttttgaaatttaaaatagttaatacttaattaatcatgagttaatagctcacctcgtttgcgtatcttcccaatctcctcaatccccttctcctcaaacacaccctaagaaaataatcaaaattaacatcatttaatatgaaacgacgagggagtatataatataataataaattcgcgacgagggagtatataatataataataaattcgaaatgctaaatgtcattgtacaaaaatttaggggcaatattttacagattttagactgttggattggcgccaagattcgtgcccgcgctttttctcccccaaccccgacgagctctcactcttctccggtgccggcgatgcccccaactccgacaggggacatatatatggattaggatttggggttggattgttagagtaggagtggggatgtggcgggggaagaaggtagttccccaaggtttagagggatgggcgtgggcagcggtgggcggtaaggcaccaatggtggcactagagccatagggatggcaggaggcggtgggccaacgttagcggccgggcaaataacgagactggttagaaggcaacagccgatgatgccgtatctggcgaccgggagccaccagagacggggaagacggcgaaacaagggactcggcgacgttgccttgggaaagagagaggaggagggggagaaggccgaccaaggtgggagagggggctcatcggtgctgttgaccccttctgaccagctggagaggtagcggaggagcaggagacagagccgaaggttttgcgtgagcgcacgaaagcggcggcgatgggcgggattgaggaagacaaagagaaaaaaagatttgggtatatatgtttgcatgaatctcaaagcgatccaatggtatatatttgcaagatttaagagggtctcagtcaaaatccataatgactgtcctatgataaatttcggaagttattctcataaagctattttggtcatttaaacaaaattgtaaagtattaatgaaggctaatcggacggtgatggtaaattatagaagttaaacaaagccaattgcatatcgtagaacgtgataaagtcagtgatggatcatagatatatgataaactcaatagcatataatgtattctcacatctccagctttgtctccacatgataccatacgcatggcacacttgatacaatgagacgcccctactattcgggacaaaagtcacaaaactcgatgctctctccagtctcacctggtcccacgcgaaaaaccatgtggccacccatgtccatacataaaacaactccgccatgcgccccacgcgtgcatctcctgctataaaaacgaacatctccacagtacacgagtgctcattgccttccaagcacagcagctcatcactgagctgaccagagagagccggaga

SEQ ID NO: 56557 - DNA, 359 bp, Oryza sativa
ggatgcgatgtttaacataaatttaatatatttgtaagcctcaagccccctaccccgttggatcctcatgcaaagaagaaaaagaagaaaaagatgccctccaccatttctggatttgcttcacatgatatttttttatacgtcgtactaatttatactattcttaaaaataatgtttaaattataccaatatattataaattaaacgacaacttaattacaaaaagtattatcaaacatacatactgtatctctgtgcctctgcaatctcgcaaagacgtggtatggaactagaaggaaactgcaacaacgcatggtttgaaatggttcttcacctttggcctttttcttaaaccagc

SEQ ID NO: 56558 - DNA, 468 bp, Oryza sativa
atgtaggggtaagaacgaaattgcccccaattaattttggcttggtatttctcccgtatagtgttgagcgctcccaatagcaaatacatgcgtgacaatttttacaatatatgcagtacaaactcaacttgggtggaacttctctaaccgcttctgtaccgccggtctgaccggtgtccggtctaacctaagtttgactgcttctgtaccgccggtctgaccggtgtccggtttgactggagtcttaccgcttctgtaccgctggtctgaccggtgtccggtctgaccgccaattagtagcggtcggaccggcagtacctcggcggtcggaccggcagtacctcggcggtcagaccggcttcagacatattttttttctaaaaattctcaaattatttttgcactcggatatatgcctattcgatctacttgtcgtgtcttagtactggattcctaaatttttattat

SEQ ID NO: 56559 - DNA, 158 bp, Oryza sativa
cccctctcttcctcccctcctccccttcatcttctcctcctcccctctcctccctcccatcagccggcccttcctcctcccctctactccgtcttccatcagccggccggcagcgagcggcggtggcacggcctcgcggggggaggaggcggcgggca

SEQ ID NO: 56560 - DNA, 189 bp, Oryza sativa
ctgctcctgagttgcagtgcatggtggattgtgctatcgcctggtgattaatttgacgttcacgtccttctctctccttggttctctctccttcatattagaatataatgatataaaatgttttagaggaatgagcctattgtaactgccctaaggactgcactcgtttctggctatccattttgatga

SEQ ID NO: 56561 - DNA, 1501 bp, Oryza sativa
gataaattattgggggtgcgattatgtttcttttttcattttttctattttctaaccactcacgcggatcacgatcggatgggggcagcgagctgaggggaatgagagcagcgaggaaacaacacttatttttttcttttctctaactgcttacacagataattatgacatataacaatttcattcggttgatatctgtgtagaacattagcttgattcatcgatttgtacttttcaaaaatatctttttttttcatgattgcatgtataagagtacatctaactgattgattcaaatgttgatataatattttatatggtattgtagagataacctcacctaactaaataaagaggagagatcatacacaaatccgcaaaaccaaccaaacaaaatatcttctgaaccgtctctcttatggaagcaaccaaacaaaatattacattagccaaacaaaataaattcaagcaacaaaacagaggaggaatgtttatcctcttagccatgtcaaactcaggctgtatgagggagataagctagactaaggagatgcgagcaacctaacacatggggaggatagggtagctttgttgatgcatgcctatggttcttcatttaaggatgttctggccgagtattgttacacgaacttatatcctaccctactttaaacatatggattttttcaatcgtcacgctttattttgttcatcgcctacatgaaccccgctgaatcgcccgattgagtcaatcatttcattttttttccatacgtgtttaaattcatgcattgtgtgatataaaatgaaaaattaaaaaaaataaaaaaaggtaaagggagatgagttttgtatttgcctttagaaaaattaaaaaaaataaaaaaaggtaaagggagatgagttttgtatttgcctttagtatattcttgtgcatggtagcaatacttgttagataatatggaactagactttgtatgcattttttactttatatgaacttttgatattgtttttgatagtgtaacgtttcatatagatagagtagaaaattacaagtctatattcctggagggctatagcccaaagggaaataaaaacaaccatgccacacatctacaaccaaatcctgcatgcttcgtatattctcgaaaatactttatgcttgagcaatattattaagaatggagaagttgtaccgatcaaattatcaccaattatatagaacatccatttggaatggcctgctgactgagtcagtgtggagattatgggtaccccatacccacacggcatggttatccgactagttataggggataacttatatctatgtaatatgtaacagatcatgacttgggtgttacgtttccttgtatattacggaacggcgtaaagtcctgatttgggaaaccgataccgtattggttaaggtttctatcttgtaatcctgctccccatcctatataaggtgggcaggaggccctctagggggcagata

SEQ ID NO: 56562 - DNA, 998 bp, Oryza sativa
attttcctaggagatagagaagggtaaaattatcttcagttctaggtacgtaggtaccacatcggtaccatatctcagtacattatttacgtgttcttttttaagatttacattttcttcttaagaacgtattcgctttgtaagcctccatgacgtgatttacatgctttgtagaattcattcactaacaacaaattatatgttttaggaattaaataactaattctataataccatacacctagatttcaatattgacccgaactcaaccatcttccaaatttacctcacgtttggctgatgtgcttcgccttgccattgtcgagttgatctcatctcctattcaattctcaaccataccaacacttctcccatttttttccctggtgaaccaatgcaaacactagaacaagaacgaagtgatgtgtaaagaagattcaacctgattttttgtcatgtgtagatctaatcgatgcctaaatcaatgcctccgaatatttacattttaagtattcgattcaacgtaatgccaatatttcactagttaattactctactgccattggttacaataatttttcttacatacctttctcctctcttgatcaatggtccacattaccccacctctcgataactctaaatagctcgtaaacactgtaaaacctctcatatcttacgtacaaaatgatccgtaactgtttgatgatcagcaatggcacacaaagatacacgaggcaagaataaagaaggaatataatcaaagaggtaaattttgatacccaggctcctaacattttcgctaaatggtgcattcttatttacaaattttcagcgctgtcacacagtcacacactaacacgcaggaccttgcagtagactgcagtctgccagctaagacgacgttggtcaaacatccaagacaaatcagtcttctacatggtacatggatagcaaggccagcaaaagaacaaaacacaaatcgtaaggtaaaaaca

SEQ ID NO: 56563 - DNA, 250 bp, Oryza sativa
acacatcaagtccggctcaagatcattctgggtgcacgacaatgtagcgatggtgcttgttccactcatctgcctcagtgaagagcgggttcgattggtttgtgcgatgatcctaacttggcgcagacctcacaaaagctagcatttcatacggctggtcacattgatgccaggacaatgctatttatctctagcctcaatttacttccgaagggactcgtgttaagctgtttgtatttgtttaattaga

SEQ ID NO: 56564 - DNA, 264 bp, Oryza sativa
  unsure (1)..(264): unsure at all n locations
ttctccaccagtttttctgatggaaggatagtaggattccatggtaggnaaggatggtacattgatggcatcggggtccatgtcaagaaaggtaacttgcttgccccgcgagttagtagtagatcaccgattgagatgaacccctctttgcgctacgacatgcttgcacaatcaaggagtgaaacatacaatgaggtagctacaattcttgtctgaatcataacataagtatgtggctgcagagctaacttgtaaccgttttcc

SEQ ID NO: 56565 - DNA, 446 bp, Oryza sativa
  unsure (1)..(446): unsure at all n locations
ccgagcttttgttttctgattttgtanaacnnnnnnnnnnnnnnnnnnnnnnnnnnnnnnnnnnnnnnnnnnnnnnnnnnnnnnnnnnnnnnntggaggtgctcgtctccgccgagttcagtcggcggagctcaccggcggcgacgggacggggaccctaacttttacaaaatagcccctacttggatcctaccaactctaacttttgcacaatagcccatatatttacatagtagcccccctgtatgatcctaaatattacagcatagcccatactgacccgatcacaattcgcaacggacaatggctggtgccctacattttacaaagtagccccccttctgcttagatcctactagtaactttttttacaaaaatgaccctcctgtaaagtagactggctcgtcttcttccccttccatcctccccaaaatcgtcgccgcgga

SEQ ID NO: 56566 - DNA, 1447 bp, Oryza sativa
gggagtgatcgccgagaaatagggttccagcgaaagcacaaagaggcgagattggctgttgcggcctcccgctggccataatcgcggggaggcggcatgattttccgcttggaaggggaagggcctccgttgtacagtgagtgtaatttcaaattttcatccattaatctgcaaggttagcatgcactgattgatgttggtagatagatacaaaggaatatggcgtttgattatgcaaaaagatgttattttttcctgtaggatgattatcctgacattgttctcgagtaggctagaacatgagagtaataccgctaattaggattgcaatgcaggtcttgatgatggtaaattcaccgctgaggtacaccatggtggtttttttgttggtcagggtagcaatagggcatatgtagatcaaacgataaattggattgaccactgtgaagcaagaacatgggatattgtttgtttggatgaatttttagctatgcttgggtatgatatgactccagattttaaggcttattggttgctccctggaaagactcttgaagatggccttagggttatatctactagggctgactttgaagtgatgaaatcagttgtgcacaaggttaagaattttattatctactttgatcagggtgacacaattgcaggtgtagattgggatgatgtagtagctaatcctattagtgaattgcctaaggtgcttagtcctaggaagatgtcaactgctgataggaaggtgccaaacaaataagatgacagtgacagtgatggtagcttagaagatgacccagattttatggatagtgactatgatatatcagatgcaaatgatgacttgtatgttgacaatgttgatgtgggtgttgaagacttatctgactgcaaggcaaagttttggaagaaagctaagggcagtcagttgaaggggaaagaaatagtagttagaaattctgatggggaggaagtttccactgatgatgaagatttgcagctcccagattcagatgatgatggtgaagtgagattaaagtttaaggctttcatggcagaggatgttaagaacccagtttttaaggttggcatggtgtttccttcagtagaagtacttagaaaggccataacagagtacagtttgaaggctagagtggacatcaagatgcctaggaatgagcaaaaaagacttagggcccattgtgttgagggttgcccatggaacttatatgcatcatttgatagcaggtccaagtcaatgatggtgaagacatatcttggggagcataaatgtcagaaggaatgggtgctgaaaaggtgtactgctaaatggctatctgagaagtacattgaaacttttagagcaaatgataagatgacacttggagggtttgcaaagttagtccaattagcaaatgatattgaaagtactgaaaaa

SEQ ID NO: 56567 - DNA, 171 bp, Oryza sativa
  unsure (1)..(171): unsure at all n locations
gcgcgcatgnaattctcnttccnnnnnnnnnnnnnnnnnnnnnnnnnnnnnnnnnnnnnnnnnnnnnnnnnnnnntaaacggctaaactaatttcggtgctttctctcagggaccattttgaatattacgcgttattatttggacctacctgcaaatatctccttgtcttt

SEQ ID NO: 56568 - DNA, 817 bp, Oryza sativa
attctcggccttctgcctttttcatataccaaccagctgttggcaagctagttccaagctcgcgaatagttggccatcaacgacaaactttccagtcatttctcgagtttcagctgaacagtccaagtgactcagagtgtgtatcaattgaacaaccggagtgactcaaagaggctagatcactcctgatgcctcctaattctacgcataaaatattgtatagcagagcctataagttgcatgatacatttccaaggttgaggataattagctagcccgtacccagtgacaggcacattaggattgctgtccttttgtctatatatctaccaatagcacatagcactatatattgtcccacatatgcatgtattgccatggaccacatagtatttagaaatatttaccctaaagtaatattaagaatattttcaataatctagtatttatgatactttatatagtactttccactattcttttgacacattgttaaattaaaccagtacaacacgtttttagcaagcacatgtaacttatcagtcccagtcccactaatgtagtatgaattcatttacaactttcattgcatcacaccaatttgctagtaaatttgttcccaatgattactccatcaagtacaaccaaatatgcatgttcgagctagaaggctcttaatttagcactaacctttgtttgatctccatatataatttgatattttacacaacgcgtttaataaccctctcaaaattaacctagacgcggcctcagtgattagtgatgtgtgatggctcctggacctacaaatccacaa

SEQ ID NO: 56569 - DNA, 256 bp, Oryza sativa
tcctttttaatgaagggacggtcaaagttaccaagtttacttcggaaccatgctgccagtgcaaagttgaaaaatatggtcagtgcacttcatccttctacagctatcagtttaagttgaatcatgatgcagtttgataattttttgatacgggctacccttgacctttttcttcaggcgtgttacctttggtagtttaatatggtgaacttctcttttcccattcctccttatgctaactggtgtacttgacagg

SEQ ID NO: 56570 - DNA, 1501 bp, Oryza sativa
cggacgcataggcgtgcggcccagacgaccatctctttttttttgatattttgtgattcactgagatgtaattttgtgattcattgtatggatttgagatgtataatctgtgatgtatttgatttgtgtgtaaatttttttaggatttgtgatgttttagatttgtgtgtataagtaactttaagatttgtgatgtggatttgggatttgtgatgtggatttgagatgttactttatttgggatttggggtttgatttgggatgtgcatgccatccgattcgggagaaaataagaaagtaacaaaaaaaaaaagaccatccgggattgtccctatcctctctttagtcccggttggtatccctctctttagtcctggttggtgttatcaaccgggactaaagatagatctttactcccggttatttcgcccgggactaaagatagcgatcattagtcccggattcgtagtcccggttaggaaaccggaactataggagagttataaatcgggagtaaaaacagtttctccaccagtaatatatagaatcatacccccatgctattggtatatgctatttttacttctctttgatgagtctagctagtccaagcaatatattattagaccatggattactctaatcttgaaaggtaatttaattactccgatcaatcttggaactgaaccggataaagtatataggcatatgtagtcaaataggattgggaggtgtctggaatgaggaatgctgtcatcacgttctgtataagacttcataactatagaaagggctggagtggagcaacagaacatgttgctacttgctgccatggaatgtgctattctggtttatatccatgtttgaacagattgagtagaattaggaggcatcaggagttggatagcccggcccataactcggattggtcctttcaccagtcacacaagaatcgccggtgaaatgcaactggatggccatatgtttggcaacatcgaaacaagcatcatcatcctgggccctggcagaatctaaactgcctaggttgggtaatataaaatgcacgaagacgacgaaaccgttccaaccgttgaggcacacacgtcgcgcctcgttgcttgcttgcacatgtttccgagttcagcgctgcaagctatcaatgctggcaaaatcaccctattggtggatatgtaggtgtaggagtacatgtcatcattgctctaatggtgtggtagggcctaaggttaatttttatggtattactccctccgtcccaaaataagtgcagttttgcactattcatctccaacgtttgaccgttcgttttatttgaaatttttttataattattatttttattgttattagatgataaaatatgaatagtactttatgtgtggctaatttttttaaaaaaaattataaatttttcaaataagacggacggtcaaacgttggacacgtatttccacggctgcagttattttgggacggaggtagt

SEQ ID NO: 56571 - DNA, 1501 bp, Oryza sativa
tatcatggttctcttttctcatttactcaaacacactttaagtggtagttattttgggataaattttaaacctaaaagggagaattttttgaacgcatggagtaaattagaatgcaaagtgggctcgcagggtatctatgtaattaattttctcatctatgggttccatagtaaaaaaaatgataaatcgtgtgatttttgcaaataaaaataatagtaaaattcaccttgggctacttttttttatcaccggcgtttcaaagcactttgaatcaccctttaactaattttttcacttttgatcagatacttttaccttagcattttgtaccatccttagttgttttatccatatacatctaaactgtcatatatcaaagaaacaatctatatacaatcaagggagtttattgacgaataagagcataagtactcaaggtcattcatatgcatgaaaagagagtaacaaaggcaatattacccgatccaaagtgaaaacatttggttaaaggatgatcaaatgccaaatatcggtaataaaagatgacccaaagtaaaatttactccaaaaaatttttctagaaaagtgatcttacaagcatattaatccattttcatgtttgaaataattaatacccattaattatacgctgatgacttatctcattttgtgcatcttatcattcttctcttttctccttcactcaaataagcactattatttattttaggataatttttaatttggtgatggagggagtaaactagaatgtgaatatcgaagatttgttaattatatcgaagatttgctaaatggtattgcatgtgaagcgtttacatagttggccaaataaaacattctgcatactaccacattaatattttctacttgcttatattttttgccagtttttatttatctaagtgtaatatgtttgtcaagaaataaacatttccagaattttttcccaaatggaaatattcccaaacagaatttttttcaaaaagaaatatcacaaatatcaccgattattgtcgcttcgttcatttttactccatctcatatatataagaaatcaagctaattctaaataactctacaacatttttatatcctaaaaagtataaatattcacaaggtatttttagttggtgcgccaaaggcgcacccattttctagtattttcctgacatagagtcatgcttcgatagaaatgatattaattacagttcacaaatgttcttccccctgttgtatgcccttgcccttggtgtaagcaacaatggttgaaatgtttatacataatgatggactctatggggtagataattaatctcaaacaacaaagtaggtatataatcgtccaacaatgtaaaaatgtggaaggagaaaatcatgaatttaggctgaggctagtttgcttcccacagtatcagcgacaaacgcatatcgtgccttgcgcatgatctgtgacaagatctcactggtattgtgtttttt

SEQ ID NO: 56572 - DNA, 169 bp, Oryza sativa
  unsure (1)..(169): unsure at all n locations
aatgtacccctttagagcctggacatancccnnnnnnnnnnnnnnnnnnnnnnnnnnnnnnnaatctagattattgagtcagattactataagctaaattattataatctatagtagaataagcggctagttgtggctgtgctaaattattagagtctagattattagg

SEQ ID NO: 56573 - DNA, 394 bp, Oryza sativa
caatgcacgcatgcgtctttctttcgttttcctctctctatcatcattcatcaaccgcagcagtactagtagtacaatggtttggtagtggtacggtgtcttgacgtcttgtcgacggggttgacacgaacgaacagagataattatggccggtagaaattgtcgggttcaaatgccaatcttactgttcggctatctccatgaatcgaattccccccttctcagacagcatggaacaaaatttcttcctaccccaataatctaaaccgtacgaatctttctttctttctttctttcccaatcaaccaaagaagatagcaacaagcactagtagtaatccaggctgtaggaatctccggtggcgtgtagctttggtggctgtcgttgggttaga

SEQ ID NO: 56574 - DNA, 160 bp, Oryza sativa
  unsure (1)..(160): unsure at all n locations
atgttcttctccttcaagatcgccaacnaattataaacntgctccagttcctcccaaaatctcacaaagtgggtaatgcactccaagttcctccaaaatctccccaattgaaaagcttgtccagttccccccaaatcaccaccaagtgctaaagatacat

SEQ ID NO: 56575 - DNA, 595 bp, Oryza sativa
agtggcgggcgggcccgcctgtcagcggcgcgcgcgcgcgcggggagccgatgggccgaggggaaagagagagagagagggagggaatgggccgagccggcccaagaaggaagggggagggggaaaagacttcttttaggattttctttttataaacctttttaactttgttcatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttaattattcttttgcacaatttcgaggatagattttagagtcgatttgggacgcgacattttcttactccctgagatctctcgtttgcttgttttgcctgtttaggtggtaatgataatacgtgctatatcagtttgcattattttgatgcttaggcagctttgacgctagcattaatgtgggctaagtttgctttttgtataggtaatccgtccagtgctgcctctgtctcagtagaagctggaccaaaacaagctggtatcaactcaga

SEQ ID NO: 56576 - DNA, 1501 bp, Oryza sativa
agaaaatatccgcacgcagcatcctacccaaaagtctccactctccacaccacctaagctcctacgccgcggccgccggcgactcaacttcgctcagctcgcctctgctctggtcaacagccatacccgcctccccttaccacccaccccaaacaaaccactatgcaaatagtaatccaaacaccatcacttgtcagatttatcatatcgcacaagctttcagtcgactgtgccatggattcttttaggcaggcaaggcaatgcgtcgagcacctggtgtgcatacagcttatctatgaaaacaggagatgatggaggtgggggtgtatgtacttacagtttgttgatgtggcagagggtcccgttgttgtacttgcagtcgcacttgatgaacgggttgagatttgggtagtcgtcccagttggacaggtcggaggcgacgccgctgcagagctcgccgctgatgttccactccggcgacgccgtcttgccccatctccccaggatcgtgttcaacgccgccgctgcaatcacgcgcggggttagcgaactcaatattaaccaaagaagctaactagtaagacgcttgaacagttgaagtaacaattactgcgtgatgatgatcacgtactcaccttcgactggatcagttcgcggctgagcctgagcagctgcgataatccgccatgagcacagcacaagcacaagcagcggccacgcgagatgggtgaagacaccggccatgctaggccgcatcgctatcgatctgtctccacgcgtttgtctcttttctggtctcgctctctttgctggactggagactggactggcggcgaggcaacattgttgggattgttaaatagatttgaagtcgttggagcagtagttgtggccaataatttttaattttgcaaaccaagcgacgccaaactatatacgtgtgtgccaaaccgtatattgacgtttatttcatgaaaaaaagacaaataaaatgtcaaggctaaggagaggttgaaatatttgtcgtattggataacactaatgtcaaattttatctatgaataacttctcaaatatttgcgttagaaacatgaagactatgcatatgcgcctgtttgcacagctccaactacaactccaccttttctcgagctagagctcagccaaacagttttagaggggagctaggtgaaccaaataaactagagaggtggagctgagtttagacagctccacaacttcactacagaaccaactactggagttaaatttaaaagttggagttctaccaaacggaccttatatgtgacaccctggttcaattaagatttaacatgtgtggtccattagagctatgagtgttaagagcaaagttttaaatctccggctaagcctcttagctgctgaccttctcaacagctaagcacagctatagctggagatagctgcagctaagccatttagctgtttttgcaaataaataaataaataaaagacatga

SEQ ID NO: 56577 - DNA, 1501 bp, Oryza sativa
atgtaaatggtgtgagaatttgtttgtgttgcatgaactataggtttttttgcaatcacatgcagacatacatcaccactcctgacgcacaacacatgtatacacccgcaagtgcgcccctttaactcaccatcatgatatggaagccaatgataaattcgtgaaagcctcattaaattccttaaccataggattttcagtttggtttaaccattactacaaaacaccccatagagaccaaccttataggtgctggtttacttaaaactgacacctataaagctttttcctttttttttttgtgtaaaattaagagccggtacctacaaacacttattggtaccagtttgtaacaaaaaccggcatcaatagtcctccaaagtcataggtgccggttctcataacaaaccgttacctagacaacacataggtgcccgttcttatcataaaccggcacctataactacggtatcataggtactggtttttattatgatccggaacatatgggcatcacatatgtactggttcttaataaaaaccggtacctatgagcccataggtgcctgcttacaattaaaactgcacctatgatgacacaactcatatatgtgtgtgttttatctaactttttcatataaagtcgtatgaagataagctttatatcaaatttgtagagctcgacgagatctacaactttgtagtttatgacttttttattgaaggatgtttggatgtccgaaaatgtgttacaaggtctcaaatctagttgcatgagtggatatttaaaatttctaaacgatatcgggtggagacaaaacctatataaaaattgtagatatggatgagatctacatttttgtaactgacaaacttttcatttgagcttatctatggtgttagatatggattataaatttggatgatagtggtctcaaaggaatagcatttatttccaagacaagaagtggttgtaggtgagatggtaatgtgactttgtgtgaagtgagtggtcttgagtttgaatcttccatgagacatgtatgtgattatgggttgaaaaaatcatgtgacttgtgggatgagagagttattgtataggtgcctaataaaaatatcattttttttaatttttttagcacctgcaaaaataaaaaaacaggtgcacccctataggcctatagtgccacaaacttggttctaaattagactggttctaattggtgccggtaccggacctataagccctctaaaactggcacctatgagcttttaagtagtagtaaacgctgtatgggaaaataatcattttcctattttctggcaaaaaatcccataagctctcatctgactgtttggaattttgttggaatcaataattcaatttccatgagatcccaaatacctttctgccaggattttggttccaattctgcgaccccacgcccatatcattgatccaaatgcagcttaaagtgatttactagattgcatagttatg

SEQ ID NO: 56578 - DNA, 859 bp, Oryza sativa
  unsure (1)..(859): unsure at all n locations
agtgtgcngnnnnnnntttgaatagactacnnnnnnnnnnnnnnnnnnnnnnnnnnnnnnnnnnnnnnnnnnnnnnnnnnnnnnnnnnacctacccgttgtagcaaccgtcgaactcgacttcccccacggcgtagctgttgggctcgacccccatcactacagccaccgcggattcgacctccccagctccccgccgctatgaacacctctcagattcgtttcacagaaaacttatacatgatcgaaataccaaacaatagaaggggttttctgataaaatagggccattgcttacgagcaggcaaacctgtccttcttacgtgaatgcttagttgggggtctactcatcatccaactcagcaaaattagatttgctattctatttagtcatagtccgcacgcacctatacaagtttgtgcaccaaaacaagagttttgaagtttttacactataatgcacccacctaacaagtttgtgtaccgcgggcgcaatttactcttttttttcnaagactagctaaatgtatgtgctttgctacgtatagataaaaatggcaaatttcataatattggcctaataaagagtaacatattttcatgaaaagtatatattacccgcctttttttatagagaataccccttaatttaatttcaatgtggttatccacttagatttagttgttatgcgatnnnnnnnnnnnnnnnnnnnnnnnnnnnnnnnnnnnnnnnnnnnnnnnnnnnnnnnnnnctgatgaatcccctaatgattttggtaaaaatcattaagttaaggtggatacacatcttgtcatatgatcaaatggtttcgcgaaaaatcaataatcagacaacaaga

SEQ ID NO: 56579 - DNA, 1501 bp, Oryza sativa
tactcctactactgctagtgtgctagtggtaggagtagtctaccaggactagtactccactctccgagaaccaaacaaatcgacaggaggcggctggtgtgcgcatgtgacccggatcgatcgacagcggtcgcccgcaccgcattgccgctgctcccgtttagtccagccgccgcctcctcctcctcctccgccgccgccgcctgttcaggctccggtgaggtctcttgtcttgatgttttaatagattgtggtaggttcttggtttgtgatggtcagagagtctcagagatgaggcaaaggagggttctttggtgctgtcctggggggtttcggttgggtttagggtgcagtgtgcttgtgattgttgcttggcttcctgtgctgcattatttttgttgattttgttggtgatttgcgatttgtgaggaccacattggactgggattttggtagcaactagcaagaaggaagagaatactatatgtggggaactattttattttagccctctctttatgtttttcttttctccccttttgcccatgtcgtggtggtagggcacacttattgttttttttttaatctaaagaacctgagcctgctgggtcatttcatcaggatttggtatctgcatcgagaaagattatggcattgtgggtgttgcttttgaggtggtgaatttatgaatctatgaatctatgatgttgttgttacttggtcagagctaggaatcggagaaaggtgactttgcttgttgcttttctcaccattttactcttgctgctctggtgtttgccttaatccctaaattgctcagtcaaaggcgttcgcttgaatggacttggtgcatttggccattgggtaatgatttcttgagcatttttaggttagcaagggtaggggagcaaaggttgttcctttagttcttttgctctttaccttagcccatgacattggttcttgccggtgcatgttccctgcaccggcggccgccatggatgatgcttgaagagttggaactttggaggtctgaggaggctgagttttcaacaaagatagagatgaatgttgcccgtggagtaattcttgtgaggcctgcagatgtgccggctaattgcctgatggagtgaactttttaaagactttctgttgagttgggcatctatagctcaagttagaaggatatgtgacgaattttgtgcctctgttcaaaattgttttattggtgtaatttggatttcactagtttattttaagattatgctttacttaatgttctttctattgttagttatttctactagctggaagcatgacctttcttctttgttgtttcgattagatccaaggactgaagactactgccagtttcagggaggaattctactcagtggtagcttgtggttgtagctggtcttttgatgaatctgttggtctcaaaaacattgtagaatagtatttgttggttcgttgaacacaatgggttcttcgccatcca

SEQ ID NO: 56580 - DNA, 499 bp, Oryza sativa
  unsure (1)..(499): unsure at all n locations
cggcgcttgtnatgtagatcnnnnnnnnnnnnnnnnnnnnnnnnnnnnnnnnnnnnnnnnnnnnnnnnnnnnnnnnnnnnnttggagatgattgaatttacaggtgaattacaggtgctgtcattttatgtgaccggtcagaccgggaattgtgtgctggtcagaccggcggtatgcgcgcggtcagaccggccagcccgcggtctgaccggctgactctgtgtcggtttcggtttcgggttgtttgtttggatatccgtgattatttcatgattatggcttctagatggatactatacatatgtaatactgttgtttgctactaatgagtcaagttggagatagcttgttctcggaatatggtttctttgtttatttcatgtgtaggtgactcgatgcctcgggagagtatttgcggtgatggaccgggagtcggcttggggataagacgacgttcgtggtggtcagagatcatgcgggatacttaggctagagttga

SEQ ID NO: 56581 - DNA, 192 bp, Oryza sativa
tccaaactcgtactgttggaaaattgtgcgcgtgaaaatattgtaaccaaaatctgaaaagaaatgaggtacaatattgggagtgttgtattgtagtaatagaagacttgactaattaagtcggatcctatcaatccctcttagggattgacttgactaattaaatcggatcttactagtctctcccttaga

SEQ ID NO: 56582 - DNA, 1501 bp, Oryza sativa
tcagtaaagcatcctacttaccctggttgagaatattctcacgattgcagcagactcgaagtgcggacacaaatcgggcagtaggtggcttgcctggagaacctggtatttgaggaataaaacaaagatatggagttccatcaaacaatgtcgggcatggtgcaggggaaaaaacagacaagacaatgactcagcatatgattatcacctggaatcttagcacatatatcaagtctgatcttctttgtctcaagcattctggaaacctcattcccagcttctgcggcacgtacaaaccgagtttcaatgtctttcatgcttgacacaaaatcttttgctctatgagtgatgaactctgaagggtcttctgcttctgtgcacaattctttttccatgtcatcttcctccacctttgctccaacttgcccagaagtagtagcttcagttgtaacctcaaccgatccacttggcttactcatcccacctttctttgcttgggcttcttgcttaggtgctgcattatcaccaggaagctctgggtgcattcgatcagacctgtttgttgtttcttctctcagcgagactgcttcagattcccttgaatctctcaggcccttcaatctactaaaatttaatgtcactccattctcattatttgaggtggcactaccagaagtataattggaatcgaagaagtcccacgaggtacataattcagggggcaatggtggtggtggtggcacaaaggtagataccggggattcttgccccacaaagtcagcagcagatggtcaatagtgaacgtcaaaggttttgttcctgctgctttcatgtaatggatctttgttgagggaggagtcagctgactacctcgatgtactggggagccagtgctctctactgctcgagaaggtgatggagaagccatagaagaatgtgatggtgacttatctgcttctgaaatggacagtgatgattctggtgagatctcagactctgcataccgccgcaatgcagtacccacactacggagggactgagtatatgataggtgtgatgccgacagtgcatctcttgaatcaatagctcgcctgatatggcgcattcgctccttgcatagaactagggcatcctcaccagtggctttggatggcgaagaacccattgtgttcaacgaaccaacaaatactattctacaatgtttttgagaccaacagattcatcaaaagaccagctacaaccacaagctaccactgagtagaattcctccctgaaactggcagtagtcttcagtccttggatctaatcgaaacaacaaagaagaaaggtcatgcttccagctagtagaaataactaacaatagaaagaacattaagtaaagcataatcttaaaataaactagtgaaatccaaattacaccaataaaacaattttgaacagaggcacaaaattcgtcacatatccttctaacttgagctatagatgcccaactcaacagaaa

SEQ ID NO: 56583 - DNA, 925 bp, Oryza sativa
cgtggcggcgcggcgccggtgccgtgccgtggcggcgtcgtggcgtctcgtggcgcggcatcgtgtcgtgatgaggtcggcgtcggcgtctgaaactcggtggctggcggcaaccgagagtaaagatatctttactctcgattgttctcatcaaccgggactaaagatcttttcccgctatttccaaattctttttaaacccggttagggttaagaaccggaactactgataagcgcactgaatattattttccattacatatgtgtttctaaaatagaagataatgcattacaattatttaaaattatttaaagtacaaagattaatgataattacttcgaaaaattattgttgtctgtaataaattaagtggataaaacgtaataagcaaatatatgatttaaaattaataaaaattctaataatcatatatacttagcatatgaatgatattattaaattggtaaaaactctaattaacatatgtatatacatacggcatgatttaaaattaataaaaattgtaaacatcatatatacttagcataggaattatattaaattaattgttaaaaactctaattaacatatgtaaatgccacatgcatgatttaaaaattttaaaaaatcgaatagtcatatataactagcatatgaatgatagtaaattaaattgtgaaaaactctaattaacatatgtaaatgccacatgcatgatttgaaacttttaaaaattctttagtcaattataattagcatatgaattatagtaaattaaatgttaaaaactctaattaacatatgaaattgccacctgcgtgatttaaaacaattaaaaattgtaagtatcgcgtataactagcatatacatgatttaaacttgttaaaacctctaataatcgtgcgtaattaacatattccata

SEQ ID NO: 56584 - DNA, 810 bp, Oryza sativa
  unsure (1)..(810): unsure at all n locations
aggcgccttgantttcganactgaagaacctctagcnnnnnnnnnnnnnnnnnnnnnnnnnnnnnnnnnnnnnnnnnnnnnnnnnnnnnntgtccggggattgatttgccgagtgtattattgatcgtatgatctgggagcagatcgtgccctaagaggcacctggacccctccttatataggggaaggggtccgtattataaaatacagtccatatccctaacggaataagtagttacagataagattcaatcttaaccgactaagatcccgggtatttccttaacatacaagtttggaatttaacccaagtccctttaaagatattctatctatacatggcaccccatacccagtcggattataaatgccgtgttggtatggggtatccataatctccacaaaattggaataatgtgacggaaaagttgaaagtttgtgtgtaggaaagttttgatgtgatggaaaagttgaaagtttggaactaaactcggcctataatatataggacgattcattttgcttgaagattggtgatctaccggtatatttcctccgtactaaaataaacaatccagtatgaagtatgatatatcagaatcctattgttacgaaatccggacagtagatcgttataattgcccaaccaaaaaaaaaaagatcgttataattgccagtacacgaaggaattattactattgggccgattgggtcaataagcccatgagagcccactgggccggtgctgctgacgtcacgccgagctacttacctccgcgagcggccacaactccgctccccttccccctc

SEQ ID NO: 56585 - DNA, 1501 bp, Oryza sativa
caaccgtgactaaagatccatctctagtcccggttattttaaccagtactaaagatgttcatctttagtcccgaattgctactcccggttggaaaaccgggaggtttccaaccgggagtaaaaatgggttctccaccggtgaatgtttagtagaccaattatgtatttgtcacatgggtaaagcagaaaatgtcaggagtactgcaaaaaatgctattatgcatatctaagggtagtagatcagtttttaacttgacagcaaccaaaagccatgcagaaatctacaaatccatgtgtgtctcagtcatggagtgcgccccatttccttggtgactaaaccattataacgggatcaaagtacgacgtcagattcctttatactgcaaactcggtatctacatttgcatacatctgagcaatcaaaattttaaattatcaaatagaataaaacttgaacctattgtgtgccatcatatatctacaatttatccatcatattccatgaaacagtccatttatcttcaaattcctagaataattcaatctgatccaatttagaaagataaaggcactggtggagaaaccatctttcgtcagtcggccgaattccacaatagtcccggatacaataaaaaccggggctaaagatgatctttagtcccggttaaaaagggtaacgggcatatttgatctttagtcccggttggtaacacaccaaccgggactaaagatcatctttagtcccggttcaaatgctgtcagggtctgttaggcccctcgggatttttagtcccggttggcaccaaccggaactaaagatcgtaactttagtcccggttggtattaccaaccgggactatagatctcgtggatctttagccccggttggtaacaccaaccaggactaaagtcccacccctatatatgtcttcttcctcctccagctgcccgagcaagcttcaaaatttcttcaaaaaagaggggaggtcatgccaaaatttctagtgaatttattttggtgattacatacaaatcggaggtgcctaaaaggtttgcaacttcatcctccaatgttttttttgtcatattacatttgtagctatgttttgcacacttttttgtctccaaaatttagttgtaagttgatgagggagaaaatttgtgtggggaataaagaatatatagaaatttagttgatttgctaaagaaggttttataaaatagttgagaaggaaaactatagtgaaagttaatcttgaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtacgattttttttcgactcatgtagat

SEQ ID NO: 56586 - DNA, 575 bp, Oryza sativa
acgattaggaaaacgggacacagttgatcagaaaagcactcgacttagcattaaccagcctaaacgcggggaacgctttacagaatgcaaccctttgcccttttggaattaaaagtttggaattacaggccatgacacggctcaaacccagactgaacatctattacaggtaacaagcattatttttttttgattgcaagactgtatacaggcgtcatcacgttaccagcgaccgttggcgtaacggcgatggtatagaaaggatccattcaactcactagccaaattggtgtaatccggtatttgctgggggtatccatttgacccaactgcatggttcatcgatggatatgagagccatcaaccaagctttgatggacttatgtacacagccattagaataagcattcatgagggaaatggctttccttgtcccctggaagcacctatgtataggccctgagtatccctcgcggaaatgggtaagcaaataaaccgcccagactgttagcgaaaccatttctgtctgccaattggctttaacaaaacggtacggtggacaaatgttggggata

SEQ ID NO: 56587 - DNA, 420 bp, Oryza sativa
gcccagatcgatagtttggtttcaaaatatggtcaaataaacaattgtccctttctttaagaaaaagtacaatagcaggctgtggagccagctataaacatattttaaagagataaagaaagagagagaagagcagcgggctacagatctgaagccagctgcagcgcggaattcaagacgtaatgtgtgtatgataagtgggaccatgtattagtagtatagtaagcaactacttattatatgaattggctattatattgattataaataatttagagtcagtagtagtgggtcttgctctagctgaagaatcaggtgagtcgcgtcgctgcgtgccgtggcgagacgccggccgcgtacagaacctctctctgcttgctccccatctgctacagccactgtgttgtgcgcacgtgtagc

SEQ ID NO: 56588 - DNA, 1003 bp, Oryza sativa
tcccgctcctgccacaccgagaacgtgaacgagcgaacgaacgtgaacgtgaaatgcaattataggcaggtgaatgaacgtgaacgaacaaacgtaggtgaatgaaacgtgaccttaacgagaacgcgtacgtgaacgatatcgtgaacgaaacatgaacgtcaaatgcaatatatgttacttcgcgtttatgctaatacatctttttgtatcttgcagaaaagacgttgttggagtcgtccctcaagccggagtggtagagctagccctcgaaggaattcgcgcaggcaagtaacgtaattatatatatatatatatatgattgttatatttgtaatgcaattaagattattagatttgtaattagacttaattagcatataagattgtgtagtgttctaatatacgacagttatacttagaatacatgactatttgagttttagtataagattattggagttttaatataagattattatatttgtaattagacttagtatataattattgactagctagggtcctataatatacgtcacctagacttagcatatatcatcactatttgagttttagtataagattattagatttgtaattagacttagcatgtaagattgtgtagggttctaatatacgacagttacacttagcatacatgactattttagtcttagcatataagattatttgagttttaatataagattattatatttgtaattagacttagtatataattattgactagctagggtcctataatatacgtcacctagacttagcatatatcattactatttgagttttagtataagattattagatttgtaattagacttagcttctaagattgtgtagggttctaatatacgacaattacacttagcatacatgactgttcatttagtcttagtatataagattatttgagttttaatataagatttttaaaacataaatgtctcatgacttagcagatgtttcctgtatgaataga

SEQ ID NO: 56589 - DNA, 162 bp, Oryza sativa
  unsure (1)..(162): unsure at all n locations
gtagtngaatttcctcaaaacaggtctcgactaaaaagctcgtaaaagaccgtcgcattgtgataacgtcgtatccctgtaaatacggagccgactggattaaggctgcttcacgggcttcttccagtcggttgagatcatccactcggtcttctccgtagc

SEQ ID NO: 56590 - DNA, 1455 bp, Oryza sativa
catctctctaccggtggcgctcatctccaggtacagctgatggaacttgtacatttgtgtgggtagggactgcagcagctcaggcttgacaagcggtttaccgagttcgtacatgtatttcacttccgccttttcgattagtgcgactcctagcaattgatccgtagttagactggtatcagtaataaattcttctatcgtcatttctttatcggtcaccaacggctcgatctcctggtttggttgctctccaagctgagggactggtttggactttccagaagatgctttcttcagcgttcgctcatagtccgatagcttaatggcctccttggcaggtgcagacatacccctgaagaagttcatgacactcgagtctataggaatcttcttttctggccttcgaggcttgaattgtctcttgacttctgatgccacgtaagcgtcaagctcctcttgcgtgcaatcgtaccccgggtccttgttcttggcggcgtcaactttcaccttcttcgttgcccttgtgtgggtaggcggtggagcttggggggcccttgactttgaaggtgtcggaagaggagtttgcggaggagtcagtgtaggagcccgaggaggagtcggtgcaggagcctgaggaggagtcggtgcaggagcctgaggtggagacggtgctggagcatgaggaggagacggtgcaggatcctgaggaggagatggtggagccggaggagacggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgtggtgagaggttatttattactaatcaacgatatataagctgcaactatcggtatggccaaatctaaaatatataaactatgagcttacctttattgataagttcttgaaaggaatatgcagctcacatggtgtccgctgagtgatgtcatcaacggggcaggtggattcgtcctgggtttgcatggcgtccatgctctgtgatcctacttgccccgttgaggcgcagctgctacggtttcctgacgggctcaccattgcaggaggaatggtcggctgggatcatgggaccgatgtgcggccatgcgttcatcaaccttccttgccacctcctcttgcatgctgcgctcgtagctcgataccctgaactctagatctgcaatcttcgcctcggtatctctcttgcgcctcatccgactcctgtacgtgtggatgtcctccttgaacccaatcttccaaggaatcacccatttccctcgt

SEQ ID NO: 56591 - DNA, 311 bp, Oryza sativa
attcggtggccccagtgctatagtatacttcctgtgtccctaaatatttgacgtagttgattttttagcacatgtttaactatttatcttattcaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagc

SEQ ID NO: 56592 - DNA, 1501 bp, Oryza sativa
acagaaatagcttgatggccaaaccatggattgttgaaggatgtttgccgtaatgtgaacttggaattcacttcagtgtgctcaactaaatcctcggtggccatgtcatcgtcatcatcattgatcatttgttcattgcctttcgtcaaacacttggtaggtgtcgccatacacgactcattagtatcaaccaagctaattgaattggcctcctttctgacctccaatgtgttgggaactgattcagtgttggtgcttgtaactgccaccactctggtgatatcaacgctcgcggttgactcgcatgtcacgagcatgttgttgagcatggcaatcatcttggcacacaactcttggaatgtctcctctggtttaatctcagatttgtccatgtcggcctcatcctccttagtcgcggtgagggaaaccggtggcgccgctgctgctgatgcggctgagggcatagattgactcatggtggctgggaacacatgttccaatgtggtaggagtgctctcggcatcggacttggtgatggcacagcttggtaccggcgtcgaacacttggtgggcgtcggcactgcaccatccttggaacaaggctgcgcatgctgagcctcgagtaggcaccctccatcatagatgttgcggccatgggtggccccccgagccttcttcgcatcacctctcgcccggaaccaaacaagaacctccactcgccatgcgtcgaccaccagtatatgcaattcctccgctccatagatgtcataaacctggtacaataccttattggtcactgggtagatgatgtggctcacttggacatgaagagcagcacctgcaccagctcccagccagcttggcattgcatcaaacacctggcgggcgcctccagtgcaactacctccaatgcttggattcagtatctggaagtcgtaactgcaaccgtgtgtcaaccaccttgtctcctggcatggaatcccatgaaccgacagctccgataccatattgttacgatccctcttgacctccatcaatcaacagcaaggagaagggaaatactccaattccaacacaagatatcaagtatttgagatacaacttgagggagggatagaatcatagacacaggaatcagcaatctagaatgggaagaagaagcaagagattggggaatcagagaattggagcttgaggtaggagagcatttgggaagaaaggagacaaggcatatgcctgttcattcatatgttcatccatgatccaaagaactgtagtgtggcttggttttatactccttgctgtttggttgggcctagagcctgcccaagtacatgacagaagctcactcaatcttgaggaattttttttatttttaattttttttattaaaagttttacaaaaataattttctatttcaaaatttgacaaaagtagtcgcccgcctccctctgggagggcgattcccagagggcggcaaatgtgacgtggcagacggcc

SEQ ID NO: 56593 - DNA, 427 bp, Oryza sativa
acgcataatcatttctctcgaacctcgaacatggcatggttggttgtgtagaacatcagtatgttgcttgacacaggaaacaacatgaccaacgagatcactctctcagggaagctgttgcgatccctctttgacctccatcaatcaacagcaaggagaagggaaatactccaattccaacacaagatatcaagtatttgagatacaacttgagggagggatagaatcatagacacgggaatcaacaatctagaatgggaagaagaagcaagagattggggaatcagagaattggagcttgaggtaggagagcatttgggaagaaaggagacaaggcatatgcttgttcattcatatgttcatccatgatccaaagaactgcagtgtggcttggttttatactccttgctgtttggttgggcctaga

SEQ ID NO: 56594 - DNA, 368 bp, Oryza sativa
ggacatgtggggcccacatgggtcccacgctgtctcagccgccacgtagaccaaaaccggggtcaataccgccgaaagacctcggatgaccggttttgtacagataggggaccccgcatatctggttttgcggttgagaaaatccttcactacaaatatctgagaggagctagcggaaataataaaattatggcgcaataccgaaccacgctattccgtcaaataaaacgcaccaaatgcatgcactcgaacaaatggctcagcaggatgaacaagccaacgatgggggtatcggtaatcagttctgttcaagttctggttctctctttccctctctctcaatcaaacttttctgctcgattgattct

SEQ ID NO: 56595 - DNA, 577 bp, Oryza sativa
tcctgcacccaattgccccactattcctctctcattttcgctactctgaaactctgcttttctctgttctgaatcccgctctgaatttattcgtttccctgtctgttgccgtgccggacgcgcacagtttgcatgtgtggtgttcgatccagtgcattgtcgctaacatcgatgttctcaagagtgagcttccctgagagagggatctcgttggtcatgttgtttcttgtgtcaactaacatactgatgttctacgcaaccaaccatgccatgttcgagagaaatgattatgcgtaagcttatgtactctacatgtttttatatatatatatatatatatatatatatatatatatatatatatatcagaatcaatcgagcagaaaagtttgattgagagagagggaaagagagaaccagaacttgaacagaactgattaccgatacccccatcgttggcttgttcatcctgctgagccatttgttcgagtgcatgcatttggtgcgttttatttgacggaatagcgtggttcggtattgcgccataattttattatttccgctagctcctctcaga

SEQ ID NO: 56596 - DNA, 1076 bp, Oryza sativa
  unsure (1)..(1076): unsure at all n locations
agtgactggaatccgacatgccactggccannnaccnnnnnnnnnnnnnnnnnnnnnnnnnnnnnnaatcctacctgaaatcgtgtcaaaagaaaagaaaattccaacctgacacgagtgatcgtgtgctgcagctacgagggcgtggacgtggtccggaagcgcgcctcgctcctctggaccgccgccatgatctcccgctgcgccggcgccctcgacggcgacgtgaccagggcctcccaagccgccgccgccgagccgtccggatagatctcgtggacgcagtcggcctcgacgttgaggtggctcaccctctccaagcagccgatttcttcagggtccactagaaggttgctctcgccgtccttccatcctatcagctgtagagagagccagcgagcgatggtgaattctcatttctcaatgtgcctgatgttataaaaccggccccgataacaacatcggtaaccgaacacggaatgcattggtaagctcaccttggcggcgcccgtggagttggtgcagtagagcctcgcattgtcgacgaggttgcagtagctgtggaacgcggtggcgaaccgcttgtgggacttcagctgggacttcaccctcactgctctcccggtgatcacagctcttctgacaatgtgattaaccgggtcaaattttgtgcttatacctctttgttagtacacggaaaatagtgcagttgagtcaatcgcaatgctgacataatgnaagcgtgagcagaaacagcaaagatcaagcagaatttgtttgagtaatatgaacnagcatagtatcagtaatgtagacatgtagtgaagtaggattaagttctgaagcatacctgattcccctgacaaccgcaagataggcatcacagaccacacctacgagctcgatgcgatatggcttcctgtttctcgtctcgccttcttcatctgtactggagtcctcaactggctcccagtactcctcagtgattgacccgtcctccgtgaccttgtagccaacacccatgcggtaccgttgccggtgcacagccctggccatggtgatcgtctgctggacaa

SEQ ID NO: 56597 - DNA, 1501 bp, Oryza sativa
aaaaaaatgatagtatcatttccctatttgattgttcctgcaatgtgtcaccctagaaaatttcttattttaggagttattatgattcatatatttggactcaacatatgttatttgaatataagaggtacttactaactaaaacattatatcagatgaagtaattcatagttttcattttttttattttcccaaaaatgattattcttgttctaagccctgcatgtgtgaattcttatggccttgaaaataaattgtcaactggacggttatttgtttgtgcctgtgagatattaagtttgatgcatcaagtcttgaaagagttcttacgacatatcagaagttgtcgcttgcatgcttctacataattatgtgataccgagaggcactaattttgtcttttcattgaatgagaaactgagtgaactaaaagcaactacaaaggttagatactttcatcttggatctttattaaataaccgagattattaaggttggggttgatgtgggaaagatactttagtaatttgcaatataatttgttaaaaatctagttgaccattagaaaatggtgtgaatgtatttttcatcacaaatccttttgttagttttataatttttagtagaatttagctataaaatttaatgggcggattttataatactgggtcctatgtcaactgaaatactgacaatatttttgtactgtagcctctataaatgatcacttagttatagatgagcaattttgatttctgaacaccaaatatacaaaatagtatcctataaagtatctccagaatctgcagctattcaagtcactgtctaaaatgtggatagatattgcacaccctgggataactcacttgtatacgaactttaaaatatcttcacttatgttggtgaaggaatagtaacaggctcctgggctatataaatgaacctcatgttctactttctgtaacttaggtgatcggcaacctgtgtattcatttttgggattgactcctactttaaaggcttcacttcgcctcatttttttcctgactgttcaatacttgtgaatggagtacggtaatttgcgacgtcaagcagcttccttgaaaaagagcctcttcgatcaggcttgtgctctgttcatctcaaatttcaagcattatagttgaggcatatctgagactctgcaaatatatccatcagtccttttgctatatcttcttctgctatttatcattcagcaagacatagaatacagtgttttgatggacatcaccttacagtcatgccattttaattgccataccatggattgacactattgcacacagataatgaaaacaaagctaaggagaatcagattgaagcacattatattaatataagtgggttatcgatatttctgtagagttcattccatttcgtacttatccccaccccagttagcaaagaaatgctttaaaatcaacgcctttcaccatttcggaactctcttttctggtct

SEQ ID NO: 56598 - DNA, 561 bp, Oryza sativa
atgaaaggtttgatgtgatggaaagttagaagtttggaaaaagaaaactttggtcaactttgaaaaataaactacaactacaatgaaaaagaaaatcaaaatgaactctaagattaatttttaggtggcagcggctaataagttataggacaaacgatggaagcctctaagatacttgagttgtaaaatctaaaaaaaaaagtaaagaaaaaaaagctaagtgtatttttagattctcatcaattagcaagtcaatacttcctttgttacaatataaatatacctagtgcgagatgtgttatatcttacgactataaatctgatcaagcaactatttagatttagatttatagttctacaaatacaaatctggacaaataactatatgcagattcgtaatcgtaggatatctcaagttctatcgcagatgcatttatattgagaagaaggttacttagccatctgcgcgctgagtacagcaatgcacgggccatccgctcgcggctgcgtagtacactttttacgtgcgcacgcaatgcatgccgagcttgatggaaggga

SEQ ID NO: 56599 - DNA, 303 bp, Oryza sativa
ccctcagcaatgcatacatatcatgctgctaacgatataaaaaagctgacacaacggaatccataactacatagtagagaataagaataaatacaaggccccgtttagttcccaaattttttttcccaaaaacatcatatcgaatctttaaactcatgcatatagtattaaatatagataaaaacaagaactaattgcacagttagggaggaaatcgtgagacgaatcttttgagcctaattagtctatgattagtcataagtgctacagtaatccacatgtactaatgatggcttaattagg

SEQ ID NO: 56600 - DNA, 1383 bp, Oryza sativa
  unsure (1)..(1383): unsure at all n locations
ataacaaatcccacaaaggtgtgtaaccctgtntttgtcaaacagggttgtgattgacttcattgcatcatggtcgggacaatgccgcatcattgctaagtttttgccgatctagcaaagaagcacacaaatgctgtttttctgaaggttgacgtcgatgaactgaaggtattgctgttccccaaattttatatttttatgtagtacagtagtacggttgctgtgttggttttccccttatctggctttatcctaatgaagatttatgtaacaaacagcctattgctgagcaattcagtgttgaggctatgccaacattcctgtttatgaagaagggagatgttaaagacagggttgtcggtgctatgaaggatgaactggcgagcaagcttgagctacatatggccatgtagtgttatagtggattagtactgatatcctaaataaaacgggccttcaggctctgaaaggattagtgcctctgtctgtggtggttttcatatgcttctagtatcaagcattgttcttaccgttgtctagttcatggataatgccttgcttgatccaagtttgtgctttgaatattccaacaaaataatataacctgtgttttgcatatgatggttttctttcaggtgagatatcagaatgttggatccttgagagttgtttagctttcatcatgattagtgaagaaagttgcacatcaccattgtagtaatgtggcaaaccttgttaacttgtgaaaaaaaatgaaaagagtaattcatttggagtctcatttaaattgtttcggtaacaagagtagctcatgtcatcctcaaccatctcaagccactaaaccagtactccattactgggtggtccaaccctataagatcgtgactgtaatttgcacaattgattatttgtgttgattttgaaaccaatcttctctggttaaaatttactatttgcagtcttgcttctttgcctggtcacctccatcccatgcatcatacggtatgtagtatggggcatatccttttcttcactgggtgccgtttcactggtcatttggtcggcagtcttgaagctgctcctcactgatccaggcgtaaagataagctgatctgattgatatctgccaaactcacagacagaagaaaggttttagttctaccaagtactgtactagtagttttgtgcaaccatgagagattcttgtcttccatggagtgccaccgccaagcagcagctatcttgcatcctactccacatcccatttttgttcttgcttcaatccctatctcatcaccttctcgcatggatcaaattcgataagaaatggagtaatcaagatcagtgaaagctatgggagagcttgagcttcttggccggcaa

SEQ ID NO: 56601 - DNA, 458 bp, Oryza sativa
  unsure (1)..(458): unsure at all n locations
agtgtgccgnnnnnnntttgtttcgaagacnnnnnnnnnnnnnnnnnnnnnnnnnnnnnnnnnnnnnnnnnnnnnnnnnnnnnnnnnnnnnnntaaattttcaggcttaaatttgaaattgattttagagttttttcatcaaaatttatttttcagtctttgcttttagattgctaagaacacgtatataaaagttttattcacatattatttttcatttgtaaatataccgtttggccaattgggggccggtaatttcgcacagaatagaggggcatattcgaccattcgtcacgtcaccagctaggataaagtttcgattcctctcccaacgacaatatctttgggaaggcgagccatggccaaggggagcacatagtcagaacaccgcagagcaagtgtgtgtcctgcctcgcgtgaaagataagcggcgctctgctctgctcgccgaggagaga

SEQ ID NO: 56602 - DNA, 520 bp, Oryza sativa
tgggaaaaaaactcagccttagacagtcctcaaattgcatttccgcactaggtcatgcaaccgcttcaatagcaggtaattaatttgtttttgagacggaggaattccgcctccatcttctgtgcttcatcttatcagttcttgccaacatttagattttttgaaacttgatatatttttagtttactagcaaatatattgtgctttgcaacgggatctagtaagaggggttaaacgttccattccactctactatagtatgttttcagttttttagtgtgtttcaacttttttttccatggttgttttctctatttgtgtatgttcaccggttttttgaaactttttttttggacgagtaggcggatatacaaaactctgctttcgcccttactacgttacaggaataacttggagtgaaaagcttgaaccccacacgctggtcccttgtggtggcggtacaacacaatgattaagaaatccattgagcatatgatgatcgtgcctgtgtgatcaaagc

SEQ ID NO: 56603 - DNA, 1501 bp, Oryza sativa
tattgttgccatgtgatgccatatcaaggtttcatcttctgtgcctgaactggttcccacagtgggatgtgaactacttttaaccagtaataactggtgggacccaccactccgctagaatattgaattgttttggattcccaaatttcaaactcaaaatttaaaatgagttggtgattacattattattcacagatttacttttgatgcattatttgattgcccgatctttatgctagataccttttttctccaattgtccaggatgaaaatttagttttggagaagataaatgcagagctgtgttcagaattggagaaaatgataggtacctttgactgggtaagttttttgatgctaagtgtagcttcctcatatccttatatttcttctttagatgtaaatttttttgtctgcataatttgtaggcacttatgagtcagtattactacaaggcgagatttagcaactttgcaagacaatgtgctattcaagcaagagcgagtggagttattcttgttaagcaggtcagattcatttgtcagccttaaaattggagacattcagtcagcacatgatacctagagatattttgattgcgctgctgcctgtcccatcctcttatatgcaaatgcaatattagttttttccatcctcttatatgccatcctttcatcagcacgttctgtttactacaagtgggggaatgaattataaggccattttattccctccgtgataaactccttgaaaatttgtgaggagccgcaatctttatgtttgcacaagtttgttcaatataaaacagaaagcacctgtctgccaaaacggccacaaaaatgagattccaagcctgtctgattggtctcatgtgaacagttctgaatcatgagttaaccttgtatgttatttttattgcaggctctacctatacgagaaacttggaaggaacagaaacaatccacaagtccaaaagtgtcaaagttgtcgctcgaggattgcttaggctcactacgtcgcccactacgtagaataaatgagcaatttggtagaggtgctgctcgtggtaagccgtggctacttgctgcttttgcttcaatcgcaacggctgcaacagttggcatgtccagcacacgctagagatgaaggttgatatatgtgtagttcatgctctggtagtcgttgatggggccaaagctcaacactcaatttgtttatgttgtgtccctgttcgtagaccgtcggctaaatgattgagccttaatcgaaatggtggagctgcccatttttctttatatttgggccactgtaaatcaacatacaatcattggctactgtttccgcctagaaagtttaacaaagttaaatcatctaacattaatgtattttgataatatgtttattttgtgttgaagatactactacatttttcaaaaacgaattataatatgatgaaatgaaggaagtatttcacaaaatgtgacttttggagaccccacta

SEQ ID NO: 56604 - DNA, 503 bp, Oryza sativa
tcttgcccgccaccgctcgcccaccgccgccaagccgactgctcgacgttgccgcaccgtgatgcctctgacagggcgacgccgacgccggcctccccgcgccatccaaggagctccacctctgcttccattagagcgagctccgggctcatatagccgcagggcgacgccgactatcgctagctcccctgatgccgtcttcgtcgccggcgccacgagctcgaggacacgcacgagtcagagccagcgcacgccgccgccgccgcacgactcgtggcccctcccgtcggtactattcctgccatcgccgctcctccgccgtcgtcggccaccgatgccctactccacggctccacgcctgcgacctctgctccgccagtctcctccccacccggcgcggcggcctgctcccgcgtcgcctgtcgccagccgccgcaccttcccctctccctgctcgccccgtcgacctcctcccgacccaccggcgggcctgcaagaggaga

SEQ ID NO: 56605 - DNA, 1501 bp, Oryza sativa
aggtacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaatttctgtcgatgtttcgccactgcgaaccatcggcggggtgtctcagcatcccgtcctgttgacgctcttcagcgtgccatcgcaacattctagcattccccttgttcctgaacaaacgccttagccgtgatattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaattccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgatttttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacac

SEQ ID NO: 56606 - DNA, 654 bp, Oryza sativa
ccttccttgatactccctctgtattttaatgaatgacatcgttgactttttgaccaacatttgaccattagttttattcaaaaattttgtgaaaatatgaaaatatttatatcgtgcttaaagaacatttgatgatgaatcaagtcataataaaataaatgataattgataaattttttgaataagatgaatagtaaaacgttagataaaaaatcaacggcgtcataaattaaaatacagagggagtatcaaggaaggtacgaagaaaaacacgcatacatagcggggtggagttagtacctttttcacccgtcatagcgggtgctgggatgtacataaacatgtttctttccttcctgaattgaataggtagagctcctgccgtgcgttttcaaaaaaaataataataatagtgctgattgcataacctatctatggcagggaccgatgtgccctgtttactgtcagtagccaaaccatcatgtggataaggataatgttacttttcctcctaccgtccagggccaaataaatttctctttgacaagcatgagatatgtaacgctatttattatcgcatcaaatgggaatggaaactgggatattgaaactatttcccatggaatacatatatgcatcttggctgttattagg

SEQ ID NO: 56607 - DNA, 1380 bp, Oryza sativa
gcttttggagcccgagtctggccgagaactcacgccaagatccgatccggcaaccggctaaaaacaaacgtagtacgagcagtgacgcacgcccaccccacccgcgatggtagcagctcggctaaccccttccacactccacaccagcgcaacgacggaagtgtgtgacgcggatggatgtggtagtacgctgtagcatgtactccctccctccgttcttaaaaaaaagacaaaccatgttttcgtgtccaacgtaaattaaaaagacaagtcacgtataaaatattaatcatattttatcatctaacaacaataaaaatataaattataaaaaaatttcatataagagagacagttaaaattggcaaaaaaaacccagagtttgtctcttttttttttatggagggagcacgagcgctcactgatccggtcaaataaatgtttgtgcctttgtttatcgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggaacaccaaatgtaaagatggcagaaaatggaacaccaaatgtaaagatggcttaattaacgggttgtgcatctgtaactccagaggtgctaagcgttaattatcaaccatgacgggaatgcacatgccttgccttgcgttgtggtccatattcccccggttcagtagtagaagatcacaaatttatttactgttcaaaatacacagccgatggcccccgctggagacgcacgcgtgacgcaagcggcgtgcacgcaagaaattttatgggaggagagtggtacggatgctgaagggaaaaatttctcatacgaattggcacgcttctcgaggctgccgctctgcgtgacgccatcctcccgtcgtggaacacggtttcgacagggcatggccgtcctttcgacagtgcagagcatgtactcctccgtagtagcagatccgtcgaaaacgaaaacggaaaaaaaaaaagaatgagtatctgttgcactgacccgtgggtcccactccatcgtatatgcttctaatcggcgtagctacagaggtggcaaaggagtagtagggtaccaagatactggtatactatggctgtgttgagatccaaagt

SEQ ID NO: 56608 - DNA, 375 bp, Oryza sativa
cacgcgggtgggagctcgaagccgccccccgccgcggaggaggaggagaagaccatgacggtcggccgcgccgattgccgtcgagtggaagccgctgctgatcgaggtcccctcgcaggtgatcgacggcttcaactgcgtcggcggcggtggcgacgccacggccacggccacgctcagcgagcagagcaaggaactcgaaatgctgggcaaggagaaggacgttgtgattagcatcccggcgccggtgtacgctccacggtccgtgtcggtgtcggcggcgtacgaacaagagggcgcgtatataccgtactccgtgtcgctgagcatgccggtgtcgccgtcggggttccacttctcgcagttcgggatggc

SEQ ID NO: 56609 - DNA, 951 bp, Oryza sativa
atggcaaaatcggatttttttttgagaattcatatgcgaataatccaaaggcaatactacgtttagaatgggccaaatctctactattataaaagttgaagatgtttttatcggtattttggtatgtcatccgtgtatgagtcggtttttaagttcgattgcttttggaaataaatatccgtatttgagtcggtttttaagatcgtttacttttgataatacagaagaaatctatttaaaataactcacatgctaacttgagatgattggactcctaactgcaacttatgattttctacaaatatatatatccaagcgaactctcacaatgaatttcatcttaactaaaccatataacaataataagattaaaatagacttcacccgttgcaacgcacgggcattttttctagtataactcaaaagtcaggagttgacaatttctactatgaaatgtacttcttagtcggtaacaatattttacaagcattttcacttaccttgggtggtcccgtaccagcccaggagctggattcaccactgaggcactggtcataccagatatatgtcccgttcttttctccaataagagttggatgaagattaagatttctgtggcacgcttttcaaactgttaaacggtgtatttcgtgtgaaaaatttctatatgaaagttgatctaaaatatcatattaatctatttttcaagtttgtaatagttaaaactcaatcaatcatacgttaataccacctcattttatgtaaaaataataatctccatcttcatcttcatcttccggagaaaagaacccatcattttcaactgatatcttgttggtaccaaccttgaacccccggcaccaacttgttgatgacgtcatccgccgtctccgcgcgcctcacgcatcatcaccacatccttccgcaccgacccctcactgcatgtgcaga

SEQ ID NO: 56610 - DNA, 1501 bp, Oryza sativa; identical to SEQ ID NO: 21314

SEQ ID NO: 56611 - DNA, 1501 bp, Oryza sativa
ctaatgacggattaattaggcttaataaattcgtctcgcagtttccaaacggaatctgtaatttgttttgtaatttgttttgttattagtctacgtttaatactttaaatgtgtgtccgtttatccgcatgctaaaagttttcgttcacgaactaaacagtcacagtccctagtccaaataacaaaaacacaccatgttttagaaacgtaattgacatatgggcacatgacatgtctgaattgctccaattaacttgggccacctaccatggatcagacgatggttaattacagacgcacggtagattgggcgctcgccgcgaggccgtcgctattggcctattgcctcatctagcttcctcgcacgcgtcgcatcccggccggcagccgtaagagcagtacaatagtaggctacaaaccagctgcagacatattttaaagagataaataaaaaaagagaagggcagcgggctacagatttgtagccagctgtagcacggactccaagacacagtgtgtgtatgacatgtgggaccatatattaatagtgtagtatataattattgtacgaatgagctattagattggctatagataaattggagctagtagttggctatactattgaacttgctctaagctgccgtgttttatcgcaaggcgcgcaggagctaatcaaaacattgttttcccatagctgtgatgaaaataaaagcaagaatttcactagctgagcgcatgccacaatggccgagcgctactaaccgggtaggctctccatctcgctcctattttctgtagcttcttgtcgccggtttcggcctttttttttttccaataaatttggcttctcattcttttgggcaaactatttgacaattgtaatttttaggtttggttattgggatgccggcatgttttagtgcacaatatccattttctctggatgggtttgaagtgaactgtacatcattcctcttgccactatattgtgctacctatacatggctggtaaaataaataaattgactcgtagggatttgttgatgtttcaagaataaaaggcgaactggcagattgaggcagcacctatagatttcactatttttcagttgaagttagggcctgtttagttcgcaaaagaaaaaattttagatgtcacatcggatgtttgaccgaatgtcggaaggggttttcgaacacgaatggaaaagctaatttcataactcgcctagaaaccgcgagacgaatcttttgagcctaattaatccgtcattaatacatatgggttactgtagcacttatgattaatcatgaactaattgggctcaaaagattcgtttagcgatttcctctctaactgtacaattagtttttttaatttatatttaatgcttcatgcatatgtacagagattcgatgtgatgtttttggaaaaaaaatttgggaactaaaccacagccttaataccgcaattggaggggggggaggggggggtagg

SEQ ID NO: 56612 - DNA, 1501 bp, Oryza sativa
ttggagaatttgttgatagccacaaagagatgcgtgtaaccaccgactgcccttttaaatgggcaatgatgacgtcgtcagtgatgtcggagatcttgttgcgttgttcggaaaagcgtcggatgtaatctcgaagggattctccagacttctgaacgacgttgtagagatcgaactgtgtgccggggcgttcaaaggtgccctggaagttggcgatgaagtgatcacgaagttccgcccatgatccgatcgtgccacgggatagtccgtggagccaggatcgggcggagtccgctagggccacaggtagatagtttaccatggctttgctgtctcctcctgctgcgcggattgcgagaccatagacggtgagccaagactcagggttggtggtgccgtcatacttcttgattccagttggcttaaagccggctggccaatccactcaacgcaggtcattagtgaaggcagctactccgtccacgtcgtcgtcgtagcgatctggtgaatggcggtgacctcgtgctgcacggcgctggttgatcgtgttgcaaaggtcgacgggacgctggtgaggtggagagcgaggccgttcgacccggcgctccctgtgacgttcgggaggcgagtgaacaaatcgttcgtcgtgacccctgctcctgtgactagatcctgtgccgatgatactgagggttggctgatgataatcatgagatcggaagtgagggactcggctaccagtcggggtgcgggtgcttgcggagttggctggaaccgaggcagcgatcatggtcttcgtctggttcaagatgttgacaacatgatcggcttggttgagtgcgtcttccttgaggagggtgtcgaggagagtgattgctgtaaccgcgttctgctggggggtgcgaaagaccgctgttccatcgacgtcttgttgcccaatgagctctctcgctcggcgcccagattccaaggagcgttgccgtcgatcttcagccttctttgcaattcgttcgcgatcttgttgctcacgctgtagtcgttctcgctcctgtcgctatcgctcttcctccagtcggcgacgttcagcttcttgccgtgcgcgatcttggtccgcttctcgggcttggcgatgttcctccgtttcgttgtcagccatgaatacgccgaagaagaggggcgtgtagttatcctcataactgtcgtcgaagttgtcgaggtcgccgtggtcatagtggtagccgaaatcgtcgtagtcgaggatctcggttggtcgagaactgacgccgggggagctgaggtagccatccaaatctttcgtcgagactgtcccaagaggttggagtataatgtcaacctctctggatctagattggatcggggccgaagccggagctcgcctagatcttcgagtgggagatgtcttggcagtgaagacaacggccaaatcatcaggaagtttcatcaggattgagggataggacccgtcgtcttgatccggtcg

SEQ ID NO: 56613 - DNA, 531 bp, Oryza sativa
ccacgtggtcacgtcttaacatatatactcatatttgcatgcataggcgtggttaggtgcacgaatgaaagaaagatcgtcggacgggttcgcgcgactgtctactagcgaacattcgcgtactacacctctcgggggggagggggggtggttcattatagtagccctttggtagagtattcaggccggcatcctccccttggataaagagccaccatatattgaccgttcaccattgcaataattttttttaacgattcgccgttgcaagttggcatacgtgcagcagaggacatgggtgctgctgcgctgtactgtgtattcgatagggatttggtacacacggatttggcaagagctcctgtgtacgtagctatctcgccgttgatcgctcgtatcacgttgcaactccacatggtgaacttaaaccgattggtatttgctcgcaacaaacccacgtcctacatgatcctccgcgtggcacaccacgagaaaatcggcagaaaacaccagtggccaggcgaagcgaga

SEQ ID NO: 56614 - DNA, 182 bp, Oryza sativa
gtgtgtccaattccaacataagccacccattccatagtgtccaaatgatatgagaattcccaaagtctaaagttataaaaccacctaatgttgcctaattaatcagcgaagcatctacctaaattcatactagtggaaccatgaatagagtacccactagttggggttttatttatcctagg

SEQ ID NO: 56615 - DNA, 275 bp, Oryza sativa
attttaatatgagatatgacagcatagtagggatgtcttgtatggtttattttggaaagggatagagtaagggtgtgtttagttcacgttaaaattgaaagtttgattgaaattggaacgatacgatggaaaagttaaaagtttgtgtatagaaaaattttgatgtaatagaaaagtttaaagaaaaaattcgaaactaaactcggcccaagtaacgatattacttagtatgaagtagtcggatgtttgatgccatacctttacgcgtcgacagc

SEQ ID NO: 56616 - DNA, 1346 bp, Oryza sativa
ggcctccccgcgcttcgccgccaccaccaagctgacgccgacgccggatttgtagagctcaccggccaccccgtcgcctgtcgccagccgccgaaccttctcctctccctgctggcatgcgagaggagagagagagagagagagaggagggggaggaggaagggaaaggagggaaaagagatgatgacgtggagggatatgaggggaaagaaatgtgaggccatgtaggtcccacgctaactcataatcgggatcaaaaccgtcgagggaccttctgtgacctgttttgattagttaagggatgcgaaatatctagttttgcggtttgaggataattttgtatctcgatgagaagttgagggaccttggttgtactttttccttcacatgacgagtactaagactggccctggacgataggaagtccagaatacatccttagtgtacacttgattatgggcctcgctatggattaggcatgcctggcctagcaggccactgaaaggaagcccaccgggctgacagtgcagtagttgggcttaaagcatttgtctgttaggctttttacggcatgcgagtacaacattgctcccgttttagcatttgaggttgcaagttatttgtcgttcaaccttaacccaaaagccaagactagcttattgtattttaggtcatgtttaaaattacatgatgaatttgatcattatagtggacttttaatcttcggcctgggtctatggcccaagtgacctgagactttgggtccatctctaagtcaatcgttaatatgtgtggagattatggttaccccatatctacatggcggttatattctagctggatatacggtaccaaatatagatagaatatctttatgaggactcgggttagattctaaacttgtatgtcaagaaaatacccggtatcctagtcggttacgattgtattttatctataattccatattccgttaggatagaaaatacccggtgtcctagtcggttacgattgtattttatctataattccatattccgttaggatatggactgtattttgtaaagaggactccttcccctatataaggagggtccgtgtgcctcttggggggcgattttttttttcaatttatacaatcaataacatactcggcggaatcatccccggacaggagtagggtattacttcttgaataagaatgcctgaacctgtataaaattcattgtctccaaacccatccactttcctagcttgatagccacccccttttattattgccgaaatcttgtttcgacagttggcgcgccaggtaggggtagcgtcaagttctcgccgactaagtgcga

SEQ ID NO: 56617 - DNA, 1028 bp, Oryza sativa
aatctccacagtagcccccgagaccttcgcagttgaccaaaatagtcttctcgaaacaaaaaacaataatccgagtgcttcaattcaacttgctccggcttgccgagtgctaaaatcaaagactacaaagggcgaaaataaaacatggtgcatcgagtagatgcacctaattaggtgtagcccccgactatgtgattagttgaaaaactaaacatatagtcaagaaccgagtggttttatagcgaagcacgcatggtacttactaagatacccagccgactccttctcaacttgaatatatcaaggataaaaaatacaagaagggccgagtgataaacactcaaaaggtccaaaaataaacatgtttgataggaatccgagtaaaaaatctcgtaaaataacccaccaaacaagatagaaaatcatggtaattaatgagtccaatagcctaggctgtgacccttaccataaccaaaataagcatataacatgttaaaagaatgactattaataaaccagtcatctcaaatcaacccagacagcctttgcagcctaataaagctttcaaaaacggtataacacctttctgttgggcaccttttgtttgcatcgtgttaattcttaaagaattataaaaccgcactaaaaaggattttaacagcattgggtcgcatcattgtgaacacaaattgccaaagcaaaaagtgcctaagtccctaaggatcacaacgggccacgctggaaataagactgggctgaagtactgtacaggcccaggcccattagtactcccgataccctaataataccgaagtgaaaaacgtctcttcgtcttcccgctgagactctcgccattttccccatttcttgctacagtgcaaaactgcgccgggcaaactagggttcatcaatccgctccaatccgccctcaaaaacttcacgaaatttctccccgcattcaccgctccgattccccatctttttccagccatatctcgaactaaatcagaccatccatttcacattca

SEQ ID NO: 56618 - DNA, 1430 bp, Oryza sativa
aattggatgagccggctggcagcctggtactcggaggagatgagacgtcgagactcgagacgaactgaataagtcacagatacgaaaacgaaagagaatgcaaaacaccgtggggcctcggagctcggagtcgagaatacaaagcaccatgcacgcgaaattgccgcgcggagaaagcgcgaactcgtaccgggttctggcgctctggcctcacacgaatacatgggccttctccggttgggctgattttttgaggccctggaaatttagaggccctgtacggtcgcacgggtcgcacgcccatgtgcacggccctgggttgaggcgatatatcaatgcctaagcttgttcacataaacctttagtacaaaacttccctatgttatgattgggcctattcagctgcaaggtgtagacactaaaacacagttttgttgccacggttgcttacacggagcattgtttccagacggctgtatcgcagccgaaccagcccattcatcctctttggtgcttttgtttgccttttctctctctgcccatggcgagttaacaagctccattcccttgttttccttcttagcactaaactccacaactactgtcatttcaattttccttcaatggtccaaacgatcatatgtgaaagcgtgtatggatagaagatgtgttgtaatattttgtggattaatgtatcgaaccttgagggagtacatggtttagatcttaaggagccctgatagattcaatgacaactaatcatatcctatcataacaattgaatccaatagagttatctatactctaacaaagctgctctaacaatatatcagggagaaagcaaaatgagagaagaagatgctatggactataaagcatggtttgtaaaacttgcgcggttatcatgattatcacgtacggtgatcttctcggttcttgaatccgcgataatctttgtggtaaccgtacggtttttcacgacaatcatatagttatcgcaataaccgtgtaacgctccgcttttcgtgagacgttaaaaactaattcggcaaaaatcctaattgcgaaaatttcgttccttgagtgttgagtctaagttgtgccaaagatctcaatttaaatccctcccttgtctcgataccctgttatcaaagatcgtctcctcaaaattaccatcccaatgtagtcccgaagctcgattccttctattcggaatcccctcctggaaccccatccgtgaactttgtcgaatgtccgaacccttctattcagacttctctccaaaatccttaccctcatatctcgttgaatagtcaaactcaaactcccaagttacactctctttctctgaattatccatccccttttgactcgtctccgaatattgttcccttccttgactccttcctattctcccgagaccgagtatc

SEQ ID NO: 56619 - DNA, 188 bp, Oryza sativa
aattcctgcagcccacttgattgttttttctttcctcttgataaaaaaaaagaagctgcatgatttcatcaagctcttctttctccacaggctagtaaaattctgtgttaatgccttatgcctaccacctcaaatgaagtacatgtcactgaagttaacttccacataacatttatttaccttgcaga

SEQ ID NO: 56620 - DNA, 1501 bp, Oryza sativa
aatatgaagactgtggagggctgaaaaataaagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatacgtagcatatgcggtgtgaatccctgaataacatgatccgagtgatataccgaccgctttgtaaaatatgatgagtgtaacctaaagttggttacatcattaaaaattcacatagcaaaacagctataaagaagcttgtatgttgtgaataaataaatttctaaagtattgggcatacgccatgcgcacactgctttaacagacgtgctttagtccctaaaagacacatggtttcaccacacctggaaatatatggcatatgtggtgtaaaatccgagtgaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggtcacacctgaaaatatgggctgcagacatattaggcctaggccaaaaaatatgccttcgacaccctttaaaggatgacgcatgtaacatgcttccgagtaataaatcttccgggtaatatagaccaggtgtagctcatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaataagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagatcaactaacaataaagatgaaggaacccagcgataaaattgtgtagccatggcagcaaaataatcagtcggtgacagacgaggtagatcaaaggtgatgacaaaatccaccaatca

SEQ ID NO: 56621 - DNA, 1501 bp, Oryza sativa
attgaccatgtgctgaaacgttggaaagtcgtgagctaaaggtttcactcgcaatttcgcttccgttccttttagaaaccttttgatcttcttcttatcaatgtccacatcttccggggcatatcgagccaatccgttgaagcgactcaaatactcgttgatgcaagaggatccttgcttgatatttgcaaattcttccttcttcaaatcaattatgctttcagggatgtgtgctaagcgaaaggcttctgcaaactctgtccagatgatggtactagcatctgtatgggtagcacagtagttatcccaccaatttgtggtatgtcttcttaactgatgtacggcataaaagggttttcttctacggagtgcactgcaccaaatttaatttcctttccacatctttgatccagtcattggcttcaatggtctcagttgtttgggagaaccccggtgggcgagatcttaagaattcgttcagtcttgaccgacaattatcttgaaccatatggggttgatgctcttgcgtgtgttgtcgttgcataacaactatattctgaatcattccttgtaatatctgggtttgcatggccatgagtgggcaaaagtccactgttggggggctgatttctgtactgcggcatcattagttgatccagaaacaactgcatgatcacttctcaatctgttgctcatctgctaggctaattgactgatcgggaatttctgactgagctgacccttctttagaaccagggcggttaggggcacggatctgacggatagaacaatgtgccattggcttcagagtgactgagatctgactgaaccagaaatgggataagaaaagaaggaaaacaaaaacactacatcaaaacggttttcgaaatcacagaagacataggtggtgtattccagtcggtatcccaactggtctaacacctgaacacggactaccaaacaaaactcacgcacgcactagttcaccacaactcctaccgagcgggtgacggtactagggtctgcctaccaacgagggcttaactaagactcctagaggcttgagctcacctttcttcaactgggcgtgaagacaggtttactctaggataaaggtcaaaacactcgactagcttctacttttggacacgaaaagatttttcgcaaaactagagctaaaggggacaacgacaccttagctttcacaaatagtttttttttttggtactcaaataatgccatcctattaaggggtttcgatcctagggccaactaatgctctgataccatctctgtcacaccccaatccggcaccgccgcacaacggcacctgataggagcgtgtcgtaggaaaaacggcgcgaaccgcttcctacgaaaccgcgaactcggtaccagtcccaggacatagtgctggtacccacggtgacaaatatgaatcattgcaaatccttagaataaatagaggacttatttaccttaacttaggttgcagctcaga

SEQ ID NO: 56622 - DNA, 273 bp, Oryza sativa
attaattacgcatctccggtgtggcttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttattttttattgtcaggcctgaagtgcctttgtaataatgtaaatattatcgatataataaagatgtgtcttttatatcatgtttgtgtggtgt

SEQ ID NO: 56623 - DNA, 1317 bp, Oryza sativa
atcgcccgctcgaaggggatgccgtcgatgcctgctttcctcgcagcgccgtcattgcctcccgctctccttgctacgccggcgccggcgcccgctcgtcggggaggtcgtgggtgccggatccgacagccacggtgtccccgccggccgatctggtcacccggagtcgacggcaagcggtaccacagcaggctcatcggtagtaacgagggcggtagttcttccacatcggtgagatccacagatcgatagtgacgacgtcgtttgttcttccacagcggtgagctccacacggaaagttccactctccagcactcggtttggtggtggccagaaggggattgtcacgattgagcggaacaatgtgtggatccgcatctcagtctctacatcccgacaacgcatccaacatcagccatcgacaaggtacaaaagcttgatttgttgcatgctttcttccagtaaatagcaacatatgatgttctctgtttctgctggtgatgtattgggattgggagcagattcctttgctagatcgcaaactagccgatctagaggtgtggtgccggaaattatgttagaggtgacagtggccagcgacaaggtcaacctggcggtgtagaagtctgtctcgaggacaacgcgctcattgcggccatgggtggccatcggcactgcttctccatgcaggcatgcaccaacaacactggcatccttccggcacaatgcacaaatctgtctatgcttccagctgcagctacatgtccctgcaacctgcatatttgcatagtccaggcactctgcaagattgtctgaccaaaatggaagaggtcagtgttgcaacccaccactatagtttcttgattttctattgatgcctgctgtctaatgttaacattgcaggggaaaaatatattcttttccttttcctgtaatgcacttggctaagaaaattggcggacagttaagctgctaatgcttctttgctcatgctccttgatcagaacataaatggtgagtgataaaaattgtattgtccctccatacagatattagagcagtttcccccatttttccattcatgtatggtttcgttcccccttgatcagtcaactacaggactgctcttgggtgactgaaactgatttcactttagttattttggagcaaatatttttctagaacaaattgttttactttgattatactccatcccacttctaagtaacatctcaccacactttattatgtgagcaagcatatataaaccatgtgtgcaaccgtacctctgacatgcgtgttttttcttgtctgcgg

SEQ ID NO: 56624 - DNA, 445 bp, Oryza sativa
ggagcggcggctgcctcccatgccaggggttgggccgccccaaccccctccacgctctgtctcgcgtgtgcggcttgggcgggtgctcccagcgcccacctaccacatttattaaggcagcgtcagcgcggcacatcgcatttaatgcgacgtgcaggcgcactaaccggccacttgcggccggaatgaccgatgtgacggtagccagggagacctgcgcacgcacctactgctagcaagggacgtggcctgcgcccgccctgtctaatcggctttaatgaggggctttttgccttgcatttgagctcggaccagttcttctcacaccagtccatatgagagatcaccacccaacggtgggaacgaacggccggacgtcgtcgataattaagaaggaatgacacgagcgttcgcccgtgtcgctcggcgtgatgggatgggccca

SEQ ID NO: 56625 - DNA, 446 bp, Oryza sativa
gagggaaaagaaaaagaaaaaggaaaaggattttccctggaattaaaatttgcactttagtgatttttaattggttaaaattatttccaaggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacatggtgctggtggtggtgggaggggaaggggaaggggaggtgcaggtgtaggtgctgctgctgcccctggaggtggaggtggaggtggtggtgctggtggtggtgggaggggaaggggaaggggaggtgcaggtgtaggtgctgctgatgcccctaatggaga

SEQ ID NO: 56626 - DNA, 1501 bp, Oryza sativa
attagtgggggtggagtcgagttgtggttgtgctgcttactgttgttgtgactgccaccgttgtagtcgttgtcgaagttactcgggtgatagggatggtgctgacagacgatcagggtggaaggcccacctagctgtcccgtcatgaaacgaggcttctgattgttcccctgaggaaagctgatctgagctgtctttctttttcggtctattttgttgcgttgctcttcctggcggatagccttgtccacaagcttctcaaagtcctcatagactccggagattagctggttggtcaattcatcgtcgagcccaaacaaaaacttctcctgcttctcagcatcggtgcgcacgtcgtcaggagcgtagcgcgcaaggcggttgaactcgtgcaggtactctgtaactgacatggttccttgctagagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatggtctgctgccagatgcactactgacatgagctccatcggtctgctcttcgctgcccctggcgtcgctggagtcacggggatcattccttgtcttcaccatctggaggggataggtagaaataagagaaaggaagaaaacagatggctcggaaactaatctttcttatgaaattaagtgccattatcttaatcttgattaaaacactgaaaaagaggcacacaactcctaataaaggctgtcataccactcacacatgatatcgaccgccgactaacccacaagcaacaaacctaaacaccaaaaactagcacgcaaacagactaagaagacgataaagctaagggcggcgactctgaagcttggagcggcgcttgcgatcggagaataggtctgacatctaaagagtacagagggataggaaccaacacatgctcaaaaccaaattaaataaagcaacgaatgactcaagtaacttgccgagcatgatgatttttatgcatagaacatttttcatgaacccggataaagacactaatgcgactgactaaaccatagcttaatgcataaactagttgcatggaaaatgatgcgcataaaattgccccatcgaacatagacacgacctaatgcatatc

SEQ ID NO: 56627 - DNA, 308 bp, Oryza sativa
aattcctgcagccctagtagatatttttatttagagggatttattcactaggtaaagtcctaattatacccctgaactatggagtgagtacgaagtaccccgaaaatcagatatcttttaccctcaactatcaataccggattgaaccccctcctcaaagcagctttgcaagtggtttcggtactacgtggcagtctagtcagcaattcttttattaaaaaccaatgaggctcacctatcggatctctctcctccctatctcttaatctctttcccctctcatacatttctttctcgcgcgcgtcaga

SEQ ID NO: 56628 - DNA, 1501 bp, Oryza sativa
atcgctaggttatttgattcctaacagattatgggtttacggaaatgagaccctaggtctccctaatcaacaacaaaatgtacacaactcacagcacttgcaatcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgcatttgctccagtgaccacttggcgattggcatgtctgcttccttaacaggtactacagtttgtaacaggcaataactttcttacgctcgggttcttcatcttgtacttgatttctttggctgctgtgctggaacatccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttggttcctctgtcctggcactggagttaggctgaaactgtaatcttggcgaggatttgtgttgccttgatgcttctctccgttggaactggcgggttggttggccatcttcttcgtcagcagaaaactggattgacaatcttttggtacatgatcagttccttcacaaaagaaacaagtgatcctgctcgttggacacctgtcgggtggatggtcttcctcacaatgaaggcagagtgtgagacacatgctagcaacgtgtccaatttctccacaacgggtgcatgcctttgattccatctcttcctcgccgagatgtcggggagactcatcttcatcatccgaggagacttgatcagatactctgccaccatggcttaggaggtgctgggtcaaccgtcgtgcacctcggaaggtatttcctctttgacgtctaggaatagttatccctgctggaggccattcggcgctggtaatagtcatcttacgtacttcttctttagttcgcatcggcgcttttctcttctgactcttactcttcttgcctttggcttgcttagtacgtgaccccacgtggtacgaaaggctaggaggaaagcaattctcgggattcaatggattctctccattgggctctctaccttgcacactaggctgcaagcttgacttggtgcgaggaggcgggtttagcgatgtctgccctgctaaaccaaaggaaggggcttctttggcatatacccatggacaattcagggcatagtgtccttgctctctacaatcatgacaaaaggg

SEQ ID NO: 56629 - DNA, 1501 bp, Oryza sativa; identical to SEQ ID NO: 22663

SEQ ID NO: 56630 - DNA, 1501 bp, Oryza sativa
tatgtatttttctcatcttcttcagaagaaaatttatcgactacactaatggtaatgggtgacactctgtttgggtctactgtggaatttattgttttgatgataggcttcatttgtcacaaattattttcttgttctctgcatttgactgccgccgttttgttcctttattggcattttgtttttttgatctgttctgtcaagctatttgttattcatgttctgtgttaggtcatgatttggtagcctaggcccttacgaccaaatccttacattcagttaaccttcagattttcatcggtatcctataaaactgggcatatatactttcatttcttacgtactacttagcgattagagatggcagaacacgattgtagcacgtacagtctagcatttcctagttctctcttttgtcttggggaaggtggtctcaatgaaaaatatcgttctatttttttgtttgttcctatgaaacaagatcttggtgacggtgcatccaacgcaatgcaatacgggtccattggatcttctatgatagccaaaaatgtagttatttgagtaaatttcacaaaaaccccaggttttgtgacacttataacacaaaacatcatgcattacaatttgtgatgaagaaccgtaggttttggggaaaaatgttccacgaaatctcatgtttaagcttatattgttatttgtctaatatatttatgcatattaattgcaaaaaaataacgagatattagtgagtatatatatgcatgtttgcctcatttttacaagcattattatggtaatatgattaatgtttatctatataagtaaaccggttaatatgtcattattagtatggttgtgtttattcaatcgtacaatgcaaaagtaaggaaaaatatgaagtacacgggatggttatgtattttgagcataccaatgcaaacatatactaaaaatattatatataataatagaattatcagtatgtgatataaacatggggtttcttgaaatgctatacctcaaaacctgggtttccttgaaacaaatcgtaatatctgaggttttgtgttacacgtgcctcaaaacctgtggtcttctaaaatttaatctagttatttttgtttttatattttttcttaaaaatatttttatgtgcaaatatagtttgtctatttcttgctgatgtagtcatgatacaaatgtatcgtatttgaataagcctaatttttaaaacgggtcacttcactattatatgtatagtagtagtcttataggcctaatggtcttatattgaaccaatatgtctttttgttccacttaagagcataaaagaaagactgggatcttaggaggctagcatgctaataagtacccatatgacatcctaacgtgcattttgtaagtgattgaatcacgtcatgttacatagctttagccaattcatcttcagcaacatgtggaaattgtaataacaaaaatattttgttaagatggatttagc

SEQ ID NO: 56631 - DNA, 1501 bp, Oryza sativa
  unsure (1)..(1501): unsure at all n locations
gtttgtccaaaatttgaaggaagctattggtacccctacaggttcgtattttttcttacatctttcatctttcatccttcatgttgcatttgcatattattccagttgctaactacaattttgtaccattgtaggtttggttattagtacagatgcaggcaaaggaatagagggggctgtagatgatgtatatccaggagtggaacatagggaatgtatgagacacttgtggaagaacatgaagaagaagtaccatggtcctctgtttgcccaaaatatgtgggcagctgctaagagcttcacaaatgtgaagttcacctaccacatggacaagataaaggagaggtgccctgaagccctaacctggttagatgacaatcatccatacatttggagcagaagcaagttttatgaggagtgcaaggtagattacatcaataacaacctctctgaatgtttcaatagttgggtctcaaaaatcaaggatcgtcagattgttgacttgcatgacaccataagaaagatgatcattagcaagtttgtgtcaagagccaagcttgcttgtaaaatggatgaaaggataatcccatctattactaacactctgaatgcaaaaagcaagaccctcaaaaaccatgaggtattgatatgtgggtctggaactgttgaagtaactgtgggcaccattacacatgcagtaaatttgaaggaaaggacatgtacttgtagggcttggcaagtgagtggaaagccttgtgatcatgctttggctttcattgcaaagcttaatagggaggtacaaatggatgattttgtggataagtgcttctctatagagatgttgaaaatggcttatgcaggacagttcaatccaatggcatctaaggatgagtgggcacatgttgatctangctataaaatcaagaagcctaggttgagaaggaaacctggaagaccaagagtggctaggataagagcttctgatgaggctagcactagtaaaaggaaaaaatgcagtgaatgtcatgagcttggccatacagcgaagcattgccagggaggtctcacagcaagtcaaaagaggaagctctcatcttcacaaagtggaacaggagaggggatcaatgacccaagtgatgcacccacatcagtgtgaatcattcattgctactagcatttttccttgtttttaactaatccaatgctgattttgtttattttgtcattgctaattttttgcattacttagtgctagtgcaagtggaactacaaggggaaggggaaggggaaggggaggtgcaggtgtaggtgctgctgctgcccctaatggaggtggaggtggaggtgctggtgtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaa

SEQ ID NO: 56632 - DNA, 456 bp, Oryza sativa
actagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatacgcacgaaacacttagcatatacatgactattttagtcttagcatgtaatattatttgagttttattataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 56633 - DNA, 1501 bp, Oryza sativa
tcccagcttggttgaggcagggctgtgccgtcaaatttgtatgccctgtacaatgctctaagtgagacctaaatcaagtaccaaatatagctaaaataagggataatttcgtttttgcccccattttcatctctaatattgattttgcccctactttttggggttttcgtttttgcccccactttttttttgaactgaaagagatgtttgcccctgttttggatggaggttagtgggactgaatttatggaagaaaataaagaatttttgatttagtgaactacctttttacccctgtgaaatgtttcccaggagtgaaccgaggctgcagcaggttcatggaccaaccccgcgcttggcccctgagggccaaggagaagacgttcgccatgacccggtcgccaccctccgccgcctctatgatcgccgtgcagatctggagggactcggaggggtcggcgccatcatcgtacttctcggtgaggcagggctggagctttgggggtcctcggacattccgaagactcgccacaaagacatggtagccaagcttacctggtggggatgtggggggccttgccccctgcctggggtggcgcgacactcctgaggatgctgcgccttcccccgtagcggcggtgcgacactcaccacgccggcgctcgaaagaacctcaaaaatcacaacacgtcccctacctggcgtgccagaggtgtcggagaatgaactcctccaccagggaaccgtgaggcccccctttgtgagttcggccgggggcagcgggtgagattcgagggcttggtgagcggagctgtgtggtcttgatggggttaggccactccaagacgatcagaccaaagaggtttatacaggttcgggccactaagaagcgtaaaaccctactcctatgcatgattgattgaatgtagaacaccagtgcttggggttgcgagacccaagcgccagttcgctcggaagtccccccctccaccactaggcctggacctccttttatacctcaaggggttaccacatgggcccaacaacctaacctagctccggtggagaagtattataatctttgcattaaatgcatgtcttgtctcctgacttgggaagccaagcacacgtcgtcttgatgatggggcctgtcaaatcttgccgcctgacacggggggtgcccctgtcagtcaccatttaatgggtgaagacttctgagctcctattacaccgggaaacgggagccttgctttgaccagagcgggaggaccgactccggttgggataagaggatgagaacctctcaccatcattatttgatgggatatgtcgggctgcacgtcgcctgacacacgcgatggtgcgcctgacatcttgggtcccatcagtcattcgaccggtcacagaccggttgagtgcgactgcacaccgcattaaatgcggtgtggcgcgaccgctcaggacgccataaatgcgggtaggtgggcacctggaggcggac

SEQ ID NO: 56634 - DNA, 1501 bp, Oryza sativa; identical to SEQ ID NO: 46710

SEQ ID NO: 56635 - DNA, 1501 bp, Oryza sativa
cgcatgggcgtggctcatctggggaagcggatcctctgactttgggttgcaaagtcacaggcgtgcagttctgctctatccaccgttcgttatcatccgacgatccaaaatcgtccccccagttcctttcttcttcctctgtttccttgctcctatttctgcgtagcttcacggttggccgccatggctgtcactcttggccaacaaagcacacaatttctgccgctcaaaaggtgtagacatgttgttgaaaattttcttttaaggctacagcttctgtcttagtcagattgttgttgcaacaagaaaaatggcattcgattattgttgaagcttctccctttgcatgatcttacccaaagtctaagaccactgaatttgaacatcactttctccagtgaaggactatcatcagtacttaacgagctgacatttcaacgacgcacctggtatcgtgtccccatatcatcaccaagctctattcgcgcaatgatgcggggatgcgtggggtacgaggctaaaagattgccctatagcaagccccttttcgttttctgcatcggccatgatgcgattgaagtttgttgaaagccgacaatggcaaccggccatgaagctatgcaacgaagggagcaaggaacggaggaagaagaaagaaattaggagaatgagtttaaaccgtctgatgataatggacggtggatagaatggaacttcacgctcatgactttgatatgcaaagtcagaggatccgcgtccgctcatctgtcatctcgttcttctcacgtcaggaatctccagagggacccacccggccatccacgtgactagttgtacattttcttaattcccttatcctttgtctgccgtacgccgctgattttttgttacccctaaaaagtctcctttccaagttctatttggactgagactgttacgtgggccccatcgacatggttggcttggaagtacacttccgatcgtataatgaacgtcaacgtgtgcaataaaagatatcttgttgattttgttttggagtgttttcttgttaattggatcacgccgcaccgcacttgtccgtgttggcctcccaaaaatccgttataaattatcttttatctttagaaaaatcactcacctcaaaagataatttataaccaaaagaccaaaaaccaatcgcacaattgtcaagccaaccaccccagatctacttacgacaaacacccaatccaggccgtccattcccaaacaagagcggatctgagccgtacaaatcctgagtgcggatccgcttatggcgcaaaggcgaagggtactcgaggctaccggttaaaacgcccaagtcagtggctctcgtcctcctttctcctacgcggccggagagaggaggggggaagagaggatctcgcagagcgccatagcctcggatccagaagcggaattcggtggaggtctcgggcacctggatcgatcggaggaagggaaggcggagcagcggtga

SEQ ID NO: 56636 - DNA, 1501 bp, Oryza sativa
ggcccactgccaaagtgccggttcggtccggtgtggattgaaatcctattcctcaagttaggctgtgtttagttcacaacaaaaatagaagtttggtgaaattgaaacgatgtgacgtaaaagttggaagtttatgtgtgtaggaaagttttgatgtgatggaaaagttggaagtttgaagaactattttggaactaaacacggccttagatacatgaccccactgtcccacatgtcagagatcacgtgtgcgtcaggcacagccaaccagaccgtatgaccaacgcgcgtacggcatgttcccgcactaccacttgacgtggcgcatcgccaccatcgtgttcagtgtacccggactcggccgacgtccgaccaggagctagcactactatgaaaagcatttttcctggcgaccaaaattggtttttcgctagcggttttgctagccgcttgtaaccaaaggccagtgataatgattttcactagcgcaacacgcccgctagagaaaacggattttggttggcggtccctttagaggcaccactagcgaagatctgattaattattacatccgttagcctaagaggcccgctagtgaaaaccctttttcccaaacaaaaaaaaaagaaacaagggatccaaatcccagcttcaaactcaaaaaattctgggattggatccaaatcttagacagatttcccaagcttatgcacacaatcaaccatttcatccacaatacaaattcatatattatagattcccaagttcatctacaagaaatccacaatatacaaattgaaagcaacaaatcaacaaattgtagacggcaaccggcgtgcaggtacggcgaggtcgacgggcaccatcaacaaccgccgtcatcgtcgtcgtaggctcgccgtcgccgccgtcccagcactgctgctgcccgccgccaccaccctcccccctccctccttcggctggatctgttaggggaagggaggggagccgctgccaccctcctccctccctccttcggctagatctgggagggtaggggaggggagccgccgccatcccccctccctccttcggttggacctgagaggagaggggagccgaattgatgattgaatttctcggtctcggtctttcgatttggattttttctgtccactcctagccgtaaaccagcacgccgtacgttggctcgagaggattgtgagattgtcacgccggcaccggcgagcgcggcgtggagcgtgacggggccgaggacggcggaaattttaatttcctgtacgtggactggccggatgacgatgcgacaaagcacgttgaaaaagcggaacattacagttgctttgaaaaagagaatctaattgggcctgggccatctgacagccaaaaggtacgtgacgcttcccgaaaaaggagtccactcgtggcccatgttccaatgacctgcagttttacgttttttaccgtccatactcgacgcgacgcgaggcgaggtcaa

SEQ ID NO: 56637 - DNA, 237 bp, Oryza sativa
atgtcgcgccgcctgggagccagcgtcttcttcggtggcgcccatcctttcgctcccggatactgcatcttcggtgggccaattgtcgactcaggtggctggctgcacggtccgtcgtctgaccccgtcggagattgatgaacgccgacgcaaggtcttatgcatcaactgcgacgagacctactcacgcggccacaacaaggtttgcaaatgcctcttccttcttgatttggctta

SEQ ID NO: 56638 - DNA, 956 bp, Oryza sativa
tgcgtgggcttcctttccagttttaagttaaagtcacccccacatatttccagtaataaaagttacatacataaataagattcccacgcaaaagcatgggctaccttcctggataactaactatatctataagttttgaacttataatacttctgaaattttgaacttctgtaaattgaagcgaattttgaacttctgtaaattgaagcggtgactaattatatcaattatatcttatctgcaggtatttgagagagtcataaagatgtagaaaactctagaatcaagttagcgaaggaactatcaactaagtcaggttctatgacttttgactttgatgttatggtgtgattgggatttgtaatatcatgcagtaccacacatttatcacagttacgccgtaaccttctgagttttataccagtcaccgcaatatcgtgaaaaccctgggtgtgatgttatatactcctttgatatctcgctacatgttttttccaaacctatttaagcaatactaaattcccaattatgttgctttggttataagcgtggtcttaaaaatacaatgttgaccactaatgtcaatcatagcatgtttatttgatcgatctgaaaaacttataactcctaaccgaacttacacatgggaattttttgtatatacgtaatttaagtagataaaccgaactgaaatacctatgttcaaaggtttagagctttatctaacacatacctaatatgatattaaggataagagcagatggctttgatatagagagaacgccataacaatcagcacacctgcacatcagaagatagtttagtgtgaagtgcagtggaaaatagctcaaacaaaatcaacccgcacagaatcatgtgtaattttaaaatactaggacaaatcaattaagcatccaattgtggcgtacctttactatttcattaacttattaaaa

SEQ ID NO: 56639 - DNA, 1501 bp, Oryza sativa
ataataggggaatccacaatacgttacaacatcttcaacctttcaagcacatcgattcaggggaattacatcacatatgagcatggcaagaaagccatgctaaatccatcttaacaaaatatttttgttattacaatttccacatgttgctgaagatgaattggctaaagctatgtaacatgacgtgattcaatcacttacaaaatgcacgttaggatgtcatatgggtacttattagcatgctagcctcctaagatcccagtctttcttttatgctcttaagtggaacaaaaagacatattggttcaatataagaccattaggcctataagactactactatacatataatagtgaagtgacccgttttaaaaattaggcttattcaaatacgatacatttgtatcatgactacatcagcaagaaatagacaaactatatttgcacataaaaatatttttaagaaaaaatataaaaacaaaaataactagattaaattttagaagaccacaggttttgaggcacgtgtaacacaaaacctcagatattacgatttgtttcaaggaaacccaggttttgaggtatagcatttcaagaaaccccatgtttatatcacatactgataattctattattatatataatatttttagtatatgtttgcattggtatgctcaaaatacataaccatcccgtgtacttcatatttttccttacttttgcattgtacgattgaataaacacaaccatactaataatgacatattaaccggtttacttatatagataaacattaatcatattaccataataatgcttgtaaaaatgaggcaaacatgcatatatatactcactaatatctcgttatttttttgcaattaatatgcataaatatattagacaaataacaatataagcttaaacatgagatttcgtggaacatttttccccaaaacctacggttcttcatcacaaattgtaatgcatgatgttttgtgttataagtgtcacaaaacctggggtttttgtgaaatttactcaaataactacatttttggctatcatagaagatccaatggacccgtattgcattgcgttggatgcaccgtcaccaagatcttgtttcataggaacaaacaaaaaaatagaacgatatttttcattgagaccaccttccccaagacaaaagagagaactaggaaatgctagactgtacgtgctacaatcgtgttctgccatctctaatcgctaagtagtacgtaagaaatgaaagtatatatgcccagttttataggataccgatgaaaatctgaaggttaactgaatgtaaggatttggtcgtaagggcctaggctaccaaatcatgacctaacacagaacatgaataacaaatagcttgacagaacagatcaaaaaaacaaaatgccaataaaggaacaaaacggcggcagtcaaatgcagagaacaagaaaataatttgtgacaaatgaagcctatcatc

SEQ ID NO: 56640 - DNA, 1501 bp, Oryza sativa
acgacattgcaagaatgaaaactatttaatagtttttgagctaggattgtcctaaatgtgcccactatagaatagcttatttgcgagtagtaagagtgatcctcgttgaacgaacacatctcctaagaaactaataaattatgagtactatgctaccgaccatttttagacgaacgcatcaaagagcatgtataatgagaaaaaataattataccccggatgaaatagcggaactctctataaaacacgcatttaaacaaatttattacatatattttataaaacgaatcaaaattcaattgccagcgaaatcaacccagatactatagtccggtctctctgtcccccagtattccattgttggtgttccgcatcctaattcataagaccaaatgttcgtaatacttgcatcaagggtatttgagtaggacgatgactttggtacaaaggccatttccccttcgcgagtgacaagatcaacatgaattgtctcaggccaattgtagaacctcgggaggaaaactttgttctccatccacttaaatttgggcttctttattatcgttgtcagcgacccagtgaacactacttgaccatgcaggctctccaccttctcccactccattgtttcctcattaagcttcaaaacatggaccgccttcccacggcgttcaatgagtacaaccatcaacccatattggctggaccggagcaagtagctatcttcacatttgaacccaaagccgtcaggcttgtcaagaatctcaaatccattgtcatgcctgcaaggatcatagaccagcaacctcccatcttgagctagaagatatagcaagccgttatggaggaccgggttggtgtccggtgatacccgaatacgtggcaagtcagggtgatattccgtcaacttccaatcctcccactcaccactgctgtttcggatagagctagcaaccttaatggtaagaatcgcctcgacaccaaatagcctctcatcaccgtcagagacaacaaaattgaataatgcatgaggttttggtggcaacacttcaacaagggcgccagtgacgaggtcaatatcaaacaccaaggactggtccacgcacatactcagatgtcgtccggtggagcaacagatcttcgcgccgggcaccttgagcagtccatcgacctcgaaattcttgtcgtagtaagggctatagtaccggatgttggcggtgccaacgccggcggtgctgaggaggagcggggtgatccacgctgggtagaaggacgacagcgacacggcggagcgccattgccggcacaccaatgcggcgtttgggtggctcgaccaccgcagactccccaggatccggacgagcacgtccgtcgggagagacgaccagccccggacccgcgacgtcgacgcgacggcctccatctaggttgctctcgccactactatatgcacgtgaccggtgttttctgccgcttttctcgtggtgggtcgcgtgccggc

SEQ ID NO: 56641 - DNA, 1501 bp, Oryza sativa
tccctgcggccgacggagatgtcgccgctggtggcggaggagggaggacgcgatccagacgacgatggacgcgagcacctggtagtccgggaggaggtagtacgccgcggcgaggagcgccatggccgcagcggcgtaggcggcggcgtgggggagggagcgggatggttggctgcagtcctggacagggcacatcaacgggagccacgtgaacaagaccaccgcgacgagcagccacctcaacgacgcggccagtagcgcgaccacggaggacgacgaggtggacacggaggaccacagtgggcatgcgcggccgccgccgttctcccccgccgcccctgcctgcttcgcccgccgctctcgcccgccacccagtggcgaagccaggatttagagatggggggtgccatctacgagacatggtaattcacctaaggttcagtgaacagtgattttgtagtgttgatgcatgatcggtaactcgatatcatacatgttacagcgattagctacaagagataacaagaacccatatatcatgattcgccaatttaaaattcagtaatatttttaatatatggatgattgaacagtttgttccattaattggagtcttgcaatcacttctaaaatgataaatcagttagctaagtcatttcagaagtcagttgtcctatatcctatatagttagtctcatctgtaactaatgatataattaatagctaaattataagtgctaatcatccttgggagaagagaggggaggggaggtcacataggggttaggggggtgttggccctccctggcccctacgatggcttcgccactgccgccacccctacctgcttcgccagccgccaacgcgttcgcctgccaccgccatccctgcttgcttcgcccgccgccacagcgctcgcctacccccgccgctcatgcctgcttcgcctgccgccgccgtgcgccgtgctcgcccgctgccgccgccgctctcgccggccgtcgccccgcttgtctcggcctatcgaagaagacgagagaagagaagaaaataaaggagaaaagagaagaaaggggaagaaagaagggatgtggggcccacatcgttttctctcacttacatgtgggctccacgtactttatttatttatttttgctgactaggatgccacgtcagcgaaacctcccacacatactgtcataggactttgtgtgcacggtttgtgtaagttaggggtgcgcatttctggttttgtggttaagggatctcaaaaaatctcaagagtaaaatacaccgctggtccttaaacttgaagcgtggtgtcacttagatccatgatcttgtaaaatcgacattaaggtccatgaacttgtttaaatgaatcattgcggtccaaagcacatttgacaggattgaccgtcctacgtggctgtacagcgtggccccatatttgcacttaagcccctacacacctgatccaaccctccactactgctgttga

SEQ ID NO: 56642 - DNA, 327 bp, Oryza sativa
attattaaaacaaagtcatatagcaaaataaccaaaacaaaagagggcgccaccacctccaccgcggcacctcgcgccggtccgacgcctcccctcccgggtgaatctgccgcggctgcctccaccgatgttgggtgttgacggtcgttatcgatcagtttcgaccgtcaatattaccaaaatagaggagaactagtgatgcttgccatgcatatatatgttagaataataatattccactagtattaggtttactaaccttggcagagaatgaccataaagtggacgaaaatcgacatcaacacagaaaataaatcaatcggacga

SEQ ID NO: 56643 - DNA, 1501 bp, Oryza sativa
tacctatgcgtgaaactacgtgtgcatgtcacacaccaagtggtcaaccatgggaggacctaattgccttgtactttcatgcatgacgaaggtgatggtcgaggatttgctgcatgggccatggaattgcactagccagatgtagttaggtgcctgacaggagcaacagtgtcaccacaccggcctccgctcactctgctttgcacgctgacatcaatgcctgaactgctggtcggtggtcaagaccgccaattgatccctagctagcgaatgtgcctaccttggtgtcatcgctggcgccgtagttcttgacattgaacgttgggttaccgtggtacatcgccttagccaatgtcgacgacatgttggtggcggaatatagcgtagcagcaacgatgacgaccaaccgttgctgcgtctccatattcatagctagccctctccacagctcacatctgtgcggcggacatgagagagaaattaggggatcgatggggtttccaaaaatgaagacgtgtttccgtctttgagcgatggggatgtgtgatggagtagccatagtcaatgcgatcttaggtgcaagcgcgatttggcggggacagaatcatggataagttgtgtgcagtggctgatgggaggagggaatgatccagagcgttgtacctggtgttggtgtgaataatattgggcgttggatttgatgaatgaagtatttagtagtagaaggacttgagttggccaactatccggtaataaatactacctctgttatataatagatgacgctgttgactttttgtcatatttttgaccattcgttttattaaaaaaattacgtaattataattattttattgtgagttgttttattactcaaagtatttaagtatcatttatattttatacatttgaataaaacttttgaataagacaaatggtcaaacatgtgttcaaaattcaacgcgtcatctattaaaaaaagaatgtatgggactacctatacatttgtcgacaaatttttccctaaaaatttgacagatgtaattatagtacaatcgtagtgtaattacactgtaacttatatgtaattacactgtaacttgcatgtaactacagtgtaacttatatgtaagtttcacataattttgaatcgttggatctattacaagatttgttttggtgaggaagaaaacaaatcatagcacacacatatgtgaaagaatttgttcccacgacctccattttaccgaaataacatgtaacggagagatttttgaaagttacatacaagttacactatagttacagtgtaattacatgcaagttacagtgtaattacagtacgattgtactgtaattacatctgtcaaattttgggggaaaaatttgtcgacaaatatatagcaaaatcgaaccagaaataacaaaacgagcaaaaagaaggaaaacaacttccttccttccctcctccctcccttctccaacctgaagacctgaccgc

SEQ ID NO: 56644 - DNA, 1501 bp, Oryza sativa
aatctctatgttgaactcgaggaaacaatttgatttgaggaagcaaatgcaaaagcaggtcccaaattaatttaacgttattttgaggagttatattatgtcgtcagacatttgccacattataaactctacaggatgctactgagccatcatatatcagtaggtctactgatgcagattatactctggactctgcatattatacgcggctttactgaagtgaaacgaattaagtaccacttagggactgtctagtaccatcctgctgaaattttttgagatatcagctggacttttgaccataggatatgacacgtgtcatcatctcccacctcctccccgcgtgctgtgcgtgcatcaagcacccctgccaaaaggtttgttgggtcgaacatgggcttctgtccctttttgtgcttttgttgttcaaagcccagaaaaaaaatacatgggatccattcgttcaacaaattaaagctgttgctacagaaatcaaaacatcattttccccaagaattagcgaaactgcagggtggattgcaaggtgcaaacaacactcatctgaatatgttctgcctgctctcaggctgtgcagtccggccgacctcatcaaccccgacaggcccccagccattcagtgctgacatatcgtggcagatgacatcaggatcctctcatggccatggccattgcaatggatctcactgtcccccattgatgaaggcgctcatgcttcttgttgttgtgacactaattcttcttgcggtgactgcgaatggcctcttcatgttctcgtggcaccgatggcacaaagagaagggccacaggctcgccggtgatggtggccgatgcagcacagaggctgcaaggagtcgttcccttcaaaaatcagtgacaaaaaaaaacattgcattagacattgcacgagtccaatctaagataatgaaagtctgaaacaatcaatctaaagaagctcgcatgcttcatttagctggtggaaggagattgcataacacattaacagatgacaagagtcccaaatccctcatcatcttctaatagattgtctagctaaagataaattgagccctctatagatgtagtaatttatgttcagagactcggcggatgaagattgatagattgcagacttggcaaaaatgcagcatagcaatgatagaacttgttatagcctcattttattgggttgactaagcagctatctatgcctacatgccatcaacagatctatcagacaaatcaagtgatcttaactgtatacaagacaagaattttgaaatgccggcaaaagaagtatttttagttggatatacaatgtgtgtgaaacctacaaggaagaggagactaaccttgatgtttggcctcaaagggttgaaccatctctctctgcattgttttcctactcttccaggcagcaacccccctatctgagatcacttcttcagtccaaattggtcaactcaatttcaccagcttccta

SEQ ID NO: 56645 - DNA, 1501 bp, Oryza sativa
taacgattagtccttcaaaaggtaccagaaggtaccattatagtgtaaaatttagcatctttcgatacctttggtactagaaggtaccaaatttgtactaaaaattttgataccttttagaacgtctcaaggattgtaaaatttctcgattataataggacacacacgataaaaaaaatcacatcttaatggaaactcacttgctaccgttagtatagcttcatgaagaaaaagtttcagagaaacaacacaaaaaggttgcagataagtattctagtcaccttcttcaactacattcccttgcaccacttctgtataaatgcaaagaaatcaatgaaagcacttgtgaatcatgatttaacgtctggatgaaaaacatgagaacgttgtgtagcttagttggcagggagctgccgggagctagtcaatcaacggcctgggttcgaatacacccaggtgctcaccatctcctttcttgaaaacattgatactaagatcctccttagtcgagatatagggccagaagtttcacctttggtccgtttacacaaatttcatcactaccaataattagtcccatcaaagaatttatgttttgaccaaaccgattcaaacatttgatcaatgcggttcattggtaaaattcagaatttgaacacaagatggttcaattctgaacacaagggtggaaatttcaacttcagtccaaacagcacacacaaatttcaacagtacctgttagcgacatgaaagaattgttctgttttgactaaacaggttcaaacatttgcatcaacgaggttcatggctaaaattagaattcttaacacaagttagtagcagaaagatggtttaattatgaatgaaaatggcatgcgtgttctccggctataattttgtaaaacttattgataaaactatatgctatgagactacaaatgacctgaaatattctgcgctgaagtgatcaacgacgacttttagtcatcccatttggtaagcggtactgttccagtgattattgtggaagagggagttcatttatatcttatcgtgtagaacagctttgatactcttttatcctgtgctctgctatagatatatcccaaaatatccaatttgcgattaatcaatcccaacaatttcatggcaaaactgtataaatggatgaataaaatcttgctagtagggaaaaaaaatggctatggtaggaataagtttgcacgccgatgccaaaacgtacacctacacgccgccattggcaccaccatatgtaataggctatcccaaaatatcataggtaaggattaagccctagagttgcatagcaaactaaactgtgtgaaatgggtgagtaaaattttgctaaggaaaaagctgtccacggtatttggtcaaggttgtaaaatcaaagtgtatttaattcttattctgtgaacaattagcatctgagattattagttttgatatttggagattattggcgaagtggtttttgaga

SEQ ID NO: 56646 - DNA, 1501 bp, Oryza sativa
agacgttctaaaaggtatcaaaatttttagtacaaatttggtaccttctagtaccaaaggtatcgaaagatgctaaattttacactataatggtaccttctggtaccttttgaaggactaatcgttataatcaagatatggagctgaaataggatactatagtcaatttacttttataacttattctagtactccctccgtattttaatgtatgacgccgttgactttttaaccgacattttgaccactcgtcttattaaaatacggagggagtaagtattaatatagttattgctgattattcttgcttatttatttagaaaacacttccaccttattgttacctataagtgcctatataacatggacaattttcctacccaaattttcactcgtccatttcacacagttttgctatgaaattgttgggcttaatgagctcacattggaaatttgggatagcacggttactattatgcacctgcaccagtagatgcagatgatctgtcactacagggacagtgacgttgcccccatttgtgacgactggcaaatcgtcgatcgtttcagcgcagagtagtcttaggaaatcacatccatcaatagcgttgtcaatccttcgatgaaacgatcgttgtcatttaaccggaatcatttatatcgcagtagaagcaggcccgggcgccgggctaccagaacaagtataattccttgtgtactcatccagctttcaatactacataaaacattattgaaagtctgaaacacaagtataataagaccttgtttagatccaaaaaattttggtcaaaaacatcatatcaaatctttaaacacatgtataggacattaaatatgaaaaaaaacccattgcacagtttgcgtgtaaattgcgaggcgaatcttttgagtctaattacgccatgatttggcaatgtggtgctacagtaaatatttgctaatgacggattaattaggcttaataaatttgtctcgcagtttacaggaggaatctataatttgttttgttattagtctacgttttatacttcaaatgtgcgtctatatatttcaaaaactttacacccaaagaactaaacacaccctaagtttggcccgaggtggatacgggacgcttgtatagtgatggtgtttctctttgcaattcaattttgcgtggctcatacacattgtttagatggtaatcagatcgagagatgctagtccaactcaattatttgtggagtgaataagatggcaaaaaacattgacttgttcaggagcaacccttgcgtacacacctgactgcttgtctgaatgcaaattcaaagtaattgtgtaggggcctacctgttgcagattcaagtgtcgttgcgcttataaaagcttacaacattcactccctctcactaaactgtggcatgttctctagccgcttgtgatactcgcaatcctaaaccacgagagaaaacattgcccctatagcagaagggtagatcga

SEQ ID NO: 56647 - DNA, 206 bp, Oryza sativa
atgaaggatccatgttaagagtgcaagtgctgtgagttgtgcacattttgttgttgattagggagacctagggtctcatttccgtaaacccataatctgttaggaatcaaatagcctagcgattgatggcgaagaaaatcaagtgatcaaccaaagaggcatttgtttggactaagagtttcagatgtgtctcttcggatcaaagg

SEQ ID NO: 56648 - DNA, 1216 bp, Oryza sativa
attcctgcagccctcttcctatccaaagcaggtgtgtacaagtcgctttgcattacattatctagcaaaaaatgacactttgcaaacaaagtcgtagattaatgcactactgtctactgcaatatctgtcaagattctgaagcctgaagaaatcactaggtatacacagtatatcctgtcagattcttgcttggtttgttcttttccccatttataatgggatggaatatgacaagtaaaacacacactatacgagtttctaaacgctacttcctccgactcgaaatgtaagcatttttagattgacacatgtattaaaaaagtatgtgagaatgatagaaaaaatgttatgcttagttaaaaagagaaagtagatgaaggagatggttgtgattagttgagaggaggagataggtggaaaaatagtttcattttaagataagctactgtactaaaaataactaaattttgaaatggaggtagtacgattttttaaaaaactttctacatatatttttaaaatattatttcaaatctatttttaaactctatagtagttaatttatttggttgtaccctcgaatcattcctctattactattcaactgttaaacatcccatttcattcagtcaaaaataacacatgttgcagtgatggaatgaatgatgctatggatggatttgtgagaggaaaggaaactactagtaattaagtagtaattaacacatgttggtgtgaacaactgatactaattactaacattcgtaattaccacatgttggtgtgaacaactgaaacttttcaggcatatatcattcagcgtgcacctggctcttgtaaagctctctcttgcctgccttttcttccctgcctgcttttgcatgcatctgcctttcttcagctcagtgcttcatccaggagagagtcggagttcaacacatgcaataattaatcgtcacttgcggctgcagaacggcaatgcgtgaaatgatttctgttactgataacgatcagtcagtgatgtgaactagctatagatctagcaagcaagcaaacgagcctgcatcatactatgcaggtatatagcttagctttcaggctttcagcctgatggaatctgaatgatccccttcacccacaaacatattgttgcaatggctacatgtgttccaagttgcagagagaagccatgatgggaatctccagcgttcgcca

SEQ ID NO: 56649 - DNA, 240 bp, Oryza sativa
ttcgttcgggattaaaaatcatttaataatgcattttctggaaattaaataaaagttaaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaaga

SEQ ID NO: 56650 - DNA, 1501 bp, Oryza sativa
tccaaaagtcaagatggtagccatatgatgaaaaggtgaaacggacggtggattgcacactccatgttgcccgatcgcgaagtactataataaagaaatatgtgctagctccaatgtgtagttcgatcataataaaatgtattacacaattaatttcatttttaggcaacacgtggcaccacaaaatatatgttgggcccgctcaattgatatgtgcatgctaaacatcaagcctttggaaaaaaaaacttaatatccggcccatataccaaagcccaaatgctattattctttgcacgactatacgatgtatattaaccctcattttataccctagacaggcagttattgttcccatctcctattttccatgccgccaccgccgccgccaccaccaccaccaccgctgttcgcctactcctctccaatggattcaggtacttcatctccataatatctaccacttgaactgtgaactaatcttggtagcccacatcctccctgcatcaatcgttgttacaccattcttattgattccttccatagatataagacgttttttgctagtcggatattactatgattgtctatgtcattatccctctctggatggcaccggactcttaggtttaattttaagtagttggttatgctcttattttggtctattcttatagtttagagttttttctagaccttcttactaggttatttcaatacaggcaggttagcatttgtcccaactgctatacttttggttgggtgcactatgtaaatatggcgaagatgtgtttttgatcttccattttctaaaaaggaaccactataagtatgatgaattccaatataatcacccggtgaaacttgatttgcggtatgtagaagaaaacaatgatatctccttttgttaaatactatattatagctatctttctatttcccttgcacggttgaaaaatgtaaatatgcttttttttcctaggaaataaggcaccacaacaaatttacacaaacgtcacctatcaggaagactcagataacaaaatgaatcaatatttaatctgttttatgtcgtagctaactcaaattttttattaatttgttcctgaaacatattatttatttttcagttatatcttttattttaacccatgtgtacaaccgaagcagtcgaactggattgaaaaatttgaaatgctatactactgtagcatattactatttttttaagaacagcttatatgaaatttcacatatgtacaacacattttggccatcctggctggctaaaacactggaacataccggatgttgccaacagcaaggcacatctggaatttagaggacgccattattttccccattaatgtaaatacatctgccaactttcgtgcactaatattaccctttttttcctcaaatatagtgagcccacagataaaatgcaaaaccatccacggttttacatgcaaaagtagcaattatttattgtgtaatctgg

SEQ ID NO: 56651 - DNA, 1075 bp, Oryza sativa
cgactcccggtccatcaccgcaaatactctcccgagacatcgagtcacctacacatggaacaaacaaagaaaccatattccgagaccaagctatctccaacttgacttattagcagcaaacaatagtattacatacgtatagtatccatctagaagtcataatcatgaaataaactcggatatccaaataaacaacccgaaaccgaaaccgacacagtgtcggccggtcagaccgcaggctgcgccggtctgaccgcgcgttacacgccggtctaaccggctaccagagcccggtctgaccggtcatataaaatgacaaatcctgcgatcacctgtaaatccaatcatctccaaaaccacttcgtgaataaattccaaataacaaaaccaataatctccaatgcccaattgttcatcacagaataataatcaaaaacacctttgattttacagattcttccaaaggaggacgcgctactcgtagatccctgcaaacatccgccatggcgtcgcaatggctgttgagatacgagttctacagccagatcttgcgtcctcagagcgtctcaacgtcttgatcctttttggcgatctcgatggaaagctcaagcttggccacctcaaatttcgtcttccaatatgtggcacggcactttctctcttcaagtgcatcctcgaggcctacaaaagggaacaactttagcaaatccaacttcgtggttatctatgaagactgagattcagaggctgatgacccaacctagagtacgccgaatgagtgagcttaagtgctaaccagatgggacgagcacattgtcgggtccaccgccactagagcgcgttcgttgacattcgaggcggacaaagtcacgggagaaacaggctcgacatcgagaacatcaggacctcctccatgctggacatcctcgtcaacaatacctctatagaatacaaaaacctctatgcgaaattgttctacctaaggacaaagcgggcccaaagtattacatttaagttaatacaaaccatcgagtttaaaaatattactcctcaaagaaggggatcatgctttccc

SEQ ID NO: 56652 - DNA, 1501 bp, Oryza sativa
accgaccaaagatggtttctctaccagtgcccatttcttctgttcatcttcttgctggactctagtgcatctttgttggttgttttcttcccgtcacccgttttgctctttccttccttcctcctgagggtatcatccgcatgagcgcatctgtcaatgatctcgaacaacttgcgagcggaggtgacccgtcttgttgccaactcttgagttgtatagcgatctcggacgcctgatctgaacacgcgaataactgaaacatcggtgatttcagggatcatatttcggcatttattgaaccgccgtatatagtccctcaaagattcacctaggttctgagttaatgtgtggagctcgtccttgagcgtgtggcacttgtatgtcccttgaaaattggcgacgaactgctaccacaagtcttcccatgaagagattgagcggggcgggagatgcacaagccatgaacgagcagatcctttgagtgcggccggcaaatagtttgcgagtgcgttgtcatctgctcctaccgcatagagaaccgtagagtagacgcgtaggaattcctcttggtcagtgctcccattgtatttctctttggctcctggtcgaaacttttcgggccacctaacttctcgtaaagttggagtgaacgccatgcatccttcttcgggtatatggggtggtcggtgccctcgcggtgttcgagaaccgctagccgctgatgatgatgacaaagacgatgaggggtcactgggatttgggctttgacctctgggtcgacatccttgttctcgatccctctgtggatctggggagtgtgaatcccgtcgtcgtctatcggcttggcatcgtcgacctcgtccgttgtcgtcctgagctcgctgcccatggtggttttcgtcatggtggttttggcgatcttgtcagttttggtccccacttgggcgatgtcctcgacttccatcattgtttcgttgtcgatatggtgaacgtcgctgctgatgattagcgtcctcctgttttcgttgttcccccccgacgcccatttaggtggccgtgtaagtcacaattttctcgtggtggtgggctttgctgacgatgtcctcgtggagaggcattacgcggattgcggcctagatcgtgacttgggtgactggggatctccgtgggttcgtggttcccatcctcctgcacctcttccggttgtcctggaagtcgtgaagggccctgagctgctggtccagccgccgctgcgaaagcgctgttgaggttagccattgtagattgtattctttcaaccaaattattagcgtcaaggaacgtgattgggtcaaaaggtgtcacatctagaaatttggtctaaatttccagactattttgcgtattgaatccctgtccaagaataagctagggtacaaaaaatgacaagtaaatatacagatccaaataatacttataaataaaagaggcacacaatcctcacaccgaaaagaaagtagca

SEQ ID NO: 56653 - DNA, 1151 bp, Oryza sativa
ttccggtatgacttgctgagtacagtgggtagtactcagtcttgctctcttttcccccacaccagagctgaagatcttcctagttggagctgttttatcgaagttggtttcgtcgctgccgtcaaggtttgcctgtggagtggagacacccgctgctgaagtcaagcttcccggtttagctcgcttttatcttttccgctgcatttgtaatcttttctattttttttataagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaacctaagagccctctgaacccctttttcatctgcatatgcctttttgcacttggaatttgttttgggaaaatttggagttttgcctctttggtttgcgggaaaaatcttggtcgttcattcggatcggattttttttttttttttaaaaaaaaaaatgagctcagcctagggctttagaaaaattttagttggagtttattcgacagtcagtcgggaatttattgggggttatgcattaggtcgtgtctatattcggtgggggcaatgttatgcgcatcattttccatgcaactagtctatgcattaatttattgtttagttgcattagtgtctttatttgagttcatgaaaaatattctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttccacctatcccctcaga

SEQ ID NO: 56654 - DNA, 310 bp, Oryza sativa
ccatgtgtgtgtgtatatatatatatatatatatatatatatatatatatatatatatatatatatatatatatatatatatatatatatatatatatatatatatataaaatccacgggtgcataatggacctactttaattaattattaatttagattttctaattattatgggtccacttgtcatatggattatgaggcttgttactattgtatatttgttatattagtgactttgttatttcctaattcacgagttggcgatcctttgacatcgtttaaatggtagattcacaaaattgcttggca

SEQ ID NO: 56655 - DNA, 897 bp, Oryza sativa
tatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 56656 - DNA, 581 bp, Oryza sativa
  unsure (1)..(581): unsure at all n locations
tggtgccanattgaanacatgttgcaangccncctttgtatggacnnnnnnnnnnnnnnnnnnnnnnnnnnnnnnnnnnnnnnnnnnnnnnnnnnnnnnnnnnnnnnnncaattattattaagagtattttaaatcgtatataagtgtgccacatcatcacccactagtaattattatctagagtattttaaatatcatgcaaacataacatatcattcataattttattggatttttagagctcaatatgtaaataatgtcaaatcattatcttacattatttaaacatatacatctaccatttctataatatataacatgcattcattcacatatcccgtagcaaagagcagagtatcaactagttattagacattagtatgccctaagctcttaacaagttagcatagctttggtccatgtggcataggtcgttgctttaactcagtatccgaataagtattccagtcgaatagtatttgcatctgtcttagtacgtattcgctgccgatgatatttgtgtttgtatttatacccgatactatccgtatccgtcctaattttaattacggttagaata

SEQ ID NO: 56657 - DNA, 174 bp, Oryza sativa
attcctgcagcccaatcttcgtttcttccctaataaaacctggccactgtttctttgttggtcctgtgagaaaagaaaaacaacagtaacacaatactcttaataccttttggaatataaattcaaccttctcactctaacctttcaatttttatgctattgtcacagaaaaca

SEQ ID NO: 56658 - DNA, 198 bp, Oryza sativa
  unsure (1)..(198): unsure at all n locations
tgatcagattgaaaccttttgcagccncctgtatgacnnnnnnnnnnnnnnnnnnnnnnnnnnnnnnnnnnnnnnnnnnnnnnnnnnnnnnnnnnnnnnncttaaaatagttgtgttcttgaggccagttgagacgaacagaggatacagaaacaatctgggtcaaacacaagactgctatttttttttatttgtagg

SEQ ID NO: 56659 - DNA, 1501 bp, Oryza sativa
cgagtgaattgcactttaggccacttattattgccaaagtttcactttggactaggctatgtttgatgttttcactttggaccgggatttgctaccttatattgcacattggaccattcttgttgttccttgcctctgacctactgtgctgccactcactccttgatttctttagctcacaaacaactaaacacgccagtaatgtatcctgatcacttagcaccttgattttctttttggctctttttctcccgccaaaatcatgtgggctgaaaaaaaaaatcacttgattgtgagtttacaggctacagctgcagcagcaagcagccctatggcttgattttgtgagttcgagctcaggaacggatcggagagaaggaatgctagtcatgtgattgcttgggttgatccatggcagcatctcaataaagaaaaaaccagcaccttgattttctttttttgctctttttctcccaccaaaatcatgtgagctgaaaaaaaatcacatgattgtgatctcacaggaaacagttgcagcaacaagctgcccagtgacttaatttcgtgagttcgagctcaggaacggatccgagagaagaaatcctagttatgtgcttgctccggttaatccatggcagtatctcgatgaagaaaaaaaccataagagagatggagaagaaggccagtccagtttgaaatttttgtaaaatcacctggtccaaagtgaaaagatttgtccacccctagtccaaaatgaaacttgggtaaaaattactagcccacagtgaagttcactctatattttcttatagttgaggaattccagcatatcaggcataattcgatgaatgtatgtcatgcactctattgatgtgacaaagaagtatactttaatcaattagttattataaataagtttgggaaaatagattcattctccaaattaattggtcaaggtgtcttctgtgattatgaatgattatgaagaataggcgttgaaaaacacgagacgcaaaattatagatatttatcaaaatataaccaacaatatggtcctttggagattttaccgtggtggtaattaaaaaaacactttatttaggtaaaaaaatcacatatagtacaaatagatatgaaacaactccattattctattattgttttattatcgtgacacatgttgttcttataaattcatgtcattatcataaattcaaggctgtatggttttatgtaatatgtcataactagataataactaaaacatgttttaaatagagtgaagatctattttgaaaatataatctacatataaacatttataccaataaaaaattaagcaacattaaataagtgcccgcgcatatgcgcgggctaccttcctagttctcttactagttctcttattaatgatcatgtacatatgttaccaataccataaacaatagatagtgctctcacctaaaactgcttagcttagatctatgtgtgaattagtttg

SEQ ID NO: 56660 - DNA, 1501 bp, Oryza sativa
catgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaagaacctgaaacctggaaaaagaggatacagcaacaataaaattctctgttgggtatcagatttattgaacataaggaaaggggaaatcggtaggtaacctgtgttagatcattgaagtaattggagaggatcgaccaggtgagggctgcatatgaatccagcaagcagagttgcaagaacggtagtaaaacgccagcagcctggtagagtgtggtagatcgacgaataagcgagatgataaattggatatagatgcagaactgataaagggataagaggagaagaaaacgcattaagccattaatggatttacttgataacagccgtgaagtgttttcctcggtggttgtcgacggttttcattaatcatggcaacctaaaggggcgaacaacctttagacatggaagaggaagggggaagcagcgcacgagccgccatgggggcgacggaaggggaaagcgccacaccctcattttgcttccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggtttatgcgcgtggggccggtgaagcagcgagatgtgggaaaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccctttagt

SEQ ID NO: 56661 - DNA, 1501 bp, Oryza sativa
ttccactagcaagaatttaggtagatgcttcgctgattaattaggcaacattaggtggttttataactctagactttgggaatattcatatcacctggacatattggaatggttggattattgtggaattggatgcacacctccccctctattcaaaactctcaaaatggttttaggctgggcttggggtgcattgttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgggctgcggcccggtagtcgagatgtcatagcacagggctggtgtcctgctgctaggggctcaattctgcctgcctgtccgggggttctggccgtaggtgggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtaaaacctattcgaatagccgcgccctcggttatgggcaagcctagcaatgtacccaagttagtgtttcaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgtttaataatattaaatagttctaggatcgtgttttaaatttagctttgagcaactaagagtcttttaaatgctgtttattgcaaaacctaacccctatactataactccattgtactcctttgcatttatgctgcacttgtgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccttagtcttccgctgtttttcgttgtctttgagtgtgttgggccgtcgctgcccatgtaataattaactatttacgcttccgcttgttaaactctgaattgtatcaacttttggtgtaccttgcctcctgggacaaggaataatacacgcacgtaaggaacgcccgttgggttatttccggtcgtgacaagttggtatcagagcctccttgaccctaggacgagccttagatcccaagccttagcaatattttcgaaataaaaatcctctcttatttgtgaaaatcctttagtctctctctgtcttgctgcttcatttgtcatcaaaagctgatctctaaaatattttctctcttttttgtccttgcttgtagatg

SEQ ID NO: 56662 - DNA, 1501 bp, Oryza sativa
actttacatgtcatagaaagtaacttaacatgtcactgaaagtaacttaacatgtcactgaatgtaacttaacatgtcattgaaagtaacttaccatgtcattgaaattaatttaacatgctacagtagttgtacatggtatactaatttgcttatttattttttttctttttgcttttggtaaatgtagccaaaagatcattgatacaggagaatattatatttatcttagcgatcttgcgaactctgtcaaacctatgggctcactggacaataacacatgtgaattggcattaattgttctgtctactgatatcaaggacaattcgaagagaatttttcctgccagaataggagtgagtatataaaatttacaaattaaaatctctttttaatgtactattactatcattgcaacaccttatgtttttttttccacatggtgcagggatatttgttggattcgcagttggacaggaatgagctcaagaaacacttcgatcaaacgagagcgaaccatcttgaccataaagaattagtaagaaaatatatattccagctgtcaatgatatgtaaagttactttttcctgtctgcttgtagaagtaacttaaatgtctttgcaaattaactcagcatgtttgtggaagtaactttttctgttatattgacaggaaatgttattttgaatcactttttattatccttttatacttactaaatcatgattatatttactgaaaaaccttctttccactcccctccctcttttcacttgaatgcaggcattttttcccattctccaagaattgggtaatgggaatgataaggctagtcactatttcgtggtgtgccttaatctgaaagctgaaagattcgaggtttatgattcgctgaggggagaagatgacgaagcactgatttcagcatctcatcttgttgttgcatccatcaagaccatgtgggataggttttacatgaggttttcgaagaaaaccatctagaattacccactgattttcattgatggcccaaagcaagataacacgtacgtaacatgcttttttttagttagtgattttcatttattgtctttagtcaaacttatccctattttgtttttgcaaacaaaaacagccgggattgtggtttttatatgctgaaatttgtggagttgtgggatggcaaacagttgccagcatttgaaccaagtgacatccccaacattaagaaactacttacacacaagatactctcgtttcaaggaaatcgtgtgcaatggatgcaagtattatggggcaaagagcctgatcctacacttaaggtaaagtaatgaaacactgcattttttttccagaaccagcacataagttatagccacataaattaggttgggtaacaaattaaaatagcatcttggttctgcaaagaactcagcatggtcttcctgagaacttacatatcactgtgaagtaactactatggaagctaaaagtaactta

SEQ ID NO: 56663 - DNA, 1250 bp, Oryza sativa
aggcacatggtgacatgatgtggggttgtgtcttgtgggtacagtggtacacctctgatcagagtaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttaga

SEQ ID NO: 56664 - DNA, 1501 bp, Oryza sativa
acaagcaggaacaaagcacaaaaatgggttcttgacttcttaaggaaaaattagagacttgaacggtccaattccgagttcaaatggccaagttatggccatttgaagtttatatgcactttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgccggcggcggccataggcacggcggagcggcggccgagagaggggagggaaagggggaaacgaagcggcggtccacggctcaccccgggtcgacggtgacgacggaaacggcgaccggagcggaggaaggcggcggcgcggctcgggtggacggggtcgacggcgctccggcggtcggcgagcgaaacggaggggtggacgaggtcggcgaggatgcggcgaagccgaaggaggcggcgccgaggtgggaggtagtccggggcgacgacggcggcggaccggagctcggcggcgacggcggagagagagagcgacagcgcgagctcgattccggcggggagagagggcggtgagtggcggaaacggtggtggggagctcggggagggtttatatagggttggaagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggacggcgggaggcggcgggattcgcggcggcgtcggcgctaggcgcgggcgaggcggcggaggcggcgggaggaaggggatgacgggtgggccccacccgtcagcgagggaggcgggcgggcccgcccgtcagcggcgcgcgcgcggggaggaggccaagtgggccgcggggaggaggagagagggggagggagatgggccgagccggcccattagaggggagaggtgatttttagggtttttctctttataaaatcattttaactttgtttatttcttaataattattatttgtgctctgaaaattccactaaaatttatttacacattttaggcttttagaaaatatacaaaaatcctccaagcccaatttgacttttaactttgcacattttaatttttgaaggctttcacaagcattttaattattctaggcataatttagaggatgtattttagggtcgatttgggacgcgacaattatgcaattg

SEQ ID NO: 56665 - DNA, 1501 bp, Oryza sativa
cgagtgaattgcactttaggccacttattattgccaaagtttcactttggactaggctatgtttgatgttttcactttggaccgggatttgctaccttatattgcacattggaccattcttgttgttccttgcctctgacctactgtgctgccactcactccttgatttctttagctcacaaacaactaaacacgccagtaatgtatcctgatcacttagcaccttgattttctttttggctctttttctcccgccaaaatcatgtgggctgaaaaaaaaaatcacttgattgtgagtttacaggctacagctgcagcagcaagcagccctatggcttgattttgtgagttcgagctcaggaacggatcggagagaaggaatgctagtcatgtgattgcttgggttgatccatggcagcatctcaataaagaaaaaaccagcaccttgattttctttttttgctctttttctcccaccaaaatcatgtgagctgaaaaaaaatcacatgattgtgatctcacaggaaacagttgcagcaacaagctgcccagtgacttaatttcgtgagttcgagctcaggaacggatccgagagaagaaatcctagttatgtgcttgctccggttaatccatggcagtatctcgatgaagaaaaaaaccataagagagatggagaagaaggccagtccagtttgaaatttttgtaaaatcacctggtccaaagtgaaaagatttgtccacccctagtccaaaatgaaacttgggtaaaaattactagcccacagtgaagttcactctatattttcttatagttgaggaattccagcatatcaggcataattcgatgaatgtatgtcatgcactctattgatgtgacaaagaagtatactttaatcaattagttattataaataagtttgggaaaatagattcattctccaaattaattggtcaaggtgtcttctgtgattatgaatgattatgaagaataggcgttgaaaaacacgagacgcaaaattatagatatttatcaaaatataaccaacaatatggtcctttggagattttaccgtggtggtaattaaaaaaacactttatttaggtaaaaaaatcacatatagtacaaatagatatgaaacaactccattattctattattgttttattatcgtgacacatgttgttcttataaattcatgtcattatcataaattcaaggctgtatggttttatgtaatatgtcataactagataataactaaaacatgttttaaatagagtgaagatctattttgaaaatataatctacatataaacatttataacaataaaaaattaagcaacattaaataagtgcccgcgcatatgcgcgggctaccttcctagttctcttactagttctcttattaatgatcatgtacatatgttaccaataccataaacaatagatagtgctctcacctaaaactgcttagcttagatctatgtgtgaattagtttg

SEQ ID NO: 56666 - DNA, 703 bp, Oryza sativa
ccgctatgtgatctccatcttgttactgacccaaaaatgacctgagtatggagacggacgacatcgcaaagacatctacagctgggggacctctagaaggggaatagctctcttaaaagcatgatggccatagctatcctcggcgcccaacagtacttcgctcacctatccacacaacatacaaaccggagcgaagctacaatagccagagacgcctactgtgcgtgctaagacacattaaatgagaagcgctcactggccactttacaggcaagaaaactggctcgccagctgacttaacgaatataacatcgctcattaagaagcgtatactgaagtactcactgttacgctacattattcaatgactcaatattctggctggttctattgccgccagcagaatctgctctctcaaaggcaattatacacctattcacaatatcatgcaagaacacactaaggaacatgctatgctatatgacaccaataggccagcaacctgttagacgctcaagatggttgcgagcctcatagacctacaccacatgacaagcatgactatactggactctgatgtcagacgtggccatagccatcagaactatgaagataccaagcctgtacccaagcatgctctatcgtgcccttacatgcgcacgctgtcgtttaccgcaacctagacagctttctcccttgcaga

SEQ ID NO: 56667 - DNA, 159 bp, Oryza sativa
ggtattgcgatatcgccgataattttagtggcctgaagagacgtttgggtgatgagagaatatctgatagtaggcgtggttactttgctctcggttgttgcgatcgtgcttatggtggcctgatgagacgttttggtgaaagcatataaggactgttga

SEQ ID NO: 56668 - DNA, 741 bp, Oryza sativa
tatataagaaagttttaatataatgaaaaagttaaatatgcgaacacggcccaaatttataggttctatatccgatatctcttccacaggctttattttcctttttatacacatactactacctcagcggcgtttatgagttctgattttctttttttgttgaactggatcgatggaaattctgaactttgtacatttgtgtgtgtagttggtgtgctaaaattttttcaagtatacggacacacatttgaagtattaaacgtagactaataacaaaacaaattacagattccgcttgtaaactgcgagacgaatctattaagcctaattaatccatcatttgcaaatgtttactgtagcaccacattgttaaatcatggcgtaattagactcaaaagatttgtctcgcaatttacatacaaactgtacagttggtttttttgtctacatttaatgctccatgcatgtgtccaaatatttgatgtgacggtaaagttggaagtttgaagaaaatatcttgaattgtagtactacgttttgtgttctgttttctgggctcccgatgcattgaataagtgaaaaaatggggttgcaaagctgaagctaaaaccttgtaatcccttgtagaaattaggatatatatttttttgtcggggaaaagttaggatatctaggaagaggactatttttcgaggggatagggaagaggacactgcacacattcttttccccctcttaagt

SEQ ID NO: 56669 - DNA, 164 bp, Oryza sativa
gcgagttaaattgttactactacatagcccaccatatatattcacgttgagtcaggtaaattttaactgtgtgattcaccaactataatgaacatgacttagcatattgagttattcattaactaaaggaaacttttttttgctcatgccttaatttttttttg

SEQ ID NO: 56670 - DNA, 361 bp, Oryza sativa
  unsure (1)..(361): unsure at all n locations
tggattttgttatgccccatcagtgctaaggtggacttagaatcaatccactaattcagaatattagctagcctcaggatttactagcaacgccctcttatggtcagaatcatgacaaatatatgccaggctaccccagaatatcacatattcgccattttagcacatatacctcgtaaaatggggagcnaaaagcacccaatacaaaatccnacatatttgnnnccatgccatcatacccttttnaagctccnnnntngcncaatttcttgccttgcacatgaaaccgcaaacttaccaaagtttcttgtaggcgcgccctttttaaaattttttttccccccccttttttcttattaga

SEQ ID NO: 56671 - DNA, 950 bp, Oryza sativa
cagggtgcatgaccatctgaggtttctttagaacttgatgctctgtgcctaattattctctgcctttctcaaacatatagtataaagtgtcagttacatggtcttctgcggatgagatatatgactcaaagaacactttagagctcatattgctgatggaacgtgctagtttctttagtgattgtagccgcttttacattattgtcttgagctctgttttggcaattggcaatttggcatgtatattgttcttttgcttggatttttgaagtattggcttgggctctgtttccgtatgggatacattgggggtgaaggtgccgttcgtgttctacaatatttgtatattttgtctaagaagagtttagaaactgacatgagtacatgactaagaacttttcacaattcgtgcccttccctaatccccaataaatgagtgacgcctgttggtaatgaaactgtcatctcgtccatacatcagtggcaagtatctaacctacctaggatgatgtcaacgaatgcatacatggtgtatgaagttgtaggcatttaatactacatgaatgcacaaagtaaacatcattacaatcattgatcaatttacatacttattgatgtttcacttatatctgtcctgatattatgatagttatctttctgttttcctacttctgaaagcaaacctatttgaaacggatgaatgggtgattcctgtgttgcccttcagagtgtttgctgcaactaacatgctgcgttctgtcgtatttcactgctcaccaggttgtctgctgagcattttttttgcgtgtacttcattgttagatcagtcaactgttacttttctttaaatacaaaatgtttggcaacataaatgctctattccgcatgcctatgtgttgtcatgcactcatgctacacagtttccaatttgctgcaccatttctccaatt

SEQ ID NO: 56672 - DNA, 175 bp, Oryza sativa
ctccccatcaccccgcacggtagtgcctccctccgatctccctcctcgttccatctgctccccttagactgggtagtagcacgagtagcctccccgtagctagctggcgccgccccgaccgttgtgtgctcgcctccctctgttgtccctcctcggtccatctcctccccttaga

SEQ ID NO: 56673 - DNA, 1501 bp, Oryza sativa; identical to SEQ ID NO: 41290

SEQ ID NO: 56674 - DNA, 1501 bp, Oryza sativa
gctgggccggcacgtaggcacgaccaacacactgtgctcgtccttagaataggtttattttgcattcctcctctttgggttgtgccctatatatggcttgaataagtctagattgcctccctcctctttggactgccttatacacatctgaataagtctattcgcctccctcgtgtgtcgtgccatgcgaagccagcccactgtgccaaggtagcgcccccaggctcagcccaactgtcaggccgggccggcataggcttgacaccaattaggccatgtcgtgcctggccggaccaaaaggtcgtgccatgggacgggatgtcgggccctggaccttttggccattatattcgcaactgcgtcaagtcaagcggagcgaggaatcctatctcacacagacgcacgagcaaactaactcgcacgtgatttggatccactaggccccactctagcctacagctctacactgcagtagcacatttctttttttcctttctttcgcgtgattttttttcacacgtgcttatctccctctccgtccttcgtttttgcgtgcaattttttttctcatgtgatttttcctttttctcacgcgattttttctctttttttcgcaagatagctaggtaagtttcaacctcattttattttgaaaatttttgactcaaaatttaaaaacttctaacacaaaattgaaaactttcaattagaaatttgaaactcttaactgaaaatttaaaacttttgatcaagatttgaaaactttcaactaagatttaaaatattcaactcatgatttgaaaactttcagcttaaactttaaaatttattaacttgaaatttaaatatgaaagataaattttgaaaattttcaactcatatttgaaaagtttcaacttgatatttgaaaactttcaatccgagaattgaaaacttttaactcgagatttgaaaattttcaagtcaagatttaaaaattttcaacacaaaacatttgaaaaccatgtgttgaagattaaaaaaatcgtgaaaggaaagaaaagaaaaaaaaatcgtgaaaagaaagaaaaggaaaaaaatcacttggggggagggggccagctggcgcacgcgttgccgcgccaatttgccacacccgagcggagcaccccgtcggatccgtacgtaatacacgcgtcgtccatcgagagcggtgctgcagaggtggcgtgctgccgctgggatgcatcaattttttttatttacattttgaggcttttcttttcatcgtccgctctgttccattcgccgccgtcctccattccgttcttcctcagctcccgtcggtggtgcttgaaagagtccgttttggtgctggccttcttcaggtcgtcaagttcgccttggcgcgcggtgcttctcttcttcatcgtcaggtggttccctgcgctctcttcatgtcgtcaaattcgtgtcggtgtctcgtgctgctctccaacttgctcagatagagatagttcgg

SEQ ID NO: 56675 - DNA, 169 bp, Oryza sativa
cacgtgccctcatcagtcggcgagggagctcaaggagaaatggaggattttcgggacggaggaagagaggagaaggaggcgtcgacatgccgtcctccttggatagagagaagggtgggacctacatgtgggccccatattttccaaatttttaatttttggttctagt

SEQ ID NO: 56676 - DNA, 1501 bp, Oryza sativa
ggccccccgggatctttagtgatcgtaactttagtcccggttggtagatctcggggatctttagccccggttggtaacaccaaccggaattaaagtcccacccctatatatatatgtcttcttcctcctccagctgcccgagcaagcttcaaaatttcttcaaaaaagagggtaggtcatgccaaaatttctagtgaatttattttggtaattacatacaaatcggaggtgcctaaaaagtttgcaacttcatcctccaatgttttttttgtcatattacatttgcagttatgttttgcacacttttttgtctctaaaatttagttgtaagttgatgagagagaaaatttgtgtgggttagaaagaatatatacaaatttagttgatttgataaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatgtgtcattattgtatgactgttgaaacagtttgtaattatcttataattattgtatgactgtcattattgtaagaataattatttgtgtacgatttttttcgactcatgtagatggatcggcaatggatgtacgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttccacttgtttgagtcggggtttatgccaagctataattgttggacatcccacggagagcaaggtattgaaatggaagaagatgaagtggaagacgacaatattccggactttgctcagtacgttggatttgaaggaaatcaaacgggcgaggaggaaagggatgctgatggtaacgacgttgcggatgatcttggtcagatgttgcaggatgccaaggaggactgcgaaagtgaaaagggggcccataaattggacaagatgttagaggaccacagaacttcgttatacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgccccagacaacgtacgaggctaagaagatagtctgcccgctaggactggaagttcagaagattcacgcatgtccgaatgattgtatcctatatcgcggtgaggagtatgagaacctagaagcatgccctgtttgcaaagcactacgatacaagattagacgagacgatccaggagaagttgacgggcagctaacaaagaagagaattcctgctaagg

SEQ ID NO: 56677 - DNA, 1020 bp, Oryza sativa
gtcgccacgccgccgcgccaaccgccgccccgatgccgccacaccgccgttaacgaacgagaacgagaacgatcgaacgaacgagagcgagaacgatcgaacgaacgtgaacgagctagggaacgtgaacgagcgaactaacaaggacgaacgttaacgtgaaatgcaatatatatatatatatatatacatgtatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcatgacttagcagatgtttcttgtatcaacaga

SEQ ID NO: 56678 - DNA, 1501 bp, Oryza sativa
aaattttcatgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaagaacctgaaacctggaaaaagaggatacagcaacaataaaattctctgttgggtatcagatttattgaacataaggaaaggggaaatcggtaggtaacctgtgttagatcattgaagtaattggagaggatcgaccaggtgagggctgcatatgaatccagcaagcagagttgcaagaacggtagtaaaacgccagcagcctggtagagtgtggtagatcgacgaataagcgagatgataaattggatatagatgcagaactgataaagggataagaggagaagaaaacgcattaagccattaatggatttacttgataacagccgtgaagtgttttcctcggtggttgtcgacggttttcattaatcatggcaacctaaaggggcgaacaacctttagacatgggagaggaagggggaagcagcgcacgagccgccatgggggcgacgggaggggaagcgccacaccctcatcctgcctccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggttgatgcgcgtggggccggtgaagcagcgagatgtgggagaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccc

SEQ ID NO: 56679 - DNA, 1501 bp, Oryza sativa
attattcattttttccaatactatttggcaaagaacatacataattctcgtgatgaattacgggttgtattgtagtaaaataactgtctaaaatcttatttatttattttttcacatctatccatcttgtatgcttctcactcctcaaatagcaataaaaaaggtttgaaaaactttcagatacttttagaatctcaatctcacccaaaataaacctaaaaaggtctacttaaaaaccaaagctaaattatatatttttattatcactggctaaaatttaatttaatttttctcatctatctattatttgtgcttctcacacctcaaataagaaaatttttgaaaacttcgaaataatttgagaatctcaatctctcctaaaattaaataaacctaaacagatgtacttaaaaaacaatgataggttttgtttttttaatttttacacatgtagattaaaattaacgttgtatatttttgtcaagtgatatttgacactgtaaaatatgatatgaaattatttgaaacattattatcgcattaactattacatgttagcgtcatttgtcatgatatatttatcactataataagtttatattaagtttaattgtgcatatatgtgtagtattatttttaataaaatcgtagattaaaggctgttgacaacaaatcagtgccgacactgatgatttttcctgattagtatatgtttccgattctactatgtacctatgcatattttcttgttcttttttggctttattttttttatagtatatgatgtaggtatttaagttttgttttttttccgggagggagacgatcgtatgacgtaagcgcattatgttttttccaggatagagattagcatcatggtatttttaagagctctaatccattgtttaaaataatgggtccactaatttaagtgaaaactgaaggttggatgcttttctttttttattctgaatttctaggatttctgtaattttattaaagcgccacgtgacaatgtagaagcatttgcagtacgtttaatagacttttaagtatataatagatttctaggatttctctaatttatttgagagccacatagcagagtaaaagagtttgtacaaagtttaatgtaattttagtatataatagatagatttagaagatggtttaaagaacattgattggatatttattatagatcttaatttaactaaatatatttatacatgtgaagtaatatattttatctttatattgtagaaaatcatattttaaaaacggttgatttttatggatgtatgttgtttctgtcttttttatgtacaagtgtatggttttttttttcttccagcgaaggttaagaaagcttgatcattttattttcaatcatgtacgtttgtatgttacggaaagaacatcagtagcgtttgtatcgtacaatctcatacatacggacagtagcagctagcgtttgtatgttataaacatgtggaagtta

SEQ ID NO: 56680 - DNA, 1501 bp, Oryza sativa
cgcgtgagctcgctcggtcggccggtcgggacgcgcggcgcgcgccgtgatggacgccacgtcaccacggctgccacgcgcgtcgcacgatagcgctaaatggagaggcctctccgtttagattttacgagcttagaatgaggtcaataacatagccaactatcggctgcaatagatgggcacatcatctggagttggattcagcttatctgacttcaaccctcacgatggcaaagagcagtagaggtcatccagctgtccatgttcgatcgaaccgtctgcccaggaagcgcatcaaatacaggtcagccgcatcgtgagtctgggccaaggccggcccaacaagcctcgtcccccagccgtgctcgtactcctcgtctggccaccgccatcgccgtcattcttgtcctcctcgccgccctcgctctcaccgtcgtgctcgtcctcctcaccgccctcgctctcgccgtcaggctgcggtactcggctgagaagatggggaccggaaggcgcgcaagatgcagcgcccggtcacggccacggcgcatcggtgccacgagctcgatgtgcgcgcgcggagctcgagcaggccatgcgccgcgacaggcagcgcgcggcgaatggaggaggggagtgcgcgcgccgcgtggctccatttcgccgatcagaggaagaccgaagctgtggtgcctgagctgctcgttgatctgaattacctgcgtcgggcctcggcaggcagggagaggaggaactcctcatcgccatctctcagcagtgagcgagtggaggaacacagcggcctcctcttcagctccttgatgctgcgtctaggagtgttgctttgttgcttgtctgaccaaaccgaatggcattctgaagatactgaatgttcagttataagaatgatagattgttctttacacgggcagcagaagcagaccacttgttctgaaaaatggggttgcatgtgttctgtaatttgtatagaaagcagaaaaactctataaattgtttgcaatgagaatgacttgtccaacagaatgatgaaatggccatttgtaacttatcactgcaatgaaattatgttccaattctgggcatatggcttgttcaagagaaccaacggttttttttttccaaaatgcacaaacatatatgcatgacccaacctttccatctgatttccttttgtttgagtacctttctctaacctcgaaacctttctgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagcttacagacctgttttcttccatctcaaatatgtagattttgctggaggcttctttgatgaattccaacagtctaatggaggaggtggaagacaatcaaata

SEQ ID NO: 56681 - DNA, 1501 bp, Oryza sativa
ggaatttcttgagtgaaaactttctaaccagaggatgtgtgtgttcttcaacaaactgaattacttcccacctagctcctttcctcttcactgtcatccttgctttgcaggcagcctgtcttgttctacttcttttcattttctttggggggcacgcttcacccgttttttcttctggaccacatttgttgcaaacaaacattactttgtcacgttctccatctttggctgacttccttgaagtgttgattttgattgaaaatccaacgcgctttgcgtacctgttgtagtgagcccttgcttcctcctctgagttgaaagtcaaggtgaggtacggcacttgtgtgctgcacggaatatcctgtgatggcgctgactgtgcttctgaatcatctgttccagtgtcttcacttgaaattgtgttggcagtagcagttgttgcgccagttgcaacactagtatgcattgtgtctgcacgatctgacatttcttcaaatacttgcatctcatcatcgccttcaaatatttgcatctcatcattggcttcaaatacttgcatctcatcattggctacattgtgtgcttgtaaacttccagcatcaccagtagtatacatagtttcaaagtcaaaagtgtcgtccaaatttatagcaggaatctccatgctagtgtcagtcagatttatagggaagtatgtttcatttctgtcttcatcatcaactagtaaatggtgtactggaggttcattttcaccagaaactaattccgggatactgttgaggtcaaagtccatttttgctgcatgtgtttcaggctattagtaacaaagttagtttatacagagcattcattgaggtaattcagtaatttgggggggaggggggaagaagtaacttttagtttttgcagcatgtcttttttagatgctttctaggaagcaattttctcaaattaagaccagtggctatattaatgaatttttttttcacaatttgttttgatgcagtacaagatgaaattgagacgcaactaggtgatgcatcatgctgtatatagacacaaggtacaaaatgtgtaactaggaaatgtaaattcaagtttatagggaagtaacttccatgtttctaggaagtaactaattgaattgttacaagtaactttctgttaaaactgcactgagactgttaaaattgctatgagaacctaatgcacagtgagaagtaacttaatgcacggtgagaagtaacttaatgtttcttggaagtaactcattgaagtgttagaagtaacttttctgttaaaaatgcactgagacttctgttaaaattgctatgagatttccaacaccagcactcatgcctatgtaactagggaatgcaaattcaaatttattttgggaagtaaagtaacttttctgttcatattgcactgagaggtaactagatgggatgttttcatgctgtctaaactgtaaactagggattgtgaattcaagtttatc

SEQ ID NO: 56682 - DNA, 1501 bp, Oryza sativa
cggatttgtttggaaacctctcccctaacctcgccggcgccattaatggcggccgggtctcccgcgcccatttccccctcctccggccgccctctctcactcccaaccctatataaaccctccccgagctccccaccaccgtttccgccactcaccgccctctctccccgccggaatcgagctcgcgccgtcgctctctctctccgccgtcgccgccgagctccggtccgccgccgtcgtcgccccggactacctcccacctcggcgccgcctccttcggcttcgccgcatcctcgccgacctcgtccacccctccgtttcgctcgccgaccgccggagcgccgtcgaccccgtccacccgagccgcgccgccgccttcctccgctccggtcgccgtttccgtcgtcaccgtcgacccggggtgagccgtggaccgccgcttcgtttccccctttccctcccctctctcggccgccgctccgccgtgcctatggccgccgccggcgaccataggggcgcgggcgcgccgcctcccgccggccgtgccgatgtggccgcctccgggcgcgcctagcggctgccgcatggggcccggccatcagccgcccgcgccctcgggtgcggctgacgcgtggggcccacggggccggccggtgtgagccgggtgcacccggtccaccgtggaccgtgagactgccgcgtgggtcccactcccgtggacccggtccgcgcgccctctctcccggctgacgcaataaatctatttttaaattaaaatttaaatgaagaaattcgtaaatattcatttaaagtgcatataaacttcaaatggccataacttggccatttgaactcggaattggaccgttcaagtctctaatttttccttaagaagtcaagaacccatttttgtgctttgttcctgcttgttatatggagtttattagagtaaaagcccttttcttttctgttggttgtgtagacgctgcagcttcggaagatccgctcttcgtggaggttgaagccgacgtttgggaaagcgagcaagggaagtcacatcattctttgaacatattggatcccactttgtgaaattactttgatttaaattattgcattatcgctttatttaaattcccgcgttatcactgttttatttagccatgcctatttacctttgttatgaccttattattgttgttattgttattattaccttgttcaccctagaataaacaaaaccccaactagtgggcactctattaatggttccactagcaagaatttaggtagatgcttcgctgattaattaggcaacattaggtggttttataactctagactttgggaatattcatatcacctggacatattggaatggttggattattgtggaattggatgcacacctccccctctattcaaaactctcaaaatggttttaggctgggcttggggtgcattgttttgatagtagcacctcggccacataaggaccggt

SEQ ID NO: 56683 - DNA, 1501 bp, Oryza sativa
tggcataatagggtttcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccaccgcagcgcaccttcctagatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagaattattgcgtcagcgggctagggtttggtggaccgggcgcacgggcgacggttcacgcgaacggacggccgagatcgatccaatccaaaacggacggccgagatcgatcggtccacgaccggctcacggcggacgaccccga

SEQ ID NO: 56684 - DNA, 537 bp, Oryza sativa
tatagggcgaattcgagctcggtacccgaacaatttgatacaactaatactactattttcaaaattaattcccctcatgtgcattgctgtatgcattccatcttgtcaaatctgtaattaaattgaccatttatcacacaacagttccattccccacgttaattaaatttgagaacaatttgagatacaaccaataccactattttcaaattaatttccctcatgtgaattactgtatgcattccattccattccatttcattttatttccccaaccacttttgagatttgctagcagcatagtgtggtgccaccccctccctcttgtttgttggagtagttttttttttcgcagtagtccttttcttttcgcaattggttgttgcagtgattttttttttactctcttccagcatacgtatgtctagccgattgcgttgtgtatcaaaacctctatttcttactaatatattgacgtacaatccttttacgtattcgcaaaaaatctgtatttaatttgacaagttaattattaat

SEQ ID NO: 56685 - DNA, 175 bp, Oryza sativa
tatgctttaaccttcggatcaatgcttattctatcatattgtattgctagccgattggtttatactacattatattgttattttattacatcatcattagccgattgcatttctatcattatctatattggacatatagccgattgcttaaaccctatcgctattggctggtatc

SEQ ID NO: 56686 - DNA, 285 bp, Oryza sativa
cgagctcggtacccatgtttttgacctaatgtggttttatatatcctacactttgaccattgtattttatattatattgctcatgatcttgaaattgacatcattggaaaatgtttcgaatatgaatctaatcataccataatgatttttattaaggacaaagaattttgctttcagacttttgttaaattatttgaatgcaattcaggtttggagcgcgcggttgtgacttttttttaaaaaagtaacaagaaaagataaaaaaaattaaaaaaaggctaggca

SEQ ID NO: 56687 - DNA, 509 bp, Oryza sativa
ggcaatcctaattgctgcaattaccctccttgaattattgaacacttaaacctccttgttaacgggccttcgggtacgcgcatcggaacaccccccctcaaaatataaaatatccaaccatgggtaaaacttgggttttacaaaagacttggaaaacccgacacctgggtcggtgcttgcgaactaaatgaatttccaaaaaatcggggaccggggaacgtaccgggtgtacggtttcccgctcttgcacttaaggaccgtttccttggaatttcatccgaacataagacaagtgcgaccacatggttggaatgggacacccctggctgagtaactagctaatcgggggagccatgatgccaagagacatgtggattcaacggggtggtgtcggggagaacccccgggtttcctggcacagtatggtctgggacctaatctggtgttggtctgggacccctcttgttggcatatggtgaacctgtgtcggctttcgaaatgccttgtca

SEQ ID NO: 56688 - DNA, 1501 bp, Oryza sativa
agacaccggtaattccaaactaaccaacctatatgcatcatgcatgccaataaaatataacacagcatgaaagcgtgctcacacccacccctacaaacgcatacactactctagccgacatattttgagattgacgaaattaccacggacgtctcgctgtttacaactacacacgagtatgttgtgcctatcattaaaagaacaattaaatacgagtacctgtatcaaatttaggatttaaatatatgtatgtatcatatatatttcgaaattaagtatgcttatatatatgcagattgattgcgtatatatattgtgctatgcttataggttgattggaaaggcaagcagccgcgcgcacagaaaaaagtagagagaaaaaaaaagcagatccactagcttagcttcatatacgtgggagtagaacaagatcaacgcgcttcgcagaagcagaaatcgacctctcttcccaacaaactgtgtatgaaagcttagtcgacagggatgtctactgcaggtgaaaacaatccttcgacaaaaaataagttacttttggtaaagacagttaaataataagcagctatatcacgcgcatgggagaattgcatattcaattacaatcattatttttttttcagaacactgtcggcgacattgagaattaatctacccgtgcaaacaaagaacagagaaactatagtatacctacatgtatctatcacccaataattgcaagatcatgttacaaaacggttctaattaatatatagaaacaaggcagagaattctacctttcttttgtctaagtacaattatctttttctccgcgattaatatttttcgagtagtaaaatttaagtcaaaagccgtatcaggattcaggaataatccttcactgggagagatctcatgtgatttgctgttgcactcggcggctatcttttaccgttcccagcaggaagctgcagacgttggagagatcgatctctactgacaatgcacaaagcaattactcactaaattggctatggctagtgagaggtgcgctgcgcacaaagccaatgcaactttttttgaaaattagccaggattatctccaacagtagctcatttttgtaaaagcctaattattgtgcgtgtccaaaagactttcctcaaaagcaaataaagaaaaaaaatctttgcataattattctatgattactttgatgcgtacgtgaatggccatgggtaggaggcaaccaagtgattcccacctagctagctttgctcctatataaagcaccacaactcccttcattcctctccaagagttttcagccaacacattgaactcttcttcagagctctcccttccctccacaaagggggtctagggttagagtgtgtgtgtctgtgacaagttccaagctagcaacaacaagctcaattccttgcttgtttgcttccatattacactacatctcttcccttcaattaccccccttttagcacacaaaaa

SEQ ID NO: 56689 - DNA, 324 bp, Oryza sativa
actcgagcggcacttgtcggtctcgcttaacatgcacctgttatacgaggccagccccagcaaccagtgctgctttcacaggagggcaggatctcacagccccagttgtctgtctactatggaccaagagattagtcaagtcgtgctgaggtcagatcctgctctcacaacggcgttacggacgggcagcagaaggctcgacttgaaccaatcatgacaggcgcgagttgggaactaggccgcatctatacggctcaactgagccgtctagctgctccaagaactactggctggcggtagcctgatgatcatcttcagcaacta

SEQ ID NO: 56690 - DNA, 1501 bp, Oryza sativa
gttttgctagtggtactcttaccagtatcgcctgcaaaaatcgattttcacagctggtcctcttaagggtctacttgcgaaaattgattttcgcaagcagaccacaacagctaccaaaaaaatcagtcatttttactaaccttttgtcgctggcggttgtgtcagccgctagcgaaaacatattttggccgcctgcaaaaattattatttttaagtagggctagtttatattctcatttatatttgacgatgagagagatatatagttctcaagaacgtcaaatatatatttgaccacatgtagtagcatatataattcggagtaataaatgcattcttgtatactccgtaattggcatggtcctgactcaaaattttttatttgtaacagccataacttcaggaataagttcatttctcagtaatttttcaaggcttagatatacatatgtgcgcccttaatatcaaacggttgtgtggtgtttttttaagtactttggctcatagctagtactggcaaactgatcgtggccaaacacttgcctcgtggagagtaccacatcaactaaaacaaaaaggcgatgtaagaaatttattttgacgagtttctacggtatattccaattgttgatctttggttgatatctatatttgagaaaaaagttgacaatagtaaatttaatagaaatacaagttctgccactgatgagtagtgttaaatatgttatcctaatttcagtatgcaatatggtcgaattagtttcctaatagaatttgactattatgatcagtttcctaatatgaacctatgttttttttcccacgaggattcctagatttctcctttatatattccatgtgagctgcgtaggaaaggcgcgatagcccaatgtatcccctacgtttgtactcaactcctcaatatcattgcctgtcagggtccatggtttttcctgtaagagtttttcacataaaaatttgtatctttgttatgcatctattttttctaacaattagtgagttgcacgaaatattatcatacaaatgatttaggagtttttataggatatttaccggacttttagtatataaagattcatactattacagcacgttttactgcaaatatttttgtcccatggtacattatctgtctttgtggtaccaggatgtacagcaaataaacaaccaaaaagtgcacaacattctagcgtaaccatctatgtactgtaaaccaagacaaaataggtcgtgtatatatctttgaatggtggccaatatttccaggggaaaaaaattgccatccgcaggcaataacagaatcatcgttctgaacatgcaagtggtcaaaagagcatgtatatagaccaattaaaatgcaagaaaactctgtacacgaatggttgagagatcgtcctgcttaatgataaaaaggtcatacataccagtaccaccatcactgagattcactagctagcccggccggcccgttgattatagg

SEQ ID NO: 56691 - DNA, 733 bp, Oryza sativa
  unsure (1)..(733): unsure at all n locations
tgcagccctgattgggaacgagcgtgtgtggcgaaagtagggcgtagcagagaaagagttagagctcaggcggcgaaggcaagaggaacaatggcgaaaggaagggagcaaatccttttctcgatgcttttatacccttgcaatcgctgggcctggctcctcgtttctcgcgcccanctacttcgcttccctcgtatactcgactatcatcgctccactcgtcttccgcgtgcccccacgctatccacttttaatcccaattcgcaccgcattaccggtcgcccatgaagntaggatatgcgnangttgtggacaaatcagcaaatggatctgtatacgtgccgcgccgtataattaccgcttctgccgtcccgannagcggcgttacccgtatacatccaggcgaagacaanantgctgctcaaacccagaanttcgcgcgcctgtctcnnaagtggtggttggcanngtctctgnnaatagaaccgcnctcattgatggaccaaaccnaaagttatcaaatnaaccaatnngtgcatggcattggagacccgnnttgggcatnntttgcccaaactacccggagaaaccggtcaccacncnntgtcaccnnaggcttgtagnngggtggctngtcacaacatttgacacgcttccactttgggaacagggaaattgcnntctggcataacgccgggggctaactgtcggtgatatgggaccgggagtatca

SEQ ID NO: 56692 - DNA, 209 bp, Oryza sativa
aaaattaattttcataggtgggtctcttaacatacccgcatgaaaaaatgagcctatttttacaaacggcgtacctaccaccagctcaccaccaccctaaaatatcaaatttcctctctccactcctcactctctccccactcctcccttatcctctcctctcttctcatctcctctcctctcttcctacgacgtatggctccgacagt

SEQ ID NO: 56693 - DNA, 325 bp, Oryza sativa
atattgatagtgctatcaatgccgtgatctaagcatatgtatgacagcatatgttgttcactgttcaagtagagttaagtcatgcctgtcggtcctaggatacgtatcacaagacaaattggtcagaagaaaaaacttactcattgtgtgaaatagcatgtgaggaaataatgcatgggcattgtcctaatggagcatgggcacatagagggtaccagaatcttagcgccagatatgtcctaagggctatcgtaaggcgttctgtcaagcacataaagcatagattctcccatctaaagaattatttcagtgcttgggtgtggca

SEQ ID NO: 56694 - DNA, 1501 bp, Oryza sativa
acaattcatgtcaaaaagatcttaacaaggcagaatcggcatagtttggctaatctgggacgcttttgggcacccttgaagtgcagttttttttgttgggatggctattcttttctttatgtgtgcttcgcagacgaagaatagggccgggggctccaggttgtggatctcgttcttgattggcctggcccaggatcgctggcaactgtagcgatccaatgtcttgacaggctgcgcaaagcattccggcccatgtgatcgagttggaggatcagtttacatatggaataagtccacattgactcccttaactagtgaccgaatctgattcgtatcattgaaccgtaataccggatatctcgacccccaactattaaaaccggtacaatttaacttccttgacggttttgaagggtggtttcactgatgtggcatctacgtggtagtgttaacctggtctgtggtattggcaggacgcttaggtggcattagaattaagaacatatatgtgagccccatttgtcattcacacaacaaaaaaaaaattgtgaagctcattgacatgcgaggcccacaacgtcatcccctctgtatctttcttcctcctttctctctctctgtttcttttactctccacttcggtagtctccataagcggcgggatctggagcgatggcggtggtggtggatcagttaattaattaataacttattataatcgtgatttcatatcaactaattatttgataatccggggctattaattatggcataaatcatatgggggtgatcgagttggaagatcagtttacatctctctgggcgggtagctatttaagaagttgaggacgggggcgtggtgtactggtgtgcaggcaaggcaggctgcatctcatgggtgatctggcaggtcctgagttcttagaggcccagtgcaaaactaaacacatgggcccttaatatacaacgtaaataatagtcaataaatattaccccttaaattgcataacaacaatatttacataaaaacatcatacatattaccttaaaactttcttcaggcatttctatgtgaaatcattgatgatggtgccaatatcaatttcatccaataatttttttaatgcacaaaattgccaaaccatttagtctttctgttaacaactaaatttggtaattcaagtatcggagatggagatagaaccgaagcggaatccaagatagagatcgttccggaaacagagcgagaatcggctaaagtccaaatcggctgcgatcaggatcggcagagttcgagtcggactaggtagccgattgagccgattccgataatgtgactcggtattcgttatcgggttgagttaatgtgcttcatatggattgccacgcacggattgagtcctgagaaggcaattgtatctattaattaggatattttatgtaatttttttagagataagtttgggcaaaagtctgccacaaagacttatggtattttaga

SEQ ID NO: 56695 - DNA, 296 bp, Oryza sativa
  unsure (1)..(296): unsure at all n locations
ggtccccccnattganatcgataccgcatnnnnnnnnnnnnnnnnnnnnnnnnnnnnnnnnnnnnnnatgcaacatccctaaccacgcacgcatatatatatgaaaattttaatcgtgtgctgcattgatnnnnnnnnnnnnnnnnnnnnnnnnnnnnnnnnnnnnnnnnnnnnnnnnnnnnnnnnnnctgatgaatcccctaatgattttggtaaaaatcattaagttaaggtggatacacatcttgtcatatgatcaaatggtttcgcgaaaaatcaataatcagacaacaaaa

SEQ ID NO: 56696 - DNA, 340 bp, Oryza sativa
atcgattttgtgcaagttgagtttagaaaaaagttagtattttgagtttagtcgagatttgtgagaggagtgttgttgttgcactttgtaaacatgagtagaagtaagttcaatctacttttgaaatatcttcaatttgtatatgcttgggttcggcggtcacaccgacagcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcagg

SEQ ID NO: 56697 - DNA, 1501 bp, Oryza sativa
gtaaaaactctaattaagatattaatgtacatactgcatgatttaaaattaataaaaattgtaatcatcatatgtacttagcgtaggaattatattaaattaaatactaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgacgctcttcagcgtgccatcgcaacattctagcattccccttgttcctgaacaaacgccttagccgtggtattatagggaaataccacatcaccttagcaggaattctcttctttgttagctgtcacatcctgattttcgtttcaggatttataaattatttaataaattaataatagaatttatattaaatgttcattaatttacatgtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtatttttcacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtatcttatccgaatcaaactcgttttcgagtttatctccaaaaccgagtttttgatttcccggatcgatttc

SEQ ID NO: 56698 - DNA, 1501 bp, Oryza sativa
gccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacattagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatagacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagac

SEQ ID NO: 56699 - DNA, 1501 bp, Oryza sativa
ggaaaaagatttcatcacaatgctgcacggagttaatctctcagctggtacaattattgtcacgaccggaaataacccaacgggcgttccttacgtgcgtgtattattccttgtccaaggaggcaaggtacaccaaaagttgatacaattcagagtttaacaagcggaagcgtaaatagttaattattacatgggcagcgatggcccaacacactcaaagacaatgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtctcagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccaggcctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactatcaaaacaatgcaccccaagcccagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccattaatagagtgcccactagttggggttttgtttattctagggtgaacaaggtaataataacaataacaacaataataaggtcataacaaaggtaaataggcatggctaaataaaacagtgataacgc

SEQ ID NO: 56700 - DNA, 1501 bp, Oryza sativa
ccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttagatgccgcgttacaagcctgagtacctgtttggtgttgagggttttgtccaggagttgcgtacgatgtcctttgtcattggatttggaactgcccctttttatgcccagattgctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccacagggaagtgaccgtggcagttaccttgagactgaaggaattgagaatgatgttaccacaaagcatttggttgagatgttgtgggctatggatgaaagtcgtgcggagactgtgttagcagcccaagatcgtgaagattggaatcgtggtaagatttgcaagttagaagacaaggtggatcgtttggagaaggaattagccgcattaaagggagaagcaccgccgcagaaggccaggattcgtcttaccgcaaggaagagagctctatttgttcctcgctatcaattggcgccaaaggttcgtgtggtggagaaagaagttgccccagctcaagcggatcctccggtcatcatcataagtagtgatgaagaagaagaatccaagcgcaacaattccaagattgagtgggtagcaacccaagttgataaagacgagccttcaatcgacctccgatgcttggaagaactagagtgacttgttaagccgttgtcttagatcgatgtgttagtttgcttgttttaagtttgcttgtgtgtgtgggtcttgcatgtgatttacatcagtggtgggatgtaagtgcatgcgtttgtttgcttttgagagttaggaagttggtgagtttagtggtgtgagagtctttagtttgtaataataaaactcagttaagatcaataaaagttaaagtaattctctatctt

SEQ ID NO: 56701 - DNA, 1501 bp, Oryza sativa
acgacaatcactgatttcgagctgctgaactgaagggaagataacaccctcttcaacttcactaaataacatgctttcacatcctttgacggcaagtcttgttagggagctgagcttttggagatcagtcaatgaaacgtgtggcatttcttcgatactcatatcttctactttgtccaggttatcaaagaccaaagcacctctgtatccatgtgagatcagcttgttttcttgaagacgcaacaaatctgtcttacgctctgagacaataacacatgtcaacatggaagtgtgaggtatagggggcagtgacaacttggggcaattttcaatctcaagagaacacaggttggggaaccatctggtgtttatgtcttgtgcataggagacagagaacctagaggatggcacaagcagcatagagagattgggacaattttcacacctgatgcttgtaatctttgaaaacaaatggcaatgagctcccccaacccactccacaagttctggcatatcaacaaattcaactttcttcaagtgtgagaaactttgttgtgtaacaccaccaaaattaggttcaaaccgacgcgtgcttggaatattgttcaaagttagttcctctagctgcatcagttgaccaaaaggtgcgagaatgccccaagatacaccttctatatgcagagatttcaagtagtttacacaaatattaccacacaaccaactaggaccaatggaaccacctgggttctttatgacaagtgctttaagattagaaggtggttgaagaccttcaagaacatcagatcttgtggtccgttgcaccataccccaagctagctccaactttttcatattccgtttggacatcaattttgctttattagcttcttcccttgttgccactttctcaagattaaatattttcagttcaccttcaagatctgtcaaatcccctagctcacttagttcaaacccaatgtcccgttttttaacatggtactcttccaacctttgtaaatacttcatcttgccaatcccaggaatattggaacagagttcttttctagcatttaagaggcataaattgactagatgattgatgtcttttggcaaaatacatttactgtaccctaggtccaaaaatttcaagtgataaaatctacttactgcatttggtagagacagttctacgtcataaggtatttccaactttagataccgaaggtggatcagtttggaaaagttgtgcgggaaagattggagcgagtttgcatgcatgaatagaacacggagacgttttgtttcttttaataaatctttgaaaaggataagcatgcttgcattgccttctccaaaaagcatcaatgtccgtaaatttcctatgtctatttttctcttcaaattttccatttctctctcaaaactatcctcatagttatcttgtaaggtgatggatacatgacgaatggaccatggaatgttatcagacctgaaactgtat

SEQ ID NO: 56702 - DNA, 1501 bp, Oryza sativa
aaataaattaaaaataggatgttatttgggttgtcaggtaaagaataggtggaaattcaaataacatattttattttttatagtgaaatattggtaatattgattttaaattatttagctgtctaattatgaaacaaccgttcaaacaaactaacctccgtttcatattataagtcattttgacttttttcagtgaatttttaagtttgaccaagtttatagaaaatatagtaaaattttcaaaaaaaaatatattatggatatatatggaacgttatatctaacaaaacaattttgtgtgatagatgttgttaaatatttttatatatttggtcaaatctaaagaaatttaattaagaaaaaagttaaaatggcttataatatgaaatagagggagtaactttttaaaattatgattattttgctatgtaactattatcttttttctaaattgttggttaaaaatagatttattatttataaaagcatgcatcagatcattaatcatttatatatttaggcatgggacatgcaatcaagaatccacggccattctcgtgagatagaagtgaagaaattaattattaagtaataaaacaaaaatcttaactaccatagagaaaaaaaagaaagggatgaggagaaaggattgaggggaaggagatgagaacgtacggtagtagttgaggaatgatttttttatgagataaatccaattggcccaccagttcaagttatatattttttctaatttattggagtgccacgtggtggcttaggagtgtttataagagtctcatgtggcaacttaagagtgtttataggaagtttaatcgacttttagtatataataatagatagatagatatatagatatattatatgttgttaataagtatttaatttatttagatggcatgcaaacttgcaaaatgcacagtctataccacaataacatattgcttatatatagcaaaacattggatgtaaaattgtcaatttagttataaatagagcaatgttttaatagaatataaattagctatgtacatttaaattatggtcaacttaacttgtttttaatttgataatataaaataattaggataagaaagagatggagatataaaagaataggaagaggaagagacaggaagagcgtactactttcttatgtttttttctttttccggcccacggttatacgaagccacacgtaagtacggacgttttttttcataatttttttttctttttctggcccacagtagaggaagggattactttcttaaataataatagatctaatccaatggtctaaaatatcggatccaccaatttaagtgaaaatcgacggtgagattatatagtgccatgtggcggtctaggagtgtttgtaggagtgacacgtggcggattgagagcgtttgtaggaagtttaatggacttttagtatataactagcaaggaaacccgtgccgatgcatgggtaatttatttg

SEQ ID NO: 56703 - DNA, 1501 bp, Oryza sativa
tactgcaggatggataattttgagcaaattggatacaggtgtacatgaggcatgtatgccctctataaccaacttgattttattggacatgtctactcgattgaatgtcaacttgctaacatggtcaggaacatcactatgggacttgggtatatcatgtggatcatcggcgtcatctcgtgcagaggaacaacaaaaacatgaaagccagttaccggtggtatgatgaagagcatggcggccatggatgagcacttgaccacgaaggccatcgtctaccatgggagtggcctcatgggtgccgtcgatctggtcctggatgatgaagtactggagctcgtccaaaacatcctcagcctcgtcagcctgcttggtcaggatttctaggagcacccgtaggccatggttgtttctgacatctctctcttcggccgcgtcaagcagtccttgagtgtatgcaagatcggtcttgatttgctccatgttgaggccaagctctgtactggacacgtacgccgccaccatgccatcggacagctgtgtcaccacctttccgaggagccagctcgccgcaccgacggccacatccatggatggatctcctccgcctgcagatcgagaaagatggtgccagctgcagctggggttaattgggtttgagtgtttggtgctggacgtataagtttcagacttcagattggctctgagtccctgatgattctatttgtaccagtaaccaggcttgattgcttgatgaaacaaactactcatgtttgatgtctgcctcatgacgtcatggcattcgtcacatggctatatgttgattctgtccaaaatcttcttgttcaatactgtccattgccaccaccaatcttttgtggttggtaaggacatggattgttcagttttttatttcttttaaaaagattatttagtttatatggaagaagatgcatcgatttgttttaaatagtcctgagtctggtagcgacgaagatgaggagccccttgatttgtgaatgtggtctaatgatattagttcgtcagcgtaaaataaaagggatttgttgattgacacaactactcaaaaatagaagtatccacgtggagcattagtatagttaagtggtggtatcaatctatctatttattatagggattattatattattaaaatatcttaaaaagaagccaccatatttgctacagagactagaaattctcacattaatcaaggaaaagaaaagatttaaactattaaaccgcgacgatcaaaattagggatcttttggaggtcttagtgacttggctaaattcagatttctttcggacataaccaaggagcaaaagctagactttattgctctcttggagacatgcaaaagtgattttttaaatgcatgccttaagaacatttgtggaggtaaagactttttgtggcattggactagaccaaaagggagatctgggggtattcttttgggagtaaatttggaatttt

SEQ ID NO: 56704 - DNA, 199 bp, Oryza sativa
taagggagtctaagtggactttttcccgtgaagaagtacatccccgtacgtatagatgggccgggcccggccggcccatctaaagaagcggcttcgagagagagcaccctccgtacaaggagaggtcgcgagcccccaagagaagagaaaccccacgagcccccctccacctccacgccgcagccaacccaaagcgcca

SEQ ID NO: 56705 - DNA, 1501 bp, Oryza sativa
tcggatgccgcggccgcctcagcctcgctaacgatgttgctgtagtgtgctctctgatcggccgcctccggcaacgatcatgacaacgacggcgtattctggcccgccgccgttgcctttacctctttagttctccatgtcactgatgctgcgcctagtctcaaggtagcatatctgctagagctagagatgaagcttttcgatcgtaacttgatctcttgcagaattaactgatattcagataagagggttctatctagttctgctatatgcatttggttcagtcagaaaagatggatcgaaccagatgtcagcacgtgaaaagatatcgaattcaagcgataaattgataaccagtttcatgcgaagatttacatagtataggctcatctacattttcattattttgtcgctactaagaaaaaaaattaaaactggtagagacagccacgggaaaagggcacgacaatatgcaaatataaaaaaatacaatgcaaataatataatggaaaattagaggcgatggagatgacttaccgcatatttggtgatgaactactgatgcggtacctatgtacctacaactaatactatagacaattctaccatttttcatcttctagcaaattatcattttaccctttctacctaagtacctatattaatacttaaatactttttgtatgataccttttattatggagcgttggatttttactatttctggaatgcaaataccgtaaaacttctcctctatacaggagcaacgctctctttacactagcagtctttgtttttttcaattctcttgtttccttgccctcgggctggccgcctgggcggttgcattgcgttgtgtaacaaaaacattgtttttcttcaaatatattgacgtgcaattcttttacatgttcgcgaaaaaagtgaaaaccagagttatagatttttttttaaaaaaagtggaatctagtttgatttaatttttttcaatttggctgtttattgagcggtttgtcaacccaagtaggctcgaaatctcaaaaatttgtgaaaaccaagcggtttgttactcaagctggtttgaaacctcaatatttcgtgaaaaccgaatggtttttgtcagttttatggaaccttgagggcaacaagcatgtatttgtacatatacaaatgttttgcagatttagcacatccaccaaaaatattattgtcgtatacaaatatatgtatagaacgatatgacagcaataaattatacaagatataaagtcatttaatgtttcttaaggaagttatgtcatttaatgttggaacatatatctaaaactacaacaataatatgtaaatggaaaaaacaataaaatgtgtaaagatttgggatgtttaatctatctaaaactacaacaataatatgtaaatggaacaaaaacaataaattgtgcaggagatggcataaatgcaagaaaccatcagtacatctccaagattaagttggttgtgc

SEQ ID NO: 56706 - DNA, 338 bp, Oryza sativa
tctagcccaatttcagctggcggcctcctccgttgttcttctccgtagacttgtgaattttggcccagtttgtcatgtcagttctgagttcttgacccatttattcataagtctggttcctgacatcgtccgattgatttatcatttgcgttgatgtcgattctcctccactttattttcattctctacaaaaaggttagtatacctaatactagtggaatattattactctaacacatttatgcattgtaagcatcactagctctctcctattttggtagtattgacggtcgaaactgatcgataacgaccgtcaacaccgactcggttgttgaagt

SEQ ID NO: 56707 - DNA, 1501 bp, Oryza sativa
ttactatttttttttgttttttaggtgttctttagctgtgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtgtgattcgggaaaaaatcagcatatgcccctagaggcgcccggaccccccttatatatgggaaggagtccggattacaaaagataatctatattcctaacggaatatgaagatacaggtaaaatacagtcgtaaccgactaaatctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccgagtgcttcaagcttttcatgccaaggcctgctgagtagcgaagacgaagactgtaaagggcgaaaagataaagaatatggtgcatcgaatagatgcacctaattaggtgtagcctccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgccggcgaactagggttcacaactccgaccaaatccacctccgaaaagtgcatcaaaatccttcccgtgatccaccgcctcaatccctcacctctcccaagccatccctcgaatcaaatcagcacatttgaatgaaaccga

SEQ ID NO: 56708 - DNA, 1239 bp, Oryza sativa
aaaaaccctaagttgatcttcatgaaaagttagggtgacttgagtcaagactattccatttctcaattgcacgggatcgcatggtagacactataaagacccacaagtacaagtatggctttgaataatttgtttgtatgattattagtaaggaagtcataatcctattgtatagtccatagccttcactcgggacgagcaaaggttaagtgtgggggtgttgttgacggtccttaaatcataatatttgatggtcaatactttcatataataaaataaaatatggtattgttgatgcaaaaacacacactggcctgagagatctgcttaactctagtgcaggtcctaaatcttgcttttgggttcaaggtgtgccagttggtttgatcctgcaccccccaaaaatcaaagaaagaaacagagttaaatccataaacgatagccgattggccacatgccgatgacgtgtcgtttgtaacctagccgatgtaacgtgaattagatcagcaatgaaatataaagcaaaaagaatgttagatatagtcaatcggctgtagatatcaacagtatataatctatgtatcaaaatatgtttaaactaagtgattgggatagatcggatagattgccgagacagtataaatcacttaggtctaagagtactttaatataaagattatatatgttgatagcatagccgatgttgcagatctaacatgtatcggctaatactccgataccactaagatatcaaaatagacaaaatacattaaacatggattaatcaagtgttaaagtagattaacagattaataacaagcttaatatatttaattacagtgagatcttgatataaatggcaaatttagcatattaagtaaacctaaagtaaacaaaataaccaaatcaggtaagatcggctgaaaccccgatgaaacccaaatcggcaaccaataaactggctagagattgatattctaattacgacttataagatcaaacttaactgatgtagcaataactatgaaaagaagaacaatatctagaaaatcaagtcattggatgaatcatagagtggtagatatgctatattgtaggatcgaacaaggccagacaaacctaccagaggggggtgaatggtagggaaaaccaaaaacccaaaatcttttgcggaataaaagattacctcgaacgaagttgagcatcgccagtcgaaccgctcaatcaccgccgggcaga

SEQ ID NO: 56709 - DNA, 1501 bp, Oryza sativa
gaagaaatgcgagaagaccacaatctcatgagtatccggagacgggaaagtctcaccgtgcgctggtcgccacccgatgatctccttggcagggagaacgccgtgcgccaccatctccttaagattctcctccgttacgtcggatgacgcccattggccttcgaagctttctctctcttccgccatcggtttcattcaaatgtgctgatttgattcgagggatggcttgggagaggtgagggattgaggcggtggatcacgggaaggattttgatgcacttttcggaggtggatttggtcggagttgtgaaccctagttcgccggcgcagctttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttggaggctacacctaattaggtgcatctattcgatgcaccatattctttatcttttcgccctttacagtcttcgtcttcgctactcagcaggccttggcatgaaaagcttgaagcactcggattactatctttgagaaggctatgatggtcgactgcaaaggactcgggggctactgtggagattatgggtatcccatatctacacggcgacggtatttggattgggtaccggatacttaatgtagatagaatatcttatctgtatctcgggtttgtttcttaacttgtgtatcaaggaaacaccctgagatttagtcggttacgactgtattttacctgtatcttcatattccgttaggaatatagattatcttttgtaatccggactccttcccatatataaggggggtccgggcgcctctaggggcatatgctgattttttcccgaatcacacaatcaataatacac

SEQ ID NO: 56710 - DNA, 1501 bp, Oryza sativa
ttggaggtatcgaatcgttaatctatgctgcttttataggaagattatcggtgatttgctttatgttgtttggggtgggttcccagcatagaaagtgaatgtgtgattcttgaatgattatatgtgtgttgtttgaggctgagtcggtgtttattcaggtgataccacttcggaatgcaactagagttcatctcgtcatcggtaaaggcaagtaaatgtagcggtggtttgctacagctttaacctgttattttcctaccttcactttaaaattatatatcaataaccaataatcaagatagtattacaggtcgtagcaaggttttacctatctgaatcattgcttatcgttattgcactgtttatggttatactttatgctcttggttataataaccttatactggtctccatctaaggaatgtggtttcgatgttatactctggaattcatactgcatttgcatcacacttgcattgcatttgaagttatgctgtgaacctatggttgcgaccgtaccggtacatcatcgtatattgtcgtaatacgatgcagcttcacaccttgttgggtgcgaaggcaggagtacataccattgcattgcatatgcacatattgcaggatgttatgaaaactatcgatcgaagatgtctttgagaagtgttttcttctctcggagttgtgaatatatggatttgattggtgatgtcatgatgttttagtccttggatattgaacttgtctttatgtgaatcataacttggtatttaatcagctatataataaacctgtggtttaaataggttgttaaagccgtttgcttgctgagatttattctcaccccttatagtcttttcaggtacttgttgtgacatgtttgcatgaagggatgggattagctacactgttgcacaatatgatctcacttagtcatgattattgtaatatgttgataagattacttgtgtttagacataatgggttaattaaataatagagttatcgaccattgattaactttttttttcgaggctatccgtataagtcagtcagttgttgtatcatacccttgatctatatattgaggcttccgccatattgtttttaaaagagagatgctgctgaaatttctttgttttggcacttttatagggttctttagtggcatcccagacttgtgcagttttctagggtgttacaggatgtatctaggtacagccagtctctctcttgagcttatgtgtcgcctagggttagctttcatccactcctagtggtgcacagcttttcgctctcgcagcatccacacttatgcaagcaagaggagatgccctcttctttttataggcggcgtttgctccagttcgcagttgcacatttgccaataaaaaagagatgcttcctacatctctacaatattgtgccaacggatcataccttcaaggcaaaaggtcttgcacccgacgtgtgtgcatgactaaaccgctcgcctgagttggca

SEQ ID NO: 56711 - DNA, 779 bp, Oryza sativa
ttcaacacatgagaccctaagatgaaaaccctggatttgatattttcttatgggcgttgcaacaaacataaatattttaacatatcttgtttttagtaatggtcaggcctgtgtggatgatcaatcaactcctagttcgatatataatggggttgtatgtttttacccttttattattgctagtgatgtgataattttattttatttttatttttgccgatattaaggtaataattttttcaagcttagtggtgtagcagctgtgtgtacatctagttggtaaagaagccgaaagttacacttcctctatggaaaaaattaagaaatatacctagacttattggcatagattgttacgtacgtatatataccgataagtccaagtttgatttcccctccattcaaatttgatccactccatccaaaatttataaactatggcccttttttttttgctcttatgaacaaaaaagtagaggactactggactaaacaaatagattgttttccagttgttttttattaaaaaaattccagaagtcattcctgcactgtagtgtcgaatgttagatttaattagcttttttttacttaactgagttaattagttgggaccacacccgtaaacttgaaggattaaatgtcaccggtttataaaccataaaagaaaaagtcagtttaaaagtctaagcccaataaatcaaaacctaaactaaacaaagtggtggtttggtctagacattaatgtattatcctgtgtggatgttgattttcgcagg

SEQ ID NO: 56712 - DNA, 164 bp, Oryza sativa
ccctttcccctctttctccatggcttgatatctaccattcgtacaaaaggggaagggggaatgggagatcggaggattgtagtggtggtcatcacttgcacaccgttgcaagttcatgtccattgctttgtgcccccctctctctctcttcgccatcacacagg

SEQ ID NO: 56713 - DNA, 1501 bp, Oryza sativa
  unsure (1)..(1501): unsure at all n locations
tacaagaaaactctgctgttgcattacattgatttataatgtagatcgatgtttaaccactactacatgtgttttctcatttcttgacatattagtagatctggtactattcatgtgatatatctaaggccccatcgtttggcttattgatggaagaagccaaacgacatatttacaaacgaaaaataatttgtgaataaaccttttatatatgcgctcttagtgatctaaaagcaaaggttgaaaaataaacttcgataaaaaaaactcaaaatcaactccaaatttaaagttgaaaattcaaattttagctaataagcataagcataagtgaaaagacgaggctgtaaaagtgaaccatccctttgtttcatcaaaattaattttgacatgtcctaatcattctgacgtagcaaagtagagagaagcaaaaaaatctctgatcttacatatctggtagactgatactactgatgttcacaacaacatgaagtgaaatagtgactggtgagcatgccctcagctatttcgaataaatataagctaaatttataattgaagtcacatactcacatggctggatttccttttcctagatcaaaaactgaaatttctaatcttcataaaacagaactgaaacttccaacaggggagcagagcaggccgcctgaaatactgaaatagaactttattcagactgcagagcttttcatatttggtatgattgtcattgtacacattaaaaatctcattgaacagcgcatttaataaacattacaagaatataaattaagtctggaaatacaaaagactcgaccaaattatcatctatgtccattaagttggcaactaaagcacacttctgctttcctctgtaatggatatctgttataactgatactcaatgaatctggccaaacgaagaattgttctttccctcttcaattatcaacagcaccctttaaaatacatcaatggtccttccttactgttcatttttccaaagagaaaattgcactgcgatcagcacaaatgctcttctgtatcaatatctcctgttaaattgtcataagttataacagcaccatggaccctaaatatttcactgcttctgtatgcagtagttttttctcaagaaatggcagcactgtctgtctttgcttcatcaatactctcaaaggtcactacatttgctgttgaatatgctctcgccgacatcaaacttgcttgcacagttaggagtgagatagaaaagctgaganactcattgaaggctatntggctgttcttaaagatgctgaaaggaagcaatctacatctagttcacttaaacattggctggaaaacctcaaagacattgtctacgacatagatgatgttctcgatgacgttgggacacgagcattgcagcagaaagttggaaaaggtgaaatccgtacttattttgctcaactattcatttttccttttgaactgggaagaaagataagaagggttcgtg

SEQ ID NO: 56714 - DNA, 1501 bp, Oryza sativa
atcaagcaatcaagcctggtacaaatagaatcatcagggactcagagccaatctgaagtctgaaacttatacgtccagcaccaaacactcaataaacaagggttgtttatttgcatgcgtcccagatcccgcatcaagcaataaaggtgtatgatctgacaattctctattcagagctctgaccgttgctaacaggaatttcacttcccaatccatgctcataagcaccctatccaacttctcaaaagtttgattttgtagagcattcgcccacgtaaatttacgtccagtgagctccagctctctcaagtctaagctatctatgacagcgttaaacaagaaaggccacttatcactatacttgtcattgtttttctcgctagggtttcgaattatattgaaatcccctccaattagaatcggcaaagactcttttctacaagatctgacgagttcagtaaggaaagcctccttatactcctcttgcgcagccctgtaaactgctacaaggatccattggaaggcattttccttattccgcacatgaaactttacatagaagtctccttcatcaatactagaaacgtcaaaaaattccaaatttactcccaaaagaatacccccagatctcccttttggtctagtccaatgccacaaaaagtctttacctccacaaatgttcttaaggcatgcatttaaaaaatcacttttgcatgtctccaagagagcaataaagtctagcttttgctccttggttatgtccgaaagaaatctgaatttagccaagtcactaagacctccaaaagatccctaattttgatcgtcgcggtttaatagtttaaatcttttcttttccttgattaatgtgagaatttctagtctctgtagcaaatatggtggcttctttttaagatattttaataatataataatccctataataaatagatagattgataccaccacttaactatactaatgctccacgtggatacttctatttttgagtagttgtgtcaatcaacaaatcccttttattttacgctgacgaactaatatcattagaccacattcacaaatcaaggggctcctcatcttcgtcgctaccagactcaggactatttaaaacaaatcgatgcatcttcttccatataaactaaataatctttttaaaagaaataaaaaactgaacaatccatgtccttaccaaccacaaaagattggtggtggcaatggacagtattgaacaagaagattttggacagaatcaacatatagccatgtgacgaatgccatgacgtcatgaggcagacatcaaacatgagtagtttgtttcatcaagcaatcaagcctggttactggtacaaatagaatcatcagggactcagagccaatctgaagtctgaaacttatacgtccagcaccaaacactcaaacccaattaaccccagctgcagctggcaccatctttctcgatctgcaggcggaggagatccatcca

SEQ ID NO: 56715 - DNA, 1501 bp, Oryza sativa
gtgcagcctcaaggaattggtggtctacaagaaagccgatgacgagattcatctctactctttagcagatgatttgttcttagaggtggcaacaaggatgacgaaagtaatacctgcgggaggttcctacttccaacagctggaaaaacttgaggtggacagcatctcggcagtgcttgttagccccatttgcagtctcctcgctgccaacctccgcgagttgcgattcaggtatgatttgtggatggaaagcttcacagaagaacaggaagaggcacttcagctcctcacctccctccaatgcctgaaattccggaagtgccttcgtctgcagtccctccccgaagggttgcattgcctttattctctctataaactaaatatcgctggatgtccggaaatcatgtcgctgcccaaggacggcttcccggtctcattggaacgtctaagaatacgagactgcagcatcgatttaatggttcaagtcaaggaattagaagcatcaaacccagatttacatatacggctccactagcaaacttaccacccaaggtaaaacaaggtgctctcccaactcctacatcttttttccccatttcgtctctaacctttcgaactaactaaaactcgttttttattgtttgttgttaatgatgtagctatccagcaccattgcctcatctggaacctttcagagttcttccatcatcgtatagctgacaatgtaaatgcgaattacacgacaacacatgaagataaagagctctggatggcagagcagccactttggctttcagacataatggatgtcctttgtctattatccaatcaatgttatattgatcattacaattttggtaacttacgttctctgtcattacacttctttccatctcaaactgcatggtgaattttggcaggttgcagctgcgtgatatcgaaatccacctgcacttgtatgatctgtacagatccaatagcgacattttgccaatcagccgtgctggttttttttagaaaatagattaaaccggcctctacatccaaaatagatacacagccaggccgtgctggttagtaaatatgcttatgtcgttttgctatttttttctttttggactgaaactagtatagtattgtagaatgtcccgctcttggtcttactttctgcttattactagtagagtgctcgtgcgttgctacgggaattttgttgatcacgggaaaacaaaatctggcaatccaaaagaaactacaagtcatagttgttctaagattaatttaaaagcaagatatatgttataattacagaagcgtagtataacctttttggcgcataaaacaatctcatggcgtttattaaattataaaaagcaacataaatagaagacagctaatctccaggtacgctttcttgatgaccctcgcacggacaatccaccattttcagtgtatgtgatccatttgtacctcgtggaaccgaacaattctgatgtgacca

SEQ ID NO: 56716 - DNA, 1159 bp, Oryza sativa
ataagtgattttacaaaataagtggtcccttttttggatagggctaatgccaagttagtctacgcatgtgaatggaatccacatgccctggaggctcttcaacgtaatgtcatggacaaccatgtggcagatcgatgtattatacttgaaggagataaccgtttgacagcacctaaagtaatattggttccaaagtttacttgttgatctacctgcactaggatggcttctaaccatttacttctttaactgatattaggggattgctgaccgtgtttgtcttgggttgttgccctcgagtgaatgtagctgggacactgctgtgagggctttaaggtaaacctccccagagttctttccagatttaggcaatattatatacatacagagaggcctagctcaggtttgccaagcttgacttgtgcacttgtattggtatattggtttgtttttttttttaagaatgtgtttgattgagctttcacaaggtgaattcaagccatatcatgttaaagttcacgattgttttaaactttgaagaaagggaaataaacgcttggaatagctcaaagattttcgaataaacaaaatccctaagccaacagttccctgcagcctatcatcatccaactggtgacctctaagtctgctcttaagtgcttatctttgtaacccctaaaaacgtgaatataggctgagcagtagctcctaagctatctttgttactaagtgacggttggtagttgcaagctaggcaatctttagttaggttgtttgtcaattggcactctgaaagtgcctgcgtggtggttctttcagggtgcttatcgtcaacatgcagagctagtggttctagtggtatttttgatgggacagtgccacgtttctgaagttctcttaggctttcatgtgcatctcaaaatatccagaagaatgtagtataactttgcaaaagaaaaaatattactagacattatattggaaaacatacagggcactgaaagcaactggatatgctttaaattacatggttacttcaccttgagagttgagagtcggaacacaatttgttagtggcttgttgatgtgctggatgcacgacgaacacacgacgaacatatgaagttctgactctgctgtgttttacttcatatgtagg

SEQ ID NO: 56717 - DNA, 1501 bp, Oryza sativa
agtaatattggttccaaagtttacttgttgatctacctgcactaggatggcttctaaccatttacttctttaactgatattaggggattgctgaccgtgtttgtcttgggttgttgccctcgagtgaatgtagctgggacactgctgtgagggctttaaggtaaacctccccagagttctttccagatttaggcaatattatatacatacagagaggcctagctcaggtttgccaagcttgacttgtgcacttgtattggtatattggtttgtttttttttttaagaatgtgtttgattgagctttcacaaggtgaattcaagccatatcatgttaaagttcacgattgttttaaactttgaagaaagggaaataaacgcttggaatagctcaaagattttcgaataaacaaaatccctaagccaacagttccctgcagcctatcatcatccaactggtgacctctaagtctgctcttaagtgcttatctttgtaacccctaaaaacgtgaatataggctgagcagtagctcctaagctatctttgttactaagtgacggttggtagttgcaagctaggcaatctttagttaggttgtttgtcaattggcactctgaaagtgcctgcgtggtggttctttcagggtgcttatcgtcaacatgcagagctagtggttctagtggtatttttgatgggacagtgccacgtttctgaagttctcttaggctttcatgtgcatctcaaaatatccagaagaatgtagtataactttgcaaaagaaaaaatattactagacattatattggaaaacatacagggcactgaaagcaactggatatgctttaaattacatggttacttcaccttgagagttgagagtcggaacacaatttgttagtggcttgttgatgtgctggatgcacgacgaacacacgacgaacatatgaagttctgactctgctgtgttttacttcatatgtagggctgaaggtggcatgctgcacatacatgggaatgtcaacgactcggatgagtcgctctggttggacaatgttgttaagtccatcactaacattgccaaaacacatggtacgatttgcccttttatacacacaagagttgcgaagcattcgacacggttaaaattaccatcttatgctaccgttgcttttcatttttgtctcaggactgtcttggaacgtcacggtggagcatgtcgaacgcgtcaaatggtacggtccgcatatacgacatctcgtggttgatgtcaaatgccgggcaacctaacaaagcgaaagacttgtccaaaatccatgtgctgtaggttgtggtgtatgacaattttgcttactccgtttctggttaatccagagaattaaactatttgtttgttacttcagaaggaagtttgttcagacttttctcaatagcaaagcatctatcaacatttaagtatcatacaaaatatttcctgacatcttattggctgtggctgtgcctg

SEQ ID NO: 56718 - DNA, 550 bp, Oryza sativa
atgtagatctttattttagaaaaatttagcaacttgaaccacctgaaacggatctacggttatttagttatgattttccgaagatttaatctattagaaaaaaaactggaaaagaggaatcatgacgtcatgctgacgtcatcatcaccggcatgacacgggcgacgacctcgccggcgatagagagatcggccgggctatccaagggcacctacgcgtagaggacgtcgagacgaacccgatggtactcaccaaaacgtctcacgacaaccgacgacggccggcgacgacgcaagaggcggcggcggctcggttgaacggcggcgtgtgtcacgcccagaaattcccgaatataattccaagcagaatgtgcataaaaatccccgtccaggaccagccggggtacacaaacgacaatgttgacatacagatccacgtcttacaaacatcataaagtcttacataaatgcagcggaagaaaagaaagacaacaggagctaagccttgactaaactttgactaaactacagcgggaacaccactccacagg

SEQ ID NO: 56719 - DNA, 658 bp, Oryza sativa
taaggttaacacaaacaatcgtgatataggtttatgatttttttttataggatacagcaggagaggctcctactgtggtttaggtttttatccttatgctcatcatactagacatcctgcctgttgttttaggtgttggtgctaggagtggtgaaattttgattaaacctaaaactaaagacactgtttaaatttgctagcatcatgacttctttaaatgcatcatcttctaaatctgatgttgtgattgcaaaactgcctgttgctactcctgttgctaagtcatctgtttctgtttttgcttctaatcaacgtgagaaatacacctgttcgttttgtggtaaagatggacatcttgtcagtttctgttttagacttgctagaaaacagaaaaaggaacgtgaaattgcttttgcgaaaaagaagtggcaaaaatcaggttctatttcgaggcaggcggtcagaccacagtagaactggcggtcagaccgacgctctactaccgatcagaccggcgatagacctatggttagaccgcaggtgtctcagtgatcagaccgacctcgggaaattttttctaacaggaaacgggttgaattttcttctggttatgctcctgttggttctggtcgtgtgtctcagtactggattcctaaat

SEQ ID NO: 56720 - DNA, 998 bp, Oryza sativa
tcacatcgagcgtgttgaatgctacaagtaatgaacctctgatcacgtgctattctctgtaggccatgcaatagcttttacaaaaagcggggaatatagctcatgctttaatttgtaacacttcatctgttacttttgggtgtactctttctttctttctttctttcttttttcttgtcttatttttttttacaaatgaagtataacttacagtctctgcattggatttacacaaccatatttgcaatattagaaccctaactgatagagttatacacttgcaactttacgactacattaaaggtgcattttgtatgtttcataggttattttttttgaaatgtacaacataatttaggtctattttgttcaacaagaacacaacatattttcgatggtgttgctaatttatatgtatttgttttttatatacaagtttccatgttgtgcaagaggatacatacaaattttcatatttttgaaagttctaatgagataaagtaattgttaacattgtatgtctataagggtattttgggttttttttaaaaaaaatccaacctatggaaatatttaagaataattgataaagtcaccggtataatagatatatagacaatatcagtgaaaaattatagaactgtgacaaattcagtggtatggagtagattctctgtaacaccctaggtattctcctacctagtatgctacacactacggaacaaaaaacactaagtcctaaattcattaagaattttgacagtctcccctgtaaatatggacatttaaggctggcagttatatattaaactattaataatattattcccacagtgcgatcgatccatataatccattaaaagaaacttatagttatctaaaagattattataagaccaaactaggatatagttcaagtgttattatggacctaagtaatatagtttgatagtgtgcatatagatctgtatataattaagggtgctacttcccgccca

SEQ ID NO: 56721 - DNA, 1290 bp, Oryza sativa
tcctccaattggcgaaatacaaagacacagaaaaactgacagtgccccgaactaacaatccaaaacactgcacctaaacccatcctctaaccctccaaaaatgatgaattaaaacaataaaacaacctacaaccactactataggagaggtaagcctcacctagggtttgcttggagaacttgtgagaatatgatgggaacaccaacccaccactcctcctgctccccacattttcctcgatctgtttttccaatcagattcttgataagggctatggttcttagagatccatggagtagggttaacaggggagaaaagaataggtgagttccatgcatgggtgccaagggaaaggtgtggcggcctccgttggatgcaccagcagcggcggcgcagaagcggagatgcggacgaatatcatctagtatacttatatagttcatccttactaagtagtgtagttaatactatttctctcttctctcatgaagccatatcacccgaattatttctaacctctggatgatagatctatagtacaattatcttttctttcttctcgcataaaaccattcaatctcaattattttgaggcttaaaattcataaataccaattacataatatatattcaccttgcactatatttgcaaccatgtgcaaattatataaaatacatgaggtcattttgttttggttttaaatgatcatattgcaccttaccttatttgtacatattatgcaacataatttcccacagcaacacgacgggtattcatccagtattacaaacgattggtcccatttgatgaaacatcacattttcactacacatgttctttctcccacccacttaaggacttgaatttgtcctctaattctagttgactctcatcatggtaaaaagaccatggtgtattgcaacagttatggcatatgaagtagcataggtcaacacatatgttcataattgttgccttgttgaaccggtttgctacaaaaggggtttgaggaatttgtgaaaaaaattgacaataaatcttaggaaataaattgcagattaaatacgatgtatagagaacaatctccagacttacatattcatggtttgttgtgtacctaccgttgaccgtaagcatcttgtgatgaggacacaactagcttggatatgaccatgactaacttatgtattcatcaactaaaggtgcatatgttctatgttagatttacttattatatatttgaacaaacattacgacaccatgagttttgtattttttcgtttgcaga

SEQ ID NO: 56722 - DNA, 272 bp, Oryza sativa
tagtcctcggagccttcaaaaggagttcggtaaagtctcttgtatcttttcctcttcttttgtaaaacttctactttcaatagaataatcttctttatataattcaggtgctttattccaatcttagaatatgcgtaccgactttatagtattcatgaatagtataatctgtgtagctaaatcttctgggaattgcattggtgcgggtataatgtctgattattcggttgctcaacataaattgctaactgaatatttggttgctctataga

SEQ ID NO: 56723 - DNA, 255 bp, Oryza sativa
ccgctcctataaaatgcacttctttgatcacttgtatagcaagagggcttggggttattacaaatgatcaaattgcttatatctcagtctctcgtgtttatataaatgaatcataactagtgcaaggtcatactttgaaacatggagcagatgtgaccttagtattcttccaacccggttgtagaaatgaaatcctgttacctaacccggggtatcatttgtataactgttatgcactaaccattcccctgcaga

SEQ ID NO: 56724 - DNA, 176 bp, Oryza sativa
gggcccgtcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcaga

SEQ ID NO: 56725 - DNA, 1501 bp, Oryza sativa
gtcaaggtatattatggttacagagattatccgcaagcgcacggatataccattgtagcatttcacctgagagttttccaagggtatcgtatttgtttatcccgtgggaagattataatagagagaactaaactaatatttatatgttacttgtactagtcgtgcctaagaaggggtaaagataattccagggtagaatgacacacaagctcaagctactcattcctatattaaatctctaagctaagtggaaagaatatagaaaagaatctattcctatacttctagtatacatagtgtacatacatcctaaatatatgattaactagctattaccccctttctgatgccctcctggtacttcgagaagccacccctgaccgccgagttcccttacgacagcccgtcatggaccatacaaccagggctaaatacggaggagtaccctccccagggaattaacttaggattatatacacgcaggggggaatacccgtagcgagctgtcaccatcagcggcccacctttcatccgcagcatataacccccaaataatgataccctagtaatctagacacccacgtctaaactacccagatactactctaatatcatcgtcatgacatagagtaattgcatatgcaaacattatacccgtaccaatgcatctcctagaaaagctagcagtataatcataatatctcggacatattgtaaagctggtattcatatattcggaaaatattacaatactagagtcgtatatagaggaatattctaaattaaatactagtcttgcaaaagaagaaaggaaagctactagaggccatacccgaactcttccaaagacttccagactccgactactattctattcctactccactagcttaagaacactaaactaaacttgagagagagtgagagcttcgatgcttggagtgtgtgaagaaatggagggagtgaatgccttaaataggctgccaatgacggttatggcagttggaattgtcaggattgccctctaaccgtcattggggagtgatccaagccgtccacttggatcgaacggccgtgagggaggttcggccgaaccctgggctaggccaaaccagcccattttcggctggcgggctcctttgcttctgctctttgtagacttgtgaattttggcccaaattgatcgtgtcaattctgagtttctggcccatctacacacaattctgtttctcgacatcgtccgattgattattcgcttgttttgatgccgattcttctccatttatggctcattctctgcaaagggttagtgaaccaagtgctagtggtttttattttattatgacactaaatgcattgcaagcataactagttcttcatttattccggtaatattgacggatgtaactgatcgatgacgaccgtcaacaggcaatagtcacctcccttcttttgcacaccaatggttagtgggtccgtgtcacaattatagccgttggag

SEQ ID NO: 56726 - DNA, 312 bp, Oryza sativa
aacccggtgaaacacaaatcgaagacaatacgcacacaatacctccatcgtatgccatatggaatcttcaccaaccacatgcatcaactctagccttagtatcccgcatgatatctgatcaccacggacatcgtcttaccaccaagccgactcccggtccatcaccacagatactctcccgagacatcgaatcacctacacatgaaacaaacaaagaaacaatattccgggaccaagctatcccaaacttgactcattagtagcaaataatagtatctcatacgtatagtatccatctagaagccataacca

SEQ ID NO: 56727 - DNA, 1501 bp, Oryza sativa
cggcatcaaaacaagcgaataatcaatcggacgatgtcgagaaacagaattgtgtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctgggtagtttagacgtgggtgtctagattactagggtatcattatttgggggttatatgctgcggatgaaaggtgggccgctgatggtgacagctcgctacgggtattcccccctgcgtgtatataatcctaagttaattccctggggagggtactcctccgtatttagccctggttgtatggtccatgacgggctgtcgtaagggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaactt

SEQ ID NO: 56728 - DNA, 1342 bp, Oryza sativa
tctgtacccttattgtgggctgttttttaaatttgcatgattgactcagtggttatatacctctacacttgttctttatggataagaacagagtatctacacttgttctttttttatgcataagaacagattttctgcacttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggatttaagtgccatttggacatataaccattcatggagtgtgtactgctatatatgttgctagacctattgaattttgtggacttgcatttatactcctgctgctgttttatgtcaatcatgcaaattctgtacccttgctgctgctgttttttaaatttgaatgattgattcagtggttatatacctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgtcctattttatttgggttgcttttttctcctagtagctgatttcctctttttatcccttcatgcaaatgattgtaattgatgcatatttctcagcaaaactgaggccatatctttcatagtataccccgtcactacattggatctaatgctatttagtctaatggtaggaaatttataatctttttcgcgaaagttaaacca

SEQ ID NO: 56729 - DNA, 893 bp, Oryza sativa
ccccaccttagtagtatgtctacattggtatctatagctctctcatgcattgcctcgtttttctctatagactatctctaagttagtagatagttttgctctctctcttcatttaatacattccaagtaggaaaatatgctgacatggatctcttgtagagagcctatagataaccattgtgggtgccctaagggcagtagcagtgtaagctatggggtctatacccataaggccctagctcaaagtcacagtttaaagacattcaccccacaatacaaacacccatatatatatgtggtttaattggatggagacacaggtggaggaaatcgagcccacagtgcagcgttacccaagcatgtggacacgaggtacgggacgaaatttcttccccacctaccccttccagctagcgactttctcctcctctactccatcgccgtcgcctgcctctcatcccgcgccgcttcgcttatcctcccgcgccgccgctccacttctcccccgcacctccttcccctcccttcggcggccgaggcggatgtggtggctgtagcggcggatgtggtggtcgacgcagacggatgtggtggcagccgcgcctccttctcctctcctcccaagcagcagtcggcggcgcggtcttccatagtgaacgcgaggaggacgaagaggtaggggagtagatccggcaggcggcagcgagttcttggcggcagcgaggaggaggaggaggagatgggggcgtagatccggcgggcggcggtggcgatgaggaggaggaggaggtggggacgtagatccggcgggtttttggcggcgggttctttgtggtggaggcgtccccggcagcgggttcttggcggcggcggtgggttctcatccggcccca

SEQ ID NO: 56730 - DNA, 1501 bp, Oryza sativa
agtaacatcttgatattggtggtggtcgatcggtaggtgttgggtcctcctacttgcctagtcggcacttcacttgatgttgtaagcacgatgcatcaatttacatgtgttgatttttgtctgaattcgccaacttgaattatctagaaaagataatttggagaagattgatacggaattggctgaacactcctattttattgctatttccttaatatatataaatatatacacgtatccccgtatcctaatattttgaaaaatgacgtatcctcgtatcaccgtattgcgtatccgtatccgtatccccgtatcgaggtaacatagatcaccatcaccagtagaaatttagcaaagttagagatttgtcacctgcatgtgcattgcttgcagtgtgcgtgcgtcctaacatgagaaaacaaataatcctatgcattcgaccttctccaaaagaaacatatttagtgcacataaacgagaaagctcattagcacataattaattaagtattaataattataaacttaaaaaatggattttttttaatttttaaacaacttctatatagaaatttttttaaaaaaacgcatcatctttgaaaaaagtgctaacagaaaacgagaaagttgaagtttgtagttgaagagaaaaaactaggccaagccattagtaatttagtatccccttggtaaaaacatgctattaatactttagggcttgttaactttgttgacatttttaacctttttaaatttttggtattaacaaaatttagcaagacaacaaactaaacataacattatcaacacaatcctaccaaaataatctctagaactttgagcttgtttggattgagacctacttttgccctaccaaatttttagcaactccaatagtatcttatgcatgattgttttgctatcaatttttgctcatacaactacaaactctatgctactaattttggtagtgccaaaacttgccaaagatattggcctaccaaatattttttacaaaaaaaaaaccgcaccaggcattgtgtagtttcatattgatataatagaaaaaatattacaaaattatagccctggaaggctataaccaggaaaaagcaaacaaacacaccaccaccacctgctagcagctcttcacacaacctaggagaaaagcgttagcactgagccggacatcactaagcgtgaccaatcactgctagaccttaaggagggtcgcaaacgtcttgccgaacaccgaaaccacacaagacgacaaccgagaaactagcgaggaccgacctaaggcgaggtaagaaacgaagatctctatctcttgagcctccaggcaaggcaagagacgaagatctcctaagcctcttggcaggtcatgacgcaattattaagaccggattggaccgggaaaaaccggaaccagagcctctgtcggtccggttaaaagactggatatgctatgtgtgggagtatgtgcaagcaagggagcagtc

SEQ ID NO: 56731 - DNA, 1501 bp, Oryza sativa
gaccgacagaggctctggttccggtttttcccggtccaatccggtcttaataattgcgtcatgacctgccaagaggcttaggagatcttcgtctcttgccttgcctggaggctcaagagatagagatcttcgtttcttacctcgccttaggtcggtcctcgctagtttctcggttgtcgtcttgtgtggtttcggtgttcggcaagacgtttgcgaccctccttaaggtctagcagtgattggtcacgcttagtgatgtccggctcagtgctaacgcttttctcctaggttgtgtgaagagctgctagcaggtggtggtggtgtgtttgtttgctttttcctggttatagccttccagggctataattttgtaatattttttctattatatcaatatgaaactacacaatgcctggtgcggttttttttttgtaaaaaatatttggtaggccaatatctttggcaagttttggcactaccaaaattagtagcatagagtttgtagttgtatgagcaaaaattgatagcaaaacaatcatgcataagatactattggagttgctaaaaatttggtagggcaaaagtaggtctcaatccaaacaagctcaaagttctagagattattttggtaggattgtgttgataatgttatgtttagtttgttgtcttgctaaattttgttaataccaaaaatttaaaaaggttaaaaatgtcaacaaagttaacaagccctaaagtattaatagcatgtttttaccaaggggatactaaattactaatggcttggcctagttttttctcttcaactacaaacttcaactttctcgttttctgttagcacttttttcaaagatgatgcgtttttttaaaaaaatttctatatagaagttgtttaaaaattaaaaaaaatccattttttaagtttataattattaatacttaattaattatgtgctaatgagctttctcgtttatgtgcactaaatatgtttcttttggagaaggtcgaatgcataggattatttgttttctcatgttaggacgcacgcacactgcaagcaatgcacatgcaggtgacaaatctctaactttgctaaatttctactggtgatggtgatctatgttacctcgatacggggatacggatacggatacgcaatacggtgatacgaggatacgtcatttttcaaaatattaggatacggggatacgtgtatatatttatatatattaaggaaatagcaataaaataggagtgttcagccaattccgtatcaatcttctccaaattatcttttctagataattcaagttggcgaattcagacaaaaatcaacacatgtaaattgatgcatcgtgcttacaacatcaagtgaagtgccgactaggcaagtaggaggacccaacacctaccgatcgaccaccaccaatatcaagatgttacttgcccttgctttctcttgataaatcagcagctgcatgagcagccgcgctagcacta

SEQ ID NO: 56732 - DNA, 1501 bp, Oryza sativa
aactaaataaccgtagatccgtttcaggtggttcaagttgctaaatttttctaaaataaagatctacatattaaaattgtccataaattgaattaaatttatttaattctttttaaatgggctttaattagatttaatcttgtaaaattcataataaattcatttgaagtcggaataaggccgttcaagtctcataattcatctaaaatcatgatctacatgtttgtttactttatatgtattgtttatttggtttttattagtctttttcttcgttttgcgtgttagcttgtcgtttccgtcgttgcgaagattcgtgagtgcgtcggaagtgatcaagaagattaattgaagatcggttattgcaaggcaagtcacacagatcctaaacacaatcctttgagcatgttgatcctatatttaaattctctatttatttcaactatgcatttattttcgaatgtcactgggtggtgtgaacctattcctttgttatggccaatttgcattgaatgccctattccttgataccttgggtaataaattgattagcttgaaccttatgtattggtttggttcagctaaatgttatatatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttaccgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaaaggtgcgctgtaatggattatgctgtgcaaggggtattgtcacaactcctttccgaggtaccgtggtggtactgagacacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatactttggaatccttgtgcacttgcatatttgctgtgtggcttgttgagtatgtcatatgctcattcttgcaataatcatcaaacctcagt

SEQ ID NO: 56733 - DNA, 1501 bp, Oryza sativa
taccgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaaaggtgcgctgtaatggattatgctgtgcaaggggtattgtcacaactcctttccgaggtaccgtggtggtactgagacacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatactttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagccggagcttcgctagattttattttccgctgcagttttcttcttgatgaggattaagtgcctcataagtaagtatttatcgttttagttaatttgatgaatctgtatattaaattgtcagtttgtgtacctcggctgattcctggacgaggattttatgcacaaataagttcggaaattattagtgaatttctgggcgtgacaagttggtatcagagccatctcaactgttggataagccaaatggtcaaattttaaggacgaatttttccgacaaaaatgatttgtgaaaatttctcctttcttccttatctagaattctttacaaattgtttcattgtctactctcttctctcgttcaacttgagtagttctgaaactaaactagtggttgaaacctgaagacgccaatgaggtctactgatggaggttaagtaaagtggatcgaggaaggaccaaagtgcccagatgtcaagatggaatgaagttggcatcctgccttagaacctatcccgccaaagtgtctttgaagaatagttagtagggtagaacgctgttgtttgctttgtgtgtaggtatggttgcattcccgtcatagatgtagtccagtgatgagcgtgcaactgtactaggttgtttgcttaaccaacttaaacaatataatggtctacacacatcagatcagtgttaacctggttaaggtcttgtctttagtgtaacctctctccttctatcttttctaatctgcaacaga

SEQ ID NO: 56734 - DNA, 1501 bp, Oryza sativa
ggcatagtagggtttcatttgcaaaagcagcatttagcaaacatttgagaatttgagaaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaacgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaaaccatcatgaaataatagtgaatcattagttatcccgaatatgtgctaatgtttctaagcagggctaagcaattatatctaatatctagttgaactaatataaataaagctcaactagtcaaattgtaataacccaaggtatcaaggaataaggtaatcaagtacaaaagggccataacaaagaataggtcaattccacccaatgacattcgaaaacagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcggaaaagagcaaaatcaccaaaacagcacataaacaaacatgaacagtacatgtggatatttttaatgtgtagatctcaattttagaaaaatttagagacttgaaccaactaaatcggagctaagatgaattagttatgaatttttaaagattaaatcggattaaaacacttaaatcggttagaattgaattatgacgcaataatgaattatttttaaaaaggaaaagagggtttattgcgtcagcgggctagggtttgggtggaccgggcgcacaggcggcggttcacgcgaacggacggccgagatcgatccatccaaaacggacggccgagatcgaacggtctacgaccggctcacggcggacgaccctga

SEQ ID NO: 56735 - DNA, 1342 bp, Oryza sativa
aagactaacccgactgctctcttgaccctattctgcccaccgacgattgacgggagttggaaacataacacaaaggggatctggggaggaatatgttgggagttgacctcccagctaaggaaaccgagggtggatcactcaacgcttattcccacctgatcgacgctagttgttttcttaattacaaattacccacattgattggtagagcctaatcttttggatttcttttgatctccctcaatgcaatattaacatgggagtatgctcttgttagaataattgggctaggcccaatttatcctattaaatctcaaaggcccataataagtgttaaggaaaataataccacctcaggatttaagcgaggaatatcttaacctaaatagggggttattggaggcttcctgttgactggttgaggtgggggtcggaaagccacgcgcgcgcgcgccgggcgtgggcgtgggcgtgggctaggcgtggctggcgggcgtcacgtcgttattcttttgcaaccacgaacccacgttcccacgactgccttcgcaacggcgcgtccacgatcccacattgcaaccacgaacccacgttcccacgactgcctccgcaacggcgcgtccacgatcccacgttcccactactacctctctcctgatagataaggaggtcgcgagtccgatcagaacgatttctcgggtgttagttcctccttcgtttctgatcgcttgcacgcacaagagattggaaggagcagggcctctggaatcacaccttcgcctgagatctgcaccggtaggtgggtgatcaggtttttggggagtgcttcccgcacgactgctcgtcctcgtccaccatgtctgcgcctggagctgcagacggagatggcgcgcctggagctggagccggagccgcaattctgcctcacaatccagcggagggccattctcggggtatatccttctcctgttgttagcgttgttaatcctgttagtcgcaatgttaatcctgttagtcgcaacttgctatgttcctgttcctgatgttcatgcctttagcatactggttatgttatatgttcctgctcctgatgttcatgcctttagcatgctactggttatgttacatgttgtcactagatcaccctacactattcatgccatgattattgtcttaatattttggattaaaatatgccgatatatgaccatatttccaacaatccaaaaacctgataggtcattttcagtagttggctttgctgctgcactgaaaccacatgcttttgatggtcctaattataagagatggaaagcacgtgcactattgtggttgacagcga

SEQ ID NO: 56736 - DNA, 393 bp, Oryza sativa
gctaaagcttgtgctatcccaatttcttcccaatggccttgcttgctagccgataccctcttataccaagccgtccaacttttcacagttgatggccatgacttgatggtgtttttccagattcctagattggggctggctagcctaaaagggattttcttgggttcggcattgatgaactatgttggatctagattgccgatgggaccgaggaagtactgattggggtaagttaaactcgggattgcgatttgatgagaggattgctacagaagaaaagaaaaggaaggcgaattgagcaaggaaagaaccaatctactgcaaaagaaagggatctagacgaccgaaacttacctcagggaactcagccgatggggcgcttgatggaccagc

SEQ ID NO: 56737 - DNA, 489 bp, Oryza sativa
aaaccatattccgagcacatgttcgtcccaacttgactcacattagtaaggaactatccaaatccgacaaaccaacccgaaaccaaagcaaatctagaacctgccagtcagaccgcggcctggccggtctgaccaccgcatgacctgcggtctaaccggtggcattcagccggtctgaccgccaggggtcaaccgtgccattacttgacaaaatcaaacatctattaatcttcgaaatcgcatcataagaaaccaatatttcacacatgaaatgtcacaaaccaccaatattttcatcacacagaagctaaatcaactccttgattttacatatataatctaagttagcgttgatatctaaccctatcggctgccttctaacaataaacgtttgtcgattgaaggttagatagcaatattgctctagattatatagaatatatggataaatcagcagcttacatagacaatattagaatgtcataaaga

SEQ ID NO: 56738 - DNA, 258 bp, Oryza sativa
acaatcaagctattggaagcttcatagagtggtagatatcctatataatctaagccaacgtcgatatgtaacataatcggctgctccctagcgatagatattagccgactagaggttagatagcgatattgtcagagattatataagatatatgataactcgacaacttacatgaacaagattagagtatcataaagatgtaagcactaatcccgagaacgcaagccgccataacaagttttacctcttagttgaaga

SEQ ID NO: 56739 - DNA, 267 bp, Oryza sativa
ctcggagaagacgagcggctatggtccaggttgaaacaaatggtaatatgaagtggtccaaggtgaaaaactcagctaaaacctgacccaagctgtaacatgggtaaaaatatatggccaaaatgaaatttactttttttttttaccaaagaaatctccctgtagcggttcgcgaggagtttgctcgtcttccttccctttcttcctgccttctctctcgctgctcccctgctcggcgcctcgatccgcggttgttcccgccggaga

SEQ ID NO: 56740 - DNA, 211 bp, Oryza sativa
ggaagtttggcgctctcttcgatttctacctcaacgagtgtagctttccatgaggaccggaagctactcactcttatattaaatctctaagctaagtggaaagagtattgaaaagaatctattcctatacttctagtatacatagtgtacatacatcctaagtaatatgattaactagctaataccccctttccgatgccatcctggtagt

SEQ ID NO: 56741 - DNA, 648 bp, Oryza sativa
cacgggcggggaaaacaaacaaaatgagcctaccaagggagctagtactgtacccacttaaaccgataaaacgctcatctgatactaatactgataatgataatgaggtcatatatcaatacaacacaagaaatgatattttctaccactaattctcttcctaatgccactgagccagcgatggcatggcacatcggccgctcatggtttgatccagaaataaaaatcggatcgagtcactatacagagtatctattttggggatcaattttctcgctcttttgcgagaaattcgtagacagaaatgaatctagtagcattttattatctgatttgcacagattggattcagaatccacttcctctgcggttggtctggagggaaggtgagagagggggagatgaggagtcacaggctaaccttcgccgccatcgtcgctcgccgttggctgaagggggacaagcggactggatggctcccggtgaacgacggctagagccgccgccgcccgcagcatccatctccgccggcggccgccgccggcgaccgggtagcggctagccggcgagagagcggagaaagacgaggagcaaatccgcgaggtagagagaaaggaaacaggagactgacatatgggaccatgtagc

SEQ ID NO: 56742 - DNA, 868 bp, Oryza sativa
aattgctaaaaaaccgtcacagcaaaaaactttgaaatttaactataatattgttgtagtgcaactataatataattacactatagttacattataactgcagtgtaactatactgtaactatatggtaatttttatataagttaaatataaaatcgcatatattattttagtacttatatacaagtattttatagttatagtatagctatagtgaaattatattacaattattggaattatattatggagtagttatgtgcagtttttttagatagtcccatgcccgatggatccaaatcgaaaaaaatactaccataattgaaccataaacttattttaacataaaattatatatcggaatttaagtgaattatgtcctaagtgtaaaaaaataaaaataaagtaaattttatgaaaccccacataacatagttacacaaaatcaccgggattttggcacgtggcacgtaaccttatgtattttcacaaaaccacactattgataaattttgctcttatctatcacactttgagttttacaaactcatctcaaaaccacaacgtgttttgtccatcgtataaatattacatccactttttaaaattttaatatatgagtacatcagaatggttaatgttatggttttgtgaaattttagaaccataatacccaatttgtgttgcatgttaaaatctctatggttttacaacttatgtaacctgtaacctgcatcatgataggtggagttttctgaaatttactcgaaaatttatatcgagcggaactttattttcactactacaatacctattttcctatgtgggcattttgattatctcgtgcagtagtccggcccgtctgcagc

SEQ ID NO: 56743 - DNA, 154 bp, Oryza sativa
ataatgtattggatggcaatgggtctgttgaatacagctagtggaagtaaggaggcaataagaatgggagagagatattttagtgagcttgcagggagatctcttttccaagactatgtttttagtcatgatggcaccatctcacattgtaaaa

SEQ ID NO: 56744 - DNA, 471 bp, Oryza sativa
ttaggccctctttgtttagacttataagccaacttataagtcaaaaagtctaaaccaaaacaaacaagcagcttttttatttggcttttttaagccataagccactctaacactattaaggccttctttgtttaggcttataagccaacttctaagtcgaaaagtctaagcctaaacaaacaagcagcttttccgtttggcttttttgaagccataagccactctaacactattaagccaaaagctaggttgaagaagcttttttggcttatgtgaggtagatgtatgactcaactactaaacttaggacattaaatccaccggcttataaatcatttaagccaataagctgacttaaaagtctagcccaataagcctaagcctaaacaaagagggcctaagccaaaaactaggttggagaagcttttttagcttatatgagatagatgtatgactccaccactaaactta
